(12) United States Patent
Bakaletz et al.

(10) Patent No.: US 8,283,114 B2
(45) Date of Patent: Oct. 9, 2012

(54) **GENES OF AN OTITIS MEDIA ISOLATE OF NONTYPEABLE *HAEMOPHILUS INFLUENZAE***

(75) Inventors: Lauren O. Bakaletz, Hilliard, OH (US); Robert S. Munson, Jr., Hilliard, OH (US); David W. Dyer, Oklahoma City, OK (US)

(73) Assignees: Nationwide Children's Hospital, Inc., Columbus, OH (US); The Board of Regents of University of Oklahoma, Norman, OK (US)

( * ) Notice: Subject to any disclaimer, the term of this patent is extended or adjusted under 35 U.S.C. 154(b) by 662 days.

(21) Appl. No.: 11/917,368

(22) PCT Filed: Jun. 15, 2006

(86) PCT No.: PCT/US2006/023428
§ 371 (c)(1),
(2), (4) Date: Jan. 20, 2011

(87) PCT Pub. No.: WO2006/138527
PCT Pub. Date: Dec. 28, 2006

(65) Prior Publication Data
US 2011/0135646 A1    Jun. 9, 2011

Related U.S. Application Data

(63) Continuation-in-part of application No. 10/795,159, filed on Mar. 5, 2004, now Pat. No. 7,241,867.

(60) Provisional application No. 60/691,214, filed on Jun. 16, 2005, provisional application No. 60/453,134, filed on Mar. 6, 2003.

(51) Int. Cl.
*C12Q 1/08*    (2006.01)
(52) U.S. Cl. ...... 435/6; 435/252.3; 435/320.1; 536/23.7
(58) Field of Classification Search .................. None
See application file for complete search history.

(56) References Cited

U.S. PATENT DOCUMENTS
6,797,274 B1    9/2004    Ruelle et al.

FOREIGN PATENT DOCUMENTS
| WO | WO-99/24578 | 5/1999 |
| WO | WO-02/34768 | 5/2002 |
| WO | WO-2004/078949 | 9/2004 |
| WO | WO-2005/111066 | 11/2005 |

OTHER PUBLICATIONS

EBI Accession No. P44079, Full uncharacterized protein HI0938, Nov. 1, 1995.
Harrison et al., Genomic sequence of an otitis media isolate of nontypeable *Haemophilus influenzae*: comparative study with *H. influenzae* serotype d, strain KW20. *J. Bacteriology*. 187(13):4627-36 (2005).
Partial European Search Report, EP 08 02 2435, European Patent Office dated Apr. 23, 2009.
Anderson et al., The hFbpABC transporter from *Haemophilus influenzae* functions as a binding-protein-dependent ABC transporter with high specificity and affinity for ferric iron, *J. Bacteriol*. 186: 6220-9 (2004).
Andrews et al., Bacterial iron homeostasis, *FEMS Microbiol. Rev.* 27:215-37 (2003).
Bakaletz et al. Recent advances in otitis media. 7. Vaccine, *Ann. Otol. Rhinol. Laryngol. Suppl.* 188: 82-94 (2002).
Bakaletz et al., Demonstration of Type IV pilus expression and a twitching phenotype by *Haemophilus influenzae*, *Infect. Immun.* 73:1635-4 (2005).
Barenkamp et al., Cloning, expression, and DNA sequence analysis of genes encoding nontypeable *Haemophilus influenzae* high-molecular-weight surface-exposed proteins related to filamentous hemagglutinin of *Bordetella pertussis*, *Infect. Immun.* 60:1302-13 (1992).
Barenkamp et al., Genes encoding high-molecular-weight adhesion proteins of nontypeable *Haemophilus influenzae* are part of gene clusters, *Infect. Immun.* 62: 3320-8 (1994).
Barenkamp et al., Identification of a second family of high-molecular-weight adhesion proteins expressed by non-typable *Haemophilus influenzae*, *Mol. Microbiol.* 19:1215-23 (1996).
Bayliss et al., The simple sequence contingency loci of *Haemophilus influenzae* and *Neisseria meningitides*, *J. Clin. Invest.* 107:657-62 (2001).
Bearden et al., An ABC transporter system of *Yersinia pestis* allows utilization of chelated iron by *Escherichia coli* SAB11. *J Bacteriol.* 180:1135-47 (1998).
Bergman et al., Position-based scanning for comparative genomics and identification of genetic islands in *Haemophilus influenzae* type b, *Infect. Immun.* 71:1098-108 (2003).
Bishai et al., A peroxide/ascorbate-inducible catalase from *Haemophilus influenzae* is homologous to the *Escherichia coli* katE gene product, *J Bacteriol* 176: 2914-21 (1994).
Bolhuis et al., TatB and TatC form a functional and structural unit of the twin-arginine translocase from *Escherichia coli*, *J. Biol. Chem.* 276: 20213-9 (2001).
Buscher et al., Evolutionary and functional relationships among the nontypeable *Haemophilus influenzae* HMW family of adhesins. *J. Bacteriol.* 186: 4209-17 (2004).
Chang et al., Identification and genetic characterization of *Haemophilus influenzae* genetic island 1. *Infect. Immun.* 68:2630-7 (2000).
Collet et al., Oxidative protein folding in bacteria, *Mol. Microbiol.* 44:1-8 (2002).
Cope et al., A gene cluster involved in the utilization of both free heme and heme:hemopexin by *Haemophilus influenzae* type b, *J Bacteriol.* 177:2644-53 (1995).
Cope et al., Binding of heme-hemopexin complexes by soluble HxuA protein allows utilization of this complexed heme by *Haemophilus influenzae*, *Infect. Immun.* 66: 4511-6 (1998).

(Continued)

*Primary Examiner* — Jennifer Graser
(74) *Attorney, Agent, or Firm* — Marshall, Gerstein & Borun LLP

(57) ABSTRACT

The invention relates to the polynucleotide sequence of a nontypeable stain of *Haemophilus influenzae* (NTHi) and polypeptides encoded by the polynucleotides and uses thereof. The invention also relates to NTHi genes which are upregulated during or in response to NTHi infection of the middle ear and/or the nasopharynx.

7 Claims, 15 Drawing Sheets

OTHER PUBLICATIONS

Cope et al., Involvement of HxuC outer membrane protein in utilization of hemoglobin by *Haemophilus influenzae, Infect. Immun.* 69: 2353-63 (2001).
Cripps et al., Bacterial otitis media: current vaccine development strategies, *Immunol. Cell. Biol.* 81: 46-51 (2003).
Daines et al., *Haemophilus influenzae* Rd KW20 has virulence properties. *J. Med. Microbiol.* 52:277-82 (2003).
Davis et al., Evolution of an autotransporter: domain shuffling and lateral transfer from pathogenic *Haemophilus* to *Neisseria, J. Bacteriol.* 183: 4626-35 (2001).
Dimopoulou et al., Site-specific recombination with the chromosomal tRNA(Leu) gene by the large conjugative *Haemophilus* resistance plasmid, *Antimicrob Agents Chemother* 46:1602-3 (2002).
Erdos et al., Development and characterization of a pooled *Haemophilus influenzae* genomic library for the evaluation of gene expression changes associated with mucosal biofilm formation in otitis media. *Int. J. Pediatr. Otorhinolaryngol.* 67:749-55 (2003).
Evans et al., Haemin and nicotinamide adenine dinucleotide requirements of *Haemophilus influenzae* and *Haemophilus parainfluenzae, J. Med. Microbiol.* 7: 359-65 (1974).
Forchhammer et al., Identification of a novel translation factor necessary for the incorporation of selenocysteine into protein, *Nature.* 342: 453-6 (1989).
Genbank Accession No. CP000057, *Haemophilus influenzae* 86-028NP, complete genome. Aug. 30, 2007.
Genbank Accession U05670, *Haemophilus influenzae* Lex2A and Lex2B genes, complete cds. Oct. 12, 2005.
Grass et al., The *Haemophilus influenzae* HMW1 adhesin is glycosylated in a process that requires HMW1C and phosphoglucomutase, an enzyme involved in lipooligosaccharide biosynthesis, *Mol. Microbiol.* 48: 737-51 (2003).
Gray-Owen et al., Characterization of transferrin binding proteins 1 and 2 in invasive type b and nontypeable strains of *Haemophilus influenzae. Infect. Immun.* 63: 3809-15 (1995).
Gray-Owen et al., Identification and characterization of genes encoding the human transferrin-binding proteins from *Haemophilus influenzae, Infect. Immun.* 63:1201-10 (1995).
Greiner et al., Nontypeable *Haemophilus influenzae* strain 2019 produces a biofilm containing N-acetylneuraminic acid that may mimic sialylated O-linked glycans, *Infect. Immun.* 72: 4249-60 (2004).
Griffin et al., The role of lex2 in lipopolysaccharide biosynthesis in *Haemophilus influenzae* strains RM7004 and RM153, *Microbiology.* 149: 3165-75 (2003).
Halsey et al., The ferritin-like Dps protein is required for *Salmonella enterica* serovar Typhimurium oxidative stress resistance and virulence, *Infect. Immun.* 72: 1155-8 (2004).
Heath et al., Non-type b *Haemophilus influenzae* disease: clinical and epidemiologic characteristics in the *Haemophilus influenzae* type b vaccine era. *Pediatr. Infect. Dis. J.* 20: 300-5 (2001).
High et al., The role of a repetitive DNA motif (5'-CAAT-3') in the variable expression of the *Haemophilus influenzae* lipopolysaccharide epitope alpha Gal(1-4)beta Gal, *Mol. Microbiol.* 9: 1275-82 (1993).
Hood et al., Biosynthesis of cryptic lipopolysaccharide glycoforms in *Haemophilus influenzae* involves a mechanism similar to that required for O-antigen synthesis, *J. Bacteriol.* 186: 7429-39 (2004).
Hood et al., DNA repeats identify novel virulence genes in *Haemophilus influenzae, Proc. Natl. Acad. Sci. USA.* 93: 11121-5 (1996).
Hood et al., Genetic basis for expression of the major globotetraose-containing lipopolysaccharide from *H. influenzae* strain Rd (RM118), *Glycobiology.* 11: 957-67 (2001).
Hood et al., Identification of a lipopolysaccharide alpha-2,3-sialyltransferase from *Haemophilus influenzae, Mol. Microbiol.* 39: 341-50 (2001).
Hood et al., Three genes, IgtF, lic2C and IpsA, have a primary role in determining the pattern of oligosaccharide extension from the inner core of *Haemophilus influenzae* LPS. *Microbiology.* 150: 2089-97 (2004).
Imlay, Pathways of oxidative damage. *Annu. Rev. Microbiol.* 57: 395-418 (2003).

Jarosik et al., Identification of a new locus involved in expression of *Haemophilus influenzae* type b lipooligosaccharide, *Infect. Immun.* 62: 4861-7 (1994).
Jiang et al., Fimbria-mediated enhanced attachment of nontypeable *Haemophilus influenzae* to respiratory syncytial virus-infected respiratory epithelial cells, *Infect. Immun.* 67: 187-92 (1999).
Jin et al., Characterization of hgpA, a gene encoding a haemoglobin/haemoglobin-haptoglobin-binding protein of *Haemophilus influenzae, Microbiology.* 145 (Pt 4): 905-14, (1999).
Jones et al., *Haemophilus influenzae* type b strain A2 has multiple sialyltransferases involved in lipooligosaccharide sialylation, *J. Biol. Chem.* 277: 14598-611 (2002).
Kilpi et al., Bacteriology of acute otitis media in a cohort of Finnish children followed for the first two years of life, *Pediatr. Infect. Dis. J.* 20: 654-62 (2001).
Li et al., Identification and characterization of genomic loci unique to the Brazilian purpuric fever clonal group of *H. influenzae* biogroup aegyptius: functionality explored using meningococcal homology, *Mol. Microbiol.* 47:1101-11 (2003).
Lowe et al., tRNAscan-SE: a program for improved detection of transfer RNA genes in genomic sequence, *Nucleic Acids Res.* 25: 955-64 (1997).
Maciver et al., Lack of expression of the global regulator OxyR in *Haemophilus influenzae* has a profound effect on growth phenotype. *Infect. Immun.* 64: 4618-29 (1996).
Mohd-Zain et al., Transferable antibiotic resistance elements in *Haemophilus influenzae* share a common evolutionary origin with a diverse family of syntenic genomic islands. *J Bacteriol.* 186: 8114-22 (2004).
Morgan et al., Bacteriophage Mu genome sequence: analysis and comparison with Mu-like prophages in *Haemophilus, Neisseria* and *Deinococcus, J. Mol. Biol.* 317: 337-59 (2002).
Mortan et al., Effect of multiple mutations in the hemoglobin- and hemoglobin-haptoglobin-binding proteins, HgpA, HgpB, and HgpC, of *Haemophilus influenzae* type b. *Infect. Immun.* 67: 2729-39 (1999).
Mortan et al., Identification of a haem-utilization protein (Hup) in *Haemophilus influenzae, Microbiology.* 150: 3923-33 (2004).
Munson et al., Partial analysis of the genomes of two nontypeable *Haemophilus influenzae* otitis media isolates, *Infect. Immun.* 72: 3002-10 (2004).
Munson et al., Purification and comparison of outer membrane protein P2 from *Haemophilus influenzae* type b isolates, *J. Clin. Invest.* 72: 677-84 (1983).
Munson et al., Purification and partial characterization of outer membrane proteins P5 and P6 from *Haemophilus influenzae* type b. *Infect. Immun.* 49: 544-9 (1985).
Munson et al., Purification, cloning, and sequence of outer membrane protein P1 of *Haemophilus influenzae* type b, *Infect. Immun.* 56: 2235-42 (1988).
Novotny et al., Detection and characterization of pediatric serum antibody to the OMP P5-homologous adhesin of nontypeable *Haemophilus influenzae* during acute otitis media. *Vaccine.* 20: 3590-7 (2002).
Novotny et al., The fourth surface-exposed region of the outer membrane protein P5-homologous adhesin of nontypable *Haemophilus influenzae* is an immunodominant but nonprotective decoying epitope, *J. Immunol.* 171: 1978-83 (2003).
Pauwels et al., Purification and characterization of a chimeric enzyme from *Haemophilus influenzae* Rd that exhibits glutathione-dependent peroxidase activity, *J. Biol. Chem.* 278:16658-66 (2003).
Pomposiello et al., Redox-operated genetic switches: the SoxR and OxyR transcription factors, *Trends Biotechnol.* 19: 109-14 (2001).
Poole et al., AhpF can be dissected into two functional units: tandem repeats of two thioredoxin-like folds in the N-terminus mediate electron transfer from the thioredoxin reductase-like C-terminus to AhpC, *Biochemistry.* 39: 6602-15 (2000).
Poulsen et al., A comparative genetic study of serologically distinct *Haemophilus influenzae* type 1 immunoglobulin A1 proteases, *J. Bacteriol.* 174: 2913-21 (1992).
Reidl et al., Lipoprotein e(P4) is essential for hemin uptake by *Haemophilus influenzae, J. Exp. Med.* 183: 621-9 (1996).

Reilly et al., Contribution of the DDDD motif of *H. influenzae* e (P4) to phosphomonoesterase activity and heme transport, *FEBS. Lett.* 494:19-23 (2001).
Reilly et al., Outer membrane lipoprotein e (P4) of *Haemophilus influenzae* is a novel phosphomonoesterase, *J. Bacteriol.* 181: 6797-805 (1999).
Ren et al., hgpB, a gene encoding a second *Haemophilus influenzae* hemoglobin- and hemoglobin-haptoglobin-binding protein, *Infect. Immun.* 66: 4733-41 (1998).
Richer et al., Horizontal gene transfer of "prototype" Nramp in bacteria, *J. Mol. Evol.* 57: 363-7 (2003).
Roberts et al., A nomenclature for restriction enzymes, DNA methyltransferases, homing endonucleases and their genes, *Nucleic Acids Res.* 31: 1805-12 (2003).
Rodriguez et al., Prevalence and distribution of adhesins in invasive non-type b encapsulated *Haemophilus influenzae*, *Infect. Immun.* 71: 1635-42 (2003).
Roman et al., Dynamics of long-term colonization of respiratory tract by *Haemophilus influenzae* in cystic fibrosis patients shows a marked increase in hypermutable strains, *J. Clin. Microbiol.* 42:1450-9 (2004).
Ruffolo et al., Identification, purification, and characterization of the type 4 fimbriae of *Pasteurella multocida*. *Infect Immun* 65:339-43, 1997.
Sawitzke et al., Suppression of chromosome segregation defects of *Escherichia coli muk* mutants by mutations in topoisomerase I. *Proc. Natl. Acad. Sci. U.S.A.*, 97: 1671-6 (2000).
Schlor et al., Characterization of ferrochelatase (hemH) mutations in *Haemophilus influenzae*, *Infect. Immun.* 68: 3007-9 (2000).
Sethi et al., Bacterial infection in chronic obstructive pulmonary disease in 2000: a state-of-the-art review, *Clin. Microbiol. Rev.* 14: 336-63 (2001).
Sirakova et al., Role of fimbriae expressed by nontypeable *Haemophilus influenzae* in pathogenesis of and protection against otitis media and relatedness of the fimbrin subunit to outer membrane protein A, *Infect. Immun.* 62: 2002-20 (1994).
Skoczynska et al., Prevalence and serotype distribution of encapsulated *Haemophilus influenzae* isolates from patients with lower respiratory tract infections in Poland, *J. Clin. Microbiol.* 43: 938-41 (2005).
Smoot et al., Fur and iron transport proteins in the Brazilian purpuric fever clone of *Haemophilus influenzae* biogroup aegyptius, *J. Med. Microbiol.* 48: 629-3 (1999).
Smoot et al., Genomic analysis of the F3031 Brazilian purpuric fever clone of *Haemophilus influenzae* biogroup aegyptius by PCR-based subtractive hybridization, *Infect. Immun.* 70: 2694-9 (2002).
St Geme et al., A *Haemophilus influenzae* IgA protease-like protein promotes intimate interaction with human epithelial cells, *Mol. Microbiol.* 14: 217-3 (1994).
St Geme et al., Secretion of the *Haemophilus influenzae* HMW1 and HMW2 adhesins involves a periplasmic intermediate and requires the HMWB and HMWC proteins, *Mol. Microbiol.* 27: 617-30 (1998).
St Geme, The pathogenesis of nontypable *Haemophilus influenzae* otitis media. *Vaccine.* 19: Suppl 1:S41-50 (2000).
Suzuki et al., Synergistic Effect of Adenovirus Type 1 and Nontypeable *Haemophilus influenzae* in a Chinchilla Model of Experimental Otitis Media, *Infect. Immun.* 62: 1710-8 (1994).
Touati et al., Lethal oxidative damage and mutagenesis are generated by iron in delta fur mutants of *Escherichia coli*: protective role of superoxide dismutase, *J. Bacteriol.* 177: 2305-14 (1995).
Vergauwen et al., Exogenous glutathione completes the defense against oxidative stress in *Haemophilus influenzae*, *J. Bacteriol.* 185: 1572-81 (2003).
Vergauwen et al., Glutathione and catalase provide overlapping defenses for protection against respiration-generated hydrogen peroxide in *Haemophilus influenzae*, *J. Bacteriol.* 185: 5555-62 (2003).
White et al., Hemin biosynthesis in hemophilus. *J. Bacteriol.* 85: 842-50 (1963).
Zhao et al., Iron and hydrogen peroxide detoxification properties of DNA-binding protein from starved cells. A ferritin-like DNA-binding protein of *Escherichia coli*, *J. Biol. Chem.* 277: 27689-96 (2002).

International Search Report, European Patent Office, PCT/US2004/007001 dated Feb. 17, 2005.
International Search Report, European Patent Office, PCT/US2006/023428 dated Nov. 10, 2006.
Ackerley et al., A genome-scale analysis for identification of genes required for growth or survival of *Haemophilus influenzae*, *Proc. Natl. Acad. Sci. USA.* 99: 966-71 (2002).
Altschul et al., Basic Local Alignment Search Tool, *J. Mol. Biol. 215*: 403-10 (1990).
Anderson et al., Human Serum Activities against *Hemophilus influenzae*, Type B, *J. Clin. Invest.* 51: 31-8 (1972).
Anderson et al., Quantitative Filter Hybridisation, Chapter 4: 73-111, *Nucleic Acid Hybridisation: A Practical Approach*, IRL Press Limited, Oxford, England, 2000.
Badger et al., Identification of *Escherichia coli* K1 genes contributing to human brain microvascular endothelial cell invasion by differential fluorescence induction, *Mol. Microbiol.*, 36: 174-82 (2000).
Bakaletz et al., Evidence for Transudation of Specific Antibody into the Middle Ears of Parenterally Immunized Chinchillas after an Upper Respiratory Tract Infection with Adenovirus, *Clin. Diagnostic Lab. Immunol.* 4: 223-5 (1997).
Bakaletz et al., Frequency of fimbriation of nontypable *Haemophilus influenzae* and its ability to adhere to chinchilla and human respiratory epithelium, *Infect. Immun.*, 53: 331-5 (1988).
Bakaletz et al., Modeling adenovirus type 1-induced otitis media in the chinchilla: effect on ciliary activity and fluid transport function of eustachian tube mucosal epithelium, *J. Infect. Dis.* 168: 865-72 (1993).
Bakaletz et al., Protection against Development of Otitis Media Induced by Nontypeable *Haemophilus influenzae* by Both Active and Passive Immunization in a Chinchilla Model of Virus-Bacterium Superinfection, *Infect. Immun.* 67: 2746-62 (1999).
Bakaletz et al., Relative immunogenicity and efficacy of two synthetic chimeric peptides of fimbrin as vaccinogens against nasopharyngeal colonization by nontypeable *Haemophilus influenzae* in the chinchilla, *Vaccine.* 15: 955-61 (1997).
Baldwin, Effects of Otitis Media on Child Development, *Am. J. Otol.* 14: 601-4 (1993).
Baltes et al., *Actinobacillus pleuropneumoniae* Iron Transport and Urease Activity: Effects on Bacterial Virulence and Host Immune Response, *Infect. Immun.* 69: 472-478 (2001).
Barenkamp et al., Outer Membrane Protein and Biotype Analysis of Pathogenic Nontypable *Haemophilus influenzae*. *Infect. Immun.* 36: 535-40 (1982).
Bartilson et al., Differential fluorescence induction reveals *Streptococcus pneumoniae* loci regulated by competence stimulatory peptide, *Mol. Microbiol.* 39: 126-35 (2001).
Berman et al., Theoretical cost effectiveness of management options for children with persisting middle ear effusions, *Pediatrics.* 93:353-63 (1994).
Black et al., Efficacy, safety and immunogenecity of heptavalent pneumococcal conjugate vaccine in children, *Pedriatr. Infect. Dis J.* 19: 187-195 (2000).
Bosse et al., Urease activity may contribute to the ability of *Actinobacillus pleuropneumoniae* to establish infection, *Can. J. Vet. Res.* 64: 145-50 (2001).
Bright et al., The Prevalence of Tympanostomy Tubes in Children in the United States, 1988, *Am. J. Public Health.* 83: 1026-8 (1993).
Cardillo et al., Synthesis of the phenylserine-leusine dipeptide fragment present in the antibiotic lysobactin from an aziridine-2-imide precursor. *Eur. J. Org. Chem.* 2000: 2489-94 (2000).
Chiang et al., In vivo Genetic Analysis of Bacterial Virulence. *Annu. Rev. Microbiol.* 53: 129-54 (1999).
Chissoe et al., Strategies for Rapid and Accurate DNA Sequencing, *Methods.* 3: 55-65 (1991).
Cimons, Lurid Reports Obscure Reality of Strep a Outbreak, *ASM News.* 60: 527-8 (1994).
Cormack et al., FACS-optimized mutants of the green fluorescent protein (GFP), *Gene.* 173: 33-8 (1996).
Davis et al., Liposomes as adjuvants with immunopurified tetanus toxoid: the immune response, *Immunol. Lett.* 14:341-8 (1987).

DeMaria et al., Biotypes of Serologically Nontypable *Haemophilus influenzae* Isolated from the Middle Ears and Nasopharynges of Patients with Otitis Media with Effusion, *J. Clin. Microbiol.*, 20: 1102-4 (1984).

DeMaria et al., Immunization with Outer Membrane Protein P6 from Nontypeable *Haemophilus influenzae* Induces Bactericidal Antibody and Affords Protection in the Chinchilla Model of Otitis Media. *Infect. Immun.* 64: 5187-92 (1996).

Devereux et al., A comprehensive set of sequence analysis programs for the VAX, *Nucleic Acids Res.* 12: 387-95 (1984).

Dhandayuthapani et al., Green fluorescent protein as a marker for gene expression and cell biology of mycobacterial interactions with macrophages, *Mol. Microbiol.* 17: 901-12 (1995).

Dunn et al., A vector for promoter trapping in *Bacillus cereus. Gene.* 226: 297-305 (1999).

Ehrlich, et al., Mucosal Biofilm Formation on Middle-Ear Mucosa in the Chinchilla Model of Otitis Media, *JAMA.* 287: 1710-5 (2002).

Erickson et al. Chapter 3: Solid-Phase Peptide Synthesis. *The Proteins. v.2*, Academic Press, New York: 255-527 (1976).

Eskola et al., Efficacy of a Pneumococcal Conjugate Vaccine Against Acute Otitis Media, *N. Engl. J. Med.* 344: 403-9 (2001).

Eskola et al., Potential of bacterial vaccines in the prevention of acute otitis media, *Pediatr. Infect. Dis. J.* 19: 72-8 (2000).

Eskra et al., *Brucella abortus* Genes Identified following Constitutive Growth and Macrophage Infection, *Infect. Immun.* 69: 7736-42 (2001).

Fleischmann et al., *Haemophilis influenzae* Rd KW20 section 45 of 163 of the complete genome. EMBL H132730, Database accession No. U37230, L42023 (1995).

Fleischmann et al., Whole-Genome Random Sequencing and Assembly of *Haemophilus influenzae* Rd. *Science* 269:496-512, 1995).

Fleishchmann et al., Histidine biosynthesis bifunctional protein hisB. UNIPROT: HIS7_HAEIN, Database accession No. P44327 (1995).

Giebank, Immunology: promise of new vaccines, *Pedriatr. Infect. Dis J.* 13: 1064-8 (1994).

Goosen et al., The regulation of transcription initiation by integration host factor, *Mol. Microbiol.* 16: 1-7 (1995).

Green et al., Certain site-directed, nonenzymatically active mutants of the *Haemophilus influenzae* P4 lipoprotein are able to elicit bacterial antibodies. *Infect. Immun.* 73: 4454-57 (2002).

Gritsun et al., Analysis of flavivirus envelope proteins reveals variable domains that reflect their antigenicity and may determine their pathogenesis. *Virus Res.* 35: 307-321 (1995).

Henriksen et al., Negative regulation of STAT92E by an n-terminally truncated STAT protein derived from an alternative promoter site. *Genes Dev.* 16: 2379-89 (2002).

Holmes et al., Adherence of non-typeable *Haemophilus influenzae* promotes reorganization of the actin cytoskeleton in human or chinchilla epithelial cells in vitro, *Microb. Pathog.* 23: 157-66 (1997).

Infante-Rivand et al., Otitis Media in Children: Frequency, Risk Factors, and Research Avenues, *Epidemiol. Rev.* 15: 444-65 (1993).

Jansen et al., Immunotoxins: Hybrid Molecules Combining High Specificity and Potent Cytotoxicity, *Immun. Rev.* 62:185-216 (1982).

Kaplan et al., Overall cost in the treatment of otitis media, *Pediatr. Infect. Dis. J.* 16: S9-11 (1997).

Karma et al., Immunological aspects of otitis media: present views on possibilities of immunoprophylaxis of acute otitis media in infants and children, *Int. J. Pediatr. Otorhinolaryngol.* 32(Suppl.):S127-S134 (1995).

Kennedy et al., Passive Transfer of Antiserum Specific for Immungens Derived from a Nontypeable *Haemophilus influenzae* Adhesin and Lipoprotein D Prevents Otitis Media after Heterologous Challenge, *Infect. Immun.* 68: 2756-65 (2000).

Klein, Role of nontypeable *Haemophilus influenzae* in pediatric respiratory tract infections. *Pediatr. Infect. Dis J.* 16: S5-8 (1997).

Kramp et al., Liposomal Enhancement of the Immunogenicity of Adenovirus Type 5 Hexon and Fiber Vaccines, *Infect. Immun.* 25: 771-3 (1979).

Lee et al., Constitutive and Inducible Green Fluorescent Protein Expression in *Bartonella henselae*, *Infect. Immun.* 66: 3964-7 (1998).

Lysenko et al., Bacterial Phosphorylcholine Decreases Susceptibility to the Antimicrobial Peptide LL-37/hCAP18 Expressed in the Upper Respiratory Tract, *Infect. Immun.* 68:1664-71 (2000).

Margolis et al., Identification of Hearing Loss in Children with Otitis Media, *Ann. Otol. Rhinol. Laryngol.* 103: 59-61 (1994).

Marra et al., Differential Fluorescence Induction Analysis of *Streptococcus pneumoniae* Identified Genes Involved in Pathogenesis, *Infect. Immun.* 70:1422-33 (2002).

Marra et al., In vivo characterization of the *psa* genes from *Streptococcus pneumoniae* in multiple models of infection, *Microbiology.* 148: 1483-91 (2002).

Matteucci et al., Synthesis of Deoxyoligonucleotides on a Polymer Support, *J. Am. Chem.* 103:11: 3185-3191 (1981).

Mhlanga-Mutangadura et al., Evolution of the Major Pilus Gene Cluster of *Haemophilus influenzae*, *J. Bacteriol.* 180: 4693-703 (1998).

Mitchell et al., Electroporation of *Haemophilus influenzae* is effective for transformation of plasmid but not chromosomal DNA, *Nucleic Acids Res.* 19: 3625-8 (1991).

Miyamoto et al., Selective adherence of non-typeable *Haemophilus influenzae* (NTHi) to mucus or epithelial cells in the chinchilla Eustachian tube and middle ear, *Microbial Pathogenesis.* 21: 343-56 (1996).

Musher et al., Opsonizing and Bactericidal Effects of Normal Human Serum on Nontypable *Haemophilus influenzae*, *Infect. Immun.* 39: 297-304 (1983).

Musser et al., Genetic Relationships of Serologically Nontypable and Serotype b Strains of *Haemophilus influenzae*, *Infect. Immun.* 52:183-91 (1986).

Nichols et al., Identification of the $ADP_{L}$-glycerol-$_{D}$-manno-Heptose-6-Epimerase (*rfaD*) and Heptosyltransferase II (*rfaF*) Biosynthesis Genes from Nontypeable *Haemophilus influenzae* 2019, *Infect. Immun.* 65:1377-86 (1997).

Novotny et al., Epitope Mapping of the Outer Membrane Protein P5-Homologous Fimbrin Adhesin of Nontypeable *Haemophilus influenzae*, *Infect. Immun.* 68: 2119-28 (2000).

Padmalayam et al., Molecular Cloning, Sequencing, Expression and Characterization of an Immunogenic 43-Kilodalton Lipoprotein of *Bartonella bacilliformis* That Has Homology to N1pD/LppB, *Infect. Immun.* 68: 4972-9 (2000).

Papp, Management of Otitis Media with Effusion in Young Children, *Ann. Pharmacother.* 30: 1291-7 (1996).

Poolman et al., Developing a nontypeable *Haemophilus influenzae* (NTHi) vaccine, *Vaccine.* 19: S109-15 (2001).

Ray et al., Tricross: using dot-plots in sequence-id space to detect uncataloged intergenic features, *Bioinformatics.* 17: 1105-12 (2001).

Rock et al., the *licC* gene of *Streptococcus pneumoniae* Encodes a CTP: Phosphocholine Cytidylytransferase, *J. Bacteriol.* 183: 4927-31 (2001).

Sawitzke et al., Suppression of chromosome segregation defects of *Escherichia coli muk* mutants by mutations in topoisomerase I, *Proc. Natl. Acad. Sci. USA.* 97: 1671-6 (2000).

Schneider et al., Virulence Gene Identification by Differential Fluorescence Induction Analysis of *Staphylococcus aureus* Gene Expression during Infection-Simulating Culture, *Infect. Immun.* 70: 1326-33 (2002).

Shen et al., Molecular determinants of disease and resistance in interactions of *Xanthomonas oryzae* pv. *oryzae* and rice. *Microbes. Infect.* 4: 1361-7 (2002).

Snow, Progress in the Prevention of Otitis Media through Immunization, *Otology Neurol.23*: 1-2 (2002).

Spinola et al., Epidemiology of Colonization by Nontypable *Haemophilus influenzae* in Children: A Longitudinal Study, *J. Infect. Dis.* 154: 100-9 (1986).

Suzuki et al., Synergistic effect of adenovirus type 1 and nontypeable *Haemophilus influenzae* in chinchilla model experimental otitis media. *Infect. Immun.* 62: 1710-8 (1994).

Teele et al., Otitis Media in Infancy and Intellectual Ability, School Achievement, Speech, and Language at Age 7 Years, *J. Infect. Dis.* 162: 685-94 (1990).

Tomb, A periplasmic protein disulfide oxidoreductase is required for transformation of *Haemophilus influenzae* Rd, *Proc. Natl. Acad. Sci. USA.* 89: 10252-6 (1992).

Tong, et al., Evaluation of Phase Variation of Nontypeable *Haemophilus influenzae* Lipooligosaccharide during Nasopharyngeal Colonization and Development of Otitis Media in the Chinchilla Model, *Infect. Immun.* 68: 4593-4597 (2000).

Valdivia et al., Bacterial genetics by flow cytometry: rapid isolation of *Salmonella typhimurium* acid-inducible promoters by differential fluorescence induction, *Mol. Microbiol.* 22: 367-78 (1996).

Valdivia et al., Flow cytometry and bacterial pathogenesis, *Curr. Opin. Microbiol.* 1: 359-63 (1998).

Valdivia et al., Fluorescence-Based Isolation of Bacterial Genes Expressed Within Host Cells, *Science.* 277: 2007-11 (1997).

Van Ulsen et al., Genes of non-typeable *Haemophilus influenzae* expressed during interaction with human epithelial cell lines, *Mol. Microbiol.* 45: 485-500 (2002).

Weiser et al., Decoration of lipopolysaccharide with phosphorylcholine: a phase-variable characteristic of *Haemophilus influenzae*, *Infect. Immun.* 65: 943-50 (1997).

Weiser et al., Phosphorylcholine on the lipopolysaccharide of *Haemophilus influenzae* contributes to persistence in the respiratory tract and sensitivity to serum killing mediated by C-reactive protein, *J. Exp. Med.* 187: 631-40 (1998).

Wilson et al., Identification of *Listeria monocytogenes* in Vivo-Induced Genes by Fluorescence-Activated Cell Sorting, *Infect. Immun.* 69: 5016-24 (2001).

Yamanaka, et al., CspD, a novel DNA replication inhibitor induced during the stationary phase in *Escherichia coli, Mol. Microbiol.* 39: 1572-84 (2001).

Young et al., A Bifunctional Urease Enhances Survival of Pathogenic *Yersinia enterocolitica* and *Morganella moganii* at Low pH, *J. Bacteriol.* 178: 6487-95 (1996).

Zhang et al., Structure of *Thermotoga maritima* Stationary Phase Survival Protein SurE: A Novel Acid Phosphatase, *Structure.* 9:1095-106 (2001).

Figure 3A

SEQ ID NO: 589

TTNAACAAGANATTGGGACAACTCCAGTGAAAAGTTCTTCTCCTTTACTCA
TATGTATATCTCCTTCTTAAATCTAGAGGATCAAGCAACTTAATTTTTGGT
TTGCGACATAGACAATTTTCTTCGGGCTTATGCGGGCAAATGAGTACTTCA
TCAAAGGTAATGCCCTGAGATTCAAATAATGCCATCATTACATTGTGGGG
CTTATCAAAATTTGTTTGCGGAAAAGCATCCGTACCAAGCCCATCTTGATT
AGAAACTATCACAAAACGGTATTTCGCTTTCAGTCTGAGGAGTGCGGGAA
TCACTTTCGGTTCTAATTTTAGTTTCTCTAAACTGTCAATTTGGAAATCAGT
TTTTGGTTCATCAATTAATGTGCCGTCTCGGTCGATAAAAGAGTAGGTTG
CATATTTTTCTCCGTGTATGTTATATGAATGGTATGAGGTTTATCATTTGCT
TTATACAAACAGTATAAAACTAAATAATCTCGAATCGCTCTGTGACTTAA
ATAGGAGGTGGTTCATTTTACCTCCTTAATTGCTTCAACAACTTTCTCACA
CTCATTCCTTGTTCCCACAGTAATGCGAATACAATTTTGT

Nt 80-410 of SEQ ID NO: 589 corresponds to compliment of nt 1-331 of the *hisB* gene.
Nt 80-600 of SEQ ID NO: 589 corresponds to nt 4655-5175 of the contig 532 (SEQ ID NO: 532).

SEQ ID NO: 590

TAACAAGAACTTGGGACAAAGNCCAGTGAAAAGTTCTTCTCCTTTACTCA
TATGTATATCTCCTTCTTAAATCTAGAGGATCAGCATCACATCGGGCGGAA
TAGGAAAAAATATCGCCTCGATAAAACTTACAAAGAGAGCCAAAAAAC
AGCAAAACGATGTTTTGACCATTCCATCGTTTTATCGTACATCGTGCCGAA
AATTTTCATATTTTTCTCTATTTGGTAAATTCCTGCTCTAACCAATTTTGCA
AAGAAAGCAATGAATGATATGCGGTAAGATCCTCTAGAGTCGACCTGCAG
GCATGCAAGCTTGGCGTAATCATGGTCATAGCTGTTTCCTGTGTGAAATTG
TTATCCGCTCACAATTCCACACAACATACGAGCCGGAAGCATAAAGTGTA
AAGCCTGGGGTGCCTAATGAGTGAGCTAACTCACATTAATTGCGTTGCGC
TCACTGCCCGCTTTCCAGTCGGGAAACCTGTCGTGCCAGCTGCATTAATGA
ATCGGCCAACGCGCGGGGAGAGGCGGTTTGCGTATTGGGCGCCAGATACC
GGCCTCCATCGGAGAAACTGTCCGAGGTTATGTTGACCTGCAGGG

Nt 78-210 of SEQ ID NO: 590 corresponds to compliment of nt 1-133 of the *lppB* gene.
Nt 78-285 of SEQ ID NO: 590 corresponds to compliment of nt 1423-1630c of the contig 442 (SEQ ID NO: 442).

Figure 3B

SEQ ID NO: 591

NACAGATTGGGACAACTCCAGTGAAAAGTTCTTCTCCTTTACTCATATGTA
TATCTCCTTCTTAAATCTAGAGGATCCACAATAATATGTTCTATCTTGGCTT
CTTTTTTCCAATAGTTTTCGTTACGCACTAAGCGAACATATTGGTTATATA
CATAATCTTTTACTTGATAAGGCCCTGTGCCTACTGGGTGGGTATCTAATT
GAGCAAGGTTGTCATCTGCGCTTAATTGATAGGCATATTCTTGTGAAAAA
ATAATGGCATACTGGCTGGCAAGATGCGACAAAATGGAGGAATCTGGTGC
AAATAATTCAATTTTTACTTGATAAGGCGAAAGTGCGGTCACAGATTTGAT
TTTTTCGTTAAGTTTAATGCTATCAAAATAAGGAAAACGCACTTTTCTTGC
TTGTTCGTGAAACACTCTATATTGTGGATTACTATAGGNAACCATNCGCCT
CTGCTAAGGTTGGTAAATAAGTATTATGCCCTAATACACGATTAATCGAA
AATACTTCNGTNTTCAGNGNTAAAAACACCNTGNNGGGGNAAANCNANG
GGGTTTGGGGGAAATTTTACCCCCGGGACGTAAATTNAATAAA

Nt 74-514 of SEQ ID NO: 591 corresponds to compliment of nt 369-811 of the *sapA* gene.
Nt 74-514 of SEQ ID NO: 591 corresponds to nt 3458-3897 of the contig 512 (SEQ ID NO: 512).

SEQ ID NO: 592

TTAACAAGNAATTGGGACAACTCCAGTGAAAAGTTCTTCTCCTTTACTCAT
ATGTATATCTCCTTCTTAAATCTAGAGGATCGTAGAACCATAAGGTTTTAC
CATCAGAAATAATCTGGGTTTCTTGAGGGGTTTTAGTCTCCATACGGAATA
AATTTGGGCGTTTAATTTGAAGTTTGCCACTTCCTTGTTGAACATTTTTCC
ACTTCCAGAAGTCACTGTTTGCACAAATTCTGCACTTAATACATCGACTTT
AGCTAAACGCATTTGTAATTCACTTGCCGCATCAGCCAATGCCAAATTACT
CAAACCAAGTAAGGTAAGTGCGGCAAATTTTAAGGTTGTTTTTTTCATTTT
ACTTTCCTTTTAAATTAGTATTCTGGACGATGCGATAAAATTTCACGCTTA
CCATTTTGCATTGGGCTGACAATCCCTTGCTCTTCCATTTGATCCTCTAGAG
TCGACCTGCAGGCATGCAAGCTTGGCGTAATCATGGTCATAGCTGTTTCCT
GTGTGAAATTGNTATCCGNTCACAATTCCCACAACATACGAGCCNGAAGC
ATAAAGTGTAAAGCCTGGGGGGNCTNATGAGGGAGCTA

Nt 78-345 of SEQ ID NO: 592 corresponds to the compliment of nt 11-278 of the *lolA* gene.
Nt 78-454 of SEQ ID NO: 592 corresponds to compliment of nt 1039-1415 of the contig 360 (SEQ ID NO: 360).

Figure 3C

SEQ ID NO: 593

TTAACAGAATTGGGACAACTCCAGTGAAAAGTTCTTCTCCTTTACTCATAT
GTATATCTCCTTCTTAAATCTAGAGGATCTATACCTGCAATTAAAATAACG
AAAGTCATACCCACTGCAATAATCGCATTAACCGAAGTTTGGCGTAAAAT
ATTCAAAATATTATCTACGCTAAAAAAATCAGGATTAATCATTGATACAA
TCGCGATAAGAATAATCAACGCAATAAAAGAACGCTGTTCAATCAAAAAT
CTTCCTATTTGAAAATTAGATGTTTCATTTTTCATCATACTTACCTACTCTT
ATTTACCAATAGCTGCTGCTAATAATTTTTCTTGAGTTGCGTCTTTGCGAG
AAAATTCTGCACTAATTTTACCTTCACGCATTACCAACACTCTATCGCTCA
TACCAAGCACTTCTGGCATATCAGATGAGATCCTCTAGAGTCGACCTGCA
GGCATGCAAGCTTGGCGTAATCATGGTCATAGCTGTTTCCTGTGTGAAATT
GNTATCCGNTCACAATTNCACACAACATACGAGCCNGNAGCATAAAGGG
GAANNCCGGGGGGCCTAANGGGGNGCTACNNNATTNATNGGGTG

Nt 77-290 of SEQ ID NO: 593 corresponds to compliment of nt 1-214 of the *rbsC* gene.
Nt 77-438 of SEQ ID NO: 593 corresponds to compliment of nt 1813-2174 of the contig 445 (SEQ ID NO: 445).

SEQ ID NO: 594

AAGTACTCTGTNTNTCTCCTTCTTAAATCTAGAGGATCGGGATTATCAAGC
ACATTACTCGTTTGGCTTTCACGGAAAGATTGCAAGCGTGAAAGCAACTT
CTGCATCCCAACTTGCTAGAATTTGTGCGGCTAACAATCCAGCATTTGCCG
CACCCGCAGGGCCAATAGCCAATGTTCCGACTGGGATTCCTTTTGGCATTT
GCACAATTGAATAAAGGCTATCTACGCCACTTAACATAGAACTTTTTACTG
GCACACCCAGCACAGGCACAAGGGTTTTGGCTGCGATCATGCCGGGTAAA
TGTGCCGCACCGCCAGCCCCAGCAATAATTACTTTATAGCCATTTTTTTGT
GCATTTTCAGCAAATTCAAAAAGTTTATCAGGCGTACGATGAGCAGAGAC
GATTTCCACATGATAAGGTACTTTTAATTCATCTAAAATCTGAGTTGCCTC
TTGCATGGTAGCCCAATCGCTTTTGGAACCCATCACAACAGCAATTTGTGC
AGTTTTTGACATGCTATTTTCTCAATTTTCTAATTAAAAAGGTGGCGTAGA
ATAGCATAGATTACATATATTGAGCAAACGTTTGCTATNTAT

Nt 105-519 of SEQ ID NO: 594 corresponds to compliment of nt 1-415 of the *purE* gene.
Nt 34-281 of SEQ ID NO: 594 corresponds to compliment of nt 286-40 of the contig 536 (SEQ ID NO: 536).

Figure 3D

SEQ ID NO: 595

TTATGNGACCNTGGGACAAGTCCAGTGAAAAGTTCTTCTCCTTTANTCATA
TGTATATCTCCTTCTTAAATCTAGAGGATCTTCATCATCTAAAACTAATAC
GCCAGTTCCATGTTTGAAAGCATTAATTGCATTAAGTACGCGTTCTTCAGC
GGTGTTGCCGAATGGAGATAAAATTGACTGATTCATAGTAATTTCCTAATT
TGAGATTTCAATTAAATACCAGAATCAGGGCTGAGAAATGCAAATAAAAT
GAACGATTTGGGAACCCAACTCGTTTTATTCTCTTTCATCCAGACTTTACT
GTCGGCTTTGGAATTTCACCAAATCTGCTGACTTTAAAAGTGAAAATCAG
GACAATTTCGCAGGAAAAATTTGCCAAAAATTGACCGCACTTTTAAACGC
TCGTGGGCTTTACCACCGGTAGGGAATTTCACCCTGCCCTGAGAATGCGA
GCTAAGTATAACGCAAAATACCTAGGCACTAAATCAGAACGTGAAAAATA
TTTTCATTTAGCCTACAATAAACACACTCAATTCTTACGCTATCAAGAGCA
GATTATGTCAAAAACAAAAGAGAAAAAGTCGGTGTCATTTTCG

Nt 78-189 of SEQ ID NO: 595 corresponds to compliment of nt 1-112 of the *ribB* gene.
Nt 237-565 of SEQ ID NO: 595 corresponds to compliment of nt 2216-2544 of the contig 290 (SEQ ID NO: 290).

SEQ ID NO: 596

TNACAGNAATTGGGACAACTCCAGTGAAAAGTTCTTCTCCTTTACTCATAT
GTATATCTCCTTCTTAAATCTAGAGGATCTAAGAGATATTTAATTTCACGT
TCTGTGTGATGAACAAGACTAAGTAAATGTCTATTTTTCATATTGAAAGCC
ATAATAATCTCCTTGTGTTTTGACTATACATTGGGGAATAAACATACATCA
TTCGAGATACTGCTTGTTGTTCGAACAGTTGCATTATAAGAGAGGTAAAAT
GAAATTTGTTGTCGTTTTTCAACTGGTAATGCCAGTATGTAGAATTTTATT
GCGAGATTTTTAGTATTATTAGAATTTAATAAAAATAATCTAACTCTTTAT
TGTTATTTGTTTGATTTCTAATAGTAGATGAATTTAAACGAAAATATGTTT
TAGTTTATTTTTGATGAAGAGGAATGNGTCTATCTATNCTTAATAAAAGNG
CGGNTATTTTTATTGNAGNTTTTAATATATTGATCCTNTAGAGAGCGACCC
NCACGCNTGCGCNCTTGGGGCGANCATGGGGCATATAGTTGTTCCCTGTG
NNAANGTGTTATCCGTTCACANTTCCCCACAAAANACGAN

Nt 77-155 of SEQ ID NO: 596 corresponds to compliment of nt 1-79 of the *arcB* gene.
Nt 77-494 of SEQ ID NO: 596 corresponds to compliment of nt 772-1189 of contig 461 (SEQ ID NO: 461).

Figure 3E

SEQ ID NO: 597

AACAGNATTGGGACAACTCCAGTGAAAAGTTCTTCTCCTTTACTCATATGT
ATATCTCCTTCTTAAATCTAGAGGATCAGTACGAGTCCAGTCTAAAACAG
GCATAAAATTGTAACAAACAGTGTCAATTCCGCATTGAGCAAGCATTGCG
AGAGAGTTTGTTTATAGTTATTAATCCATTTTTGATAATTTCCAGTACTGA
GTTTTAATCTCTTCATGAACTGGTACACTTTCCACTACTGACCAGCTTAAA
CCAGCATTCTCTATTTCAGTTTTGCAGTTTTTTAATTTCTTCGATACTCCAC
ACTTCACCGTTAGGAATATGGTGAAGTGCAGTGACTATACCAGTTGCGCC
TGCTTGACGAATATCAGATAAAGAAACAGGATCCTCTANAGTCGACCTGC
AGGCATGCAAGCTTGGCGTAATCATGGTCATAGCTGNTTCCTGTGNGAAA
CTGGTATCCGCTCACAATTCCACCNAACATACGAGCCNGAAGNCATAAAG
NGNTAANCCNTGGGGNGCCTAATGAGTGAGCTAACTCACATTAATTGNGT
TGGGCTTACTGCCCGTTTTCAGNNGGGAAACCTGGCGCGCCAGCT

Nt 83-388 of SEQ ID NO: 597 corresponds to compliment of nt 34-335 of the *uxuA* gene.
Nt 156-388 of SEQ ID NO: 597 corresponds to compliment of nt 779-1008 of the contig 5 (SEQ ID NO: 5).

SEQ ID NO: 598

TNACAAGNAATTGGGACAACTCCAGTGAAAAGTTCTTCTCCTTTACTCATA
TGTATATCTCCTTCTTAAATCTAGAGGATCAACCTCGTAACTTAGCAAAAT
CAGTTACCGTTGAATAAAGTGCGGTTGATTTTAATGTAATAAAAAAAACG
GTGAAATTTCACCGTATTTTTTTAGTTAAATAATCTTCTTTGTTTCCGTGTT
TTAATCACTTGTGCGATTAACAATAATGTGAGAATAACCACATATAGTGA
AAAAATAACCACTAGCCATTGCACCATCGTTAAACCAAATAATGACCATT
GGCTTTCATTACAAGAGCCAGTTGGGTTAAATATAAATGGAAACCATTGA
TGAAATGGTAAAGTCTCGGGAAAATTTGGAATAAACTCACATTGTTTCCA
AGGAGCTGGATTCATTTGCAAATCAAGATGACGAAATGAAATCAATAAGC
CCTTAATACTGCTGAATAAACCTAAAGCCAAGGCGATTAATCGAAGTATG
AAAGCAAGAGGTTGAAGTAATGCAATAATGCCCGCTACAAATAAGCCAAT
CATTGCTAAACGTTCATAAACACAGAGCACACAAGGTTGTAAGCCC

Nt 176-600 of SEQ ID NO: 598 corresponds to compliment of nt 108-532 of the *dsbB* gene.
Nt 78-600 of SEQ ID 598 corresponds to nt 819-1341 of the contig 560 (SEQ ID NO: 560).

Figure 3F

SEQ ID NO: 599

NACAAGATTGGGACAACTCCAGTGAAAAGTTCTTCTCCTTTACTCATATGT
ATATCTCCTTCTTAAATCTAGAGGATCGCCCGCCAGCACCCCAGGGGAGG
AGGACATCTGCATCGCATTCAAGCCATTCGCCCACGCATCATCGTAACTTG
GCAACGTTATCACTTTAAACGGTGGCGTCGCAAAGTATTCAGCAAGCTGG
GTTTTACCGCTGGAGGAAAGTTTGGTGGAAAGGGATAATTTGCTGTTCAT
AGATTTTGTAGGGGCTAATTACATTAGCCCCGATATTTCACCAATAATTGG
GCAAATGTAATTTGCCCCTACGATTAACGAACCAAAGATGCAGGTTCTTC
CACATTCTTCAACAACGCATATTTTCGATCCTCTAGAGTCGACCTGCAGG
CATGCAAGCTTGGCGTAATCATGGTCATAGCTGTTTCCTGTGTGAAATTGT
TATCCGCTCACAATTCCACACAACATACGAGCCGGAAGCATAAAGTGTAA
AGCCTGGGGTGCCTAATGAGTGAGCTAACTCACATTAATTGCGTTGCGCTC
ACTGCCCGCTTTCCAGTCGGGAAACCTGTCGTGCCAGCTGCATT

Nt 75-252 of SEQ ID NO: 599 corresponds to compliment of nt 1-178 of the *ureH* gene.
Nt 75-385 of SEQ ID NO: 599 corresponds to nt 825-1135 of the contig 258 (SEQ ID NO: 258).

SEQ ID NO: 600

TANACAAGNAATTGGGACAACTCCAGTGAAAAGTTCTTCTCCTTTACTCAT
ATGTATATCTCCTTCTTAAATCTAGAGGATCCAATCTCAATACGTATTACT
TGCCCATTACTATTTAAAATCGGTAGCCATTCATTGTGCGTTTTAGAACGG
ATAACCGTGAAATATTTGCTGTGTGATGGTTTCGTTAGAAAAATATTACGA
TTAAGCACTACATCCGCATCAATAACATAACAATCACTAAAGAAGTCTTG
TGCCAGAGAAAAGGAATAAATGCTGTTATATTCGCGATATTTTCGTTGTA
AATCAAGGTGCAGTCATATTTTTTCTTTAGATACTCGAATTGTTCGTGTAA
ATACCCTGTAACAATGACAATATTGTCGATATTTGCTTGACGTAGAAAAGT
GAGTGTCCGTTCTAAGTTAGGTGTGCCGTGAATATCTAACAATGATTTATG
TGTGCTTTGTGTGATGTCTTTAAAACGACCGGCTTANTCNTGCAGCTAAAA
TAATCGCATTCATTTTGTTCCCCTTTGNAAAAAAGTGTACCGATCCTCTA
GAGTCGACCTGCAGGCATGCAAGCTTGGCGTAATCATGGN

Nt 82-482 of SEQ ID NO: 600 corresponds to compliment of nt 40-440 of the *licC* gene.
Corresponding sequence not in contig set.

Figure 3G

SEQ ID NO: 601

TNACAAGANTTGGGACAACTCCAGTGAAAAGTTCTTCTCCTTTACTCATAT
GTATATCTCCTTCTTAAATCTAGAGGATCGCTCATTCGAGAGACACCTCCA
ACAGCACGAATATCTGCAGGAATTCGTTCCAAAGCCATCACTGCAGCTGC
ACCAGCAGCTTCTGCAATGCGAGCTTGTTCAGGGTTTTGAACATCCATGAT
AACACCACCTTTGAGCATCTGTGCTAAGTTTTTATTTAGTTCATAACGATT
TTCAGCCATTTCTTTGTCCTCATTATTTGGTTATTTGTATTGATAGCTACGT
TTTTTATTGTAATGTAGAAAAGTCTTTAGAACAAGTTTGAAAAAATGCGTA
TATATTAAAAGGCATAATGTCTAGTGTGCTTAATTTCAGTTTTTTGTATAA
ACGAAGTGTAGAACGTCAGAAGGATTGTCCAATTTAATAATAGAAAAAAG
AGCTACTTTAGCTGAAAGAATTTCGTCCTTAAGTGCCACAATAGTTATTAA
AAAAACCTTGAAATGTTTTTAAAAACCTTTTTCTATGTGGTTAGATTTTCT
GAAATTTAAGAAAAAGCTTGAAAGGGAGTTTACGCTTTCC

Nt 75-263 of SEQ ID NO: 601 corresponds to compliment of nt 1-189 of the HI1647 gene.
Nt 75-600 of SEQ ID NO: 601 corresponds to compliment of nt 1035-1560 of the contig 471 (SEQ ID NO: 471).

SEQ ID NO: 602

TTNACAAGGAATCGGGACAACTAGCAGTGAAAAGTTCTTCTCCTTTACTA
CATATGTATATCTCCTTCTTAAATCTAGAGGATCTGCAAAATTGTTGCAAC
CACTAATACGATGGCTGCTTCACGTACACCACCGAGTTTGTAAGTGATAA
AAAATAAAATTAAAGGGATAAAGTCAAGGAGTTGTTTCATATTGATTAAT
CCTTCATAAATAAGCTGTAGAAACGATAAGTCACTACTAGCATGAAAATA
TTAAGTAATGCGGTGAAAATGCCTATTACCATATCAAATATAGCATTATTG
GAAAATGCGCTTAATTGGAAAATAAGAATTGGCACGAGAAAATAAACCA
GTAGGGTGTAAATAAACAATACGCCTTTTCGAGTATTTCCTCGCATCCAAA
TTTTTCGGATAGTTTGCGAAAGTGCCTCTTGAGTAGAAAGATAATGTACTA
CCGTTAAATTTTAAACGGACAAAGAACCAAACGCCAACAAGCATCGCGAT
AAGTGACATAATAGAGGGCGATTTTTTTGTGAGTAATGCANCAAAGGCTT
CACCAAGNACCAGTAACATTGGTGCAACCATTAATAGATCCTCTTAG

Nt 81-191 of SEQ ID NO: 602 corresponds to compliment of nt 1-111 of the *ispZ* gene.
Nt 81-593 of SEQ ID NO: 602 corresponds to compliment of nt 850-1361 of the contig 418 (SEQ ID NO: 418).

Figure 3H

SEQ ID NO: 603

NACAAGANTTGGGACAACTCCAGTGAAAAGTTCTTCTCCTTTACTCATATG
TATATCTCCTTCTTAAATCTAGAGGATCCTTGAAACATCACCTCAGATTTA
ATCAATCTGTGGATTCTATCCAAGAAAAGTACCACGAAATTTTCTCTTTCC
TCATTACCTATAATGGTTTGAAAATAGAGTTTAGCTATTGATGGCTCAGTA
AATTCCTGTGCACCTTGGTAAAAGGGCTTTTCTTCCATCACTTTAGTTAAA
ATAACCTGTGCCTGTTCTAAAATAGCTTGTTGTTGCTCGTTTAATTTAAAC
ATTCGATATTCCTTCTAAAATAGGGAATATCGCCCATAAGGGATATATCCC
CTATGGGTAAGGTGCGAAAAGAATGCTTATCGCACATTAAAGTTAATGTT
ATTAATCAGAAGTTTTAAACTGTCGATAATCTGTTTAATTTTTGCTGCAA
ATTCTAAATCGTGCTCAGATTCATCATCTATACAATATTCCAAATAATTAC
TCATATCAGCAATTAGTGCTTCTTTTGTTGGCGAAGGTTGGAACATAATTG
ATCCTCTAGAGTCGACCTGCAGGCATGCAAGCTTGGCGTA

Nt 65-525 of SEQ ID NO: 603 corresponds to compliment of nt 18-477 of the *radC* gene.
Nt 76-564 of SEQ ID NO: 603 corresponds to compliment of nt 23606-23869 of the contig 575 (SEQ ID NO: 576)

SEQ ID NO:604

TTAACAAGNAATTGGGACAACTCCAGTGAAAAGTTCTTCTCCTTTACTCAT
ATGTATATCTCCTTCTTAAATCTAGAGGATCGGCTTCTAACATTTCGCCGT
CTAAACGTTCGTTGTTATAAATTGCAATCGCCAGCAGGAAAACCAAGCGT
TCGGTAGGTAAATTCAAAGAAAACTCGCGATCTTTTGCCCAAGAGACGAG
TTCAGGAATAGTTTGGGATGTTTCAATCATTGAATTGCAAAGCGTTAAAAT
TGAACAAAAAATTGGAAAGATTATACAGGATTTTTTGCGGATCCTCTAGA
GTCGACCTGCAGGCATGCAAGCTTGGCGTAATCATGGTCATAGCTGTTTCC
TGTGTGAAATTGTTATCCGCTCACAATTCCACACAACATACGAGCCGGAA
GCATAAAGTGTAAAGCCTGGGGTGCCTAATGAGTGAGCTAACTCACATTA
ATTGCGTTGCGCTCACTGCCCGCTTTCCAGTCGGGAAACCTGTCGTGCCAG
CTGCATTAATGAATCGGCCAACGCGCGGGGAGAGGCGGTTTGCGTATTGG
GCGCCAGATACCGGNCTCCATNGGANAAACNGTCCCAGGGTNTNT

Nt 79-296 of SEQ ID NO: 604 corresponds to compliment of nt 30-247 of the *mukF* gene.
Nt 79-296 of SEQ ID NO: 604 corresponds to compliment of nt 4026-4243 of the contig 508 (SEQ ID NO: 508).

Figure 3I

SEQ ID NO: 605

TAACAGNATTGGGACAACTCCAGTGAAAAGTTCTTCTCCTTTACTCATATG
TATATCTCCTTCTTAAATCTAGAGGATCCACGTAATCAGAATTTTCTGCAG
AAGATGGCGATGCCGCACCACCGTGATGGCGGCGAATTAAATCTAACTCC
GCCAAAATATTCAAATCACGACGAATCGTTTGAGGGCTAACATCTAAGGC
AGCAACCAATTCTTCCGTGCTTAAATAGCCAGATTGTTCCACCAGTTTAAT
AATTTTTTGATGGCGTAACGATTGTTTCATAGCGAATCCTTTATCCAAATT
AAACGGACTTACTCTAGCGAATTTTTGCGCAATTTGCTATCAATAAATCCC
CAAATCAAGCCGACAATCAAGCCTGAAATATGTGCAGCATTTCCCATTTC
AACACCAAATAAGGGGCTAATAAAACCTAATGCGATCCTCTAGAGTCGAC
CTGCAGGCATGCAAGCTTGGCGTAATCATGGTCATAGCTGTTTCCTGTGTG
AAATTGTTATCCGCTCACAATTCCACACAACATACGAGCCGGAAGCATAA
AGTGNAAGCCTGGGGNGCCTAAGGGTGAGCTAACTCACATTATT

Nt 76-283 of SEQ ID NO: 605 corresponds to compliment of nt 1-208 of the *glpR* gene.
Corresponding sequence not in contig set.

---

SEQ ID NO:606

TAACAAGAATTGGGACAACTCCAGTGAAAAGTTCTTCTCCTTTACTCATAT
GTATATCTCCTTCTTAAATCTAGAGGATCACCATTTTCAAGAGATTGAGAA
ATAAACTCTAAAATATCTTTTACCATATTTTCAATTTCTTTTGCAGATAAA
GTTGGCTGTTTTGCTGACAATTTTTCCATAAGTTCTGACTTAGTCATCCTCT
ATACTTCCTTAATATTATTTAAATTAAGATCCTCTAGAGTCGACCTGCAGG
CATGCAAGCTTGGCGTAATCATGGTCATAGCTGTTTCCTGTGTGAAATTGT
TATCCGCTCACAATTCCACACAACATACGAGCCGGAAGCATAAAGTGTAA
AGCCTGGGGTGCCTAATGAGTGAGCTAACTCACATTAATTGCGTTGCGCTC
ACTGCCCGCTTTCCAGTCGGGAAACCTGTCGTGCCAGCTGCATTAATGAAT
CGGCCAACGCGCGGGGAGAGGCGGTTTGCGTATTGGGCGCCAGATACCGG
CCTCCATCGGAGAAACTGTCCGAGGTTATGTTGACCTGCAGGGGGGGGGG
GGCCCCTGAGGTCTGCCTCGNAAGAAGGGGTTGCTGACTC

Nt 77-200 of SEQ ID NO: 606 corresponds to compliment of nt 1-124 of the *ihfB* gene.
Nt 77-236 of SEQ ID NO: 606 corresponds to compliment of nt 1455-1614 of the contig 408 (SEQ ID NO: 408).

Figure 3J

SEQ ID NO: 607

NACAGNNTTGGGACAACTCCAGTGAAAAGTTCTTCTCCTTTACTCATATGT
ATATCTCCTTCTTAAATCTAGAGGATCAACATCTAAGACAAGATTTTTTAA
TGGACTACTGGTATTGGGAACACTTAATTCATTTGGTAAGCAATAGACCAT
TTCCATTTTTGTATTACGAGTGCGAACCGCACCAAATTTGCTGAGCATTCT
CGATATTTTTGATTGATTAATACCAGTAAAGCCTTGTTTTTTTAAGGCATC
GACAATTTCATTTTGAGAACCAAAGCGTTCTTGATTGAGTAATTCTTTAAA
AGCACGAGTTAAATTGTCAGTCATCTTTATTTTTAATAGTCAAAATTTGC
ATAAGAATTGCATAAAAATTNNNCTTTCATCAACTGGAATATGGNTTNGN
ACCNNGGGGAAGAAATTTTTTNNNNAAAATNGGAACNAGATCCNTTNAA
GNCAACCTGCAGGCATGCAAGCTNGGCGNAATCANGGCATAGCTGNTTCC
TGGGNAAATTGNTATCCGTTANAATTCCCNCNACATNCNANCCGNAGCAT
AAGNGAAAGCCTGGGGGCNTANGANGNGGCTACCCCCATNATT

Nt 75-330 of SEQ ID NO: 607 corresponds to compliment of nt 1-256 of the *argR* gene.
Corresponding sequence not found in contig set.

SEQ ID NO: 608

TTTAACAAGGAATCCGGGCACAACTACCAGTGAAAAGTTCTCTCTCCTTTA
CTCATATGTATATCTCCTTCTTAAATCTAGAGGATCCTTTATCGCTGTGGA
GAACTTCAAATTGTACTTTTTGACCTGCTTTTAATGAACGATAGCCGTCCA
TTTCAATCACTGAATAATGTGCAAAATATCGGCATCTACACCTTCTGCGG
AAATGAAACCAAATCCTTTTGCATTATTGAACCATTTTACAATACCAATTT
CCATAAAAGACCTCTCTAGGCTTAGCCTATTAAAACAATAAATCAACAAG
ACTCTCGCCTTATCACCTACTAATTAGGTCCGTTATGTTTAAATATTTTGAA
CGGTTATGCAACGAGCAATATTCAAAAATGATAAGTAGATCCTCTAGAGT
CGACCTGCAGGCATGCAAGCTTGGCGTAATCATGGTCATAGCTGTTNCCT
GNGTGAAATTGTTATCCGCTCACAATTCCACACAACATACGAGCCGGAAG
CATAAAGTGNTAAGCNTGGGGTGCCTAATGAGTGNNCTAACTNACATAAA
TTGAGTTANGCTCACTGCNCCGTTTTCCAGNNGGNGANACCNG

Nt 84-259 of SEQ ID NO: 608 corresponds to compliment of nt 1-176 of the *ihfB* gene.
Corresponding sequence not found in contig set.

Figure 3K

SEQ ID NO: 609

TAACAGCATTGGGACAACTCCAGTGAAAAGTTCTTCTCCTTTACTCATATG
TATATCTCCTTCTTAAATCTAGAGGATCTATTACAGAACCATCATTTCCCC
AAATCAAGAATAGCTTTGATGAAAATAAGTAAAATCGGTAAGACAATAG
GAATACTCACGACATAGCCCGTAATGGCTAATGCCCATTCTTCCTTTTTCT
TACCTAGAAATTTGATAAAACTGAACGCCATTTTTTCAGCAACTGGGCAG
ATTGAAGTTTCACCATGTAAAGGTTCTCGAATAATGCTACTTACAAAGGA
AGAAGTCGCTTTATTTGGTTTTCCTGGACGGATACAAATTGTGAGCAGGCG
AACACAGAGACCATCAACAAAACCTTTTCTTGTATAGTCATTAATAAGTA
ATTCACTCATTGCTTTTGTGCACCATAAGTCGATTGTGGCGTTACAGCAG
TAGAATCCTGAATAATTTCTGGTAAATCACCACCAAATACAGCAAGTGAA
CTAGAAAAAATAAAACGAATTTTAGTATCAGATTCATCAAAATATGAGAA
AGTGGCGACATTCCATATTTGTCCACTAACAAATTTTGATCCTCTA

Nt 93-413 of SEQ ID NO: 609 corresponds to compliment of nt 1-321 of the HI0094 gene.
Nt 76-595 of SEQ ID NO: 609 corresponds to nt 1467-1985 of the contig 379 (SEQ ID NO: 379).

SEQ ID NO: 610

TTNNACAAGNAATTGGGACAACTCCAGTGAAAAGTTCTTCTCCTTTACTCA
TATGTATATCTCCTTCTTAAATCTAGAGGATCATCAAGATAATCAAGTACA
TATTGTTCAATTTGAGGAATGCGATTTAGACTTGGCAACATAGTATTTAAC
TCATTTAAAGGTAAAAATGGCAGGTTATTGATAATATCTTAAGGCGTTAAT
GATGTCGAATTAGATTTTGAGCATTTTAAGGAGTGTTTTATGGAGTAAAT
GAGTCAAGAAAAGTGTGTTGTTTGGATGAAAAATAAACNAAAAATTCAAA
AGAATTTGATCCTCTAGAGTCGACCTGCAGGCATGCAAGCTTGGCGTAAT
CATGGTCATAGCTGNTTCCTGTGTGAAATTGNTATCCGCTCACAATTCCAC
ACAACATACGAGCCGGAAGCATAAAGTGTAAAGCCTGGGGTGCCTAATG
AGTGAGCTAACTCACATTAATTGCGNNGCGCTCNCTNNCCCCTTTNCNCA
GGGGAAAACCCTGNCGCNCCAGCTGCNTTTAATGAATCNGCCCNCNGCG
GGGAGGGGCNGNTTGCGTNTTGGGCGCCANANCCCGNCTCCATCG

Nt 80-143 of SEQ ID NO: 610 corresponds to compliment of nt 1-64 of the HI1163 gene.
Nt 80-316 of SEQ ID NO: 610 corresponds to compliment of nt 117-353 of the contig 513 (SEQ ID NO: 513).

Figure 3L

SEQ ID NO: 611

NACAAGNAATTGGGACAACTCCAGTGAAAAGTTCTTCTCCTTTACTCATAT
GTATATCTCCTTCTTAAATCTAGAGGATCGTCATCTTTACGATATTTTCAT
CAATTCGTTTTGCAATCCAAAGTCATTTTTATCCGATTCGTTAGAAAATA
AATCTTCTGTTTGCGTTAATTGAGGATTTTGAATTCCTATCCAATTTGCAAT
CCCTTCTAAGAAATTTAAACCTGATTTAAACACCTTATATTCTTTGCGTTCC
ATATCATCTGATGAAATTTTGAATAGCGGAATATTATGGTGCTCTCGGCTG
AAACAGTTTTGATTGAACAAAAGTATATTGTTTTTTTCATCTTGTTGGTGG
CACAAACCGTGATCCTCTAGAGTCGACCTGCAGGCATGCAAGCTTGGCGT
AATCATGGTCATAGCTGTTTCCTGTGTGAAATTGTTATCCGCTCACAATTC
CACACAACATACGAGCCGGAAGCATAAAGTGTAAAGCCTGGGGTGCCTA
ATGAGTGAGCTAACTCACATTAATTGCGTTGCGCTCACTGCCCGNTTTCCA
GTCGGGAAANCCTGTCGTGCCAGCTGCATTAATGAATCG

Nt 76-260 of SEQ ID NO: 611 corresponds to compliment of nt 1-185 of the gene HI1063.
Nt 76-374 of SEQ ID NO: 611 corresponds to nt 229-527 of the contig 48 (SEQ ID NO: 48).

SEQ ID NO: 612

ATTNNACAAGNAATTGGGCACAACTCCAGTGAAAAGTTCTTCTCCTTTACT
CATATGTATATCTCCTTCTTAAATCTAGAGGATCATCTTTGATAATAAGCT
GTAATTTTGGTTGAAAACCTGAAATGCTCATCCCTTGCTGTTTTGGGGTT
TCACTGTAATAAATTCTTGGCGAGAAAAGGGCAATTCAGGATTAAAATGT
TTATTGCCTGTAAGATAGTGTAAACCTTTTGTGCTGTAACCAGAATGAACT
TCATTTTTTTCAATGGCTTTAATAAAATACGACAAAAATTCATTGTTTTTC
TTCCTGAATTTGCACTGCGCCTAACATATTTTCCCCGTTATTAAGTAAAAA
GCGAAACATATCGCTTTCATCAATTCGTTGATGAAGTGCATATTTGTGTTT
TAGCCAGCCTTCTGGGACGAGGGATGCAAAATAAGGGAATAAGGTGTNA
GAATGAAAAGGACTTTGCTCAATAGGAAAGCTGAGAGAGAGCGGTATTCC
TTGATAATCGGGATTGTAAGCAAAATGAAAACCTCGATGATCCTCTAGAG
TCGACCTGCAGGCATGCAAGCTTGGCGTAATCATGGTCATAGC

Nt 84-298 of SEQ ID NO: 612 corresponds to compliment of nt 1-215 of the HI0665 gene.
Nt 82-549 of SEQ ID NO: 612 corresponds to compliment of nt 4726-5193 of the contig 557 (SEQ ID NO: 557).

Figure 3M

SEQ ID NO: 613

NACAGNATTGGGACAACTCCAGTGAAAAGTTCTTCTCCTTTACTCATATGT
ATATCTCCTTCTTAAATCTAGAGGATCACTGCATTGAGTAAACGACTTTGT
GATTCAATATTATTTTCGAGTGCAGTCAGGCGAAAATAGGTTTCGATTAAA
TACATAAATTTTTTAATTGCTGTCTGATTTGGTTTAAGCCGTTTAAACGCAT
TTCACTTAAACGTTGTGAAATGCCGAGTTCGCTAAAAAAGGCAATAATAT
CAAATGTATTCAATTCATCCGCTGTTTGCCATTGATTTGATTGAATAAAA
TCCAAAGCAAGCCATTCATAATTCTGGCTTCGCTAAATCCGCTGAATTGAA
AAGTGCGGTCATGTTTAGGCATAATTTGAAACCACATTTGTGCTTCGCAGC
CAGNNAATAGGTTGCATTTGAGCGAGTTCATTATCGCTTGGGCGAGGNNA
ANNTTTTGNCTNCNCGGAAAAATCAGGNNATNGCGATCCTTTAGAGTCG
ACCTGCAGGCATGCAAGCTTGGCNGTAATCATGGNCATAGCTGNTTCCTG
GGGGAAATNGTTNTCCGNTNCAATTCCCCACAACATACGAGC

Nt 75-158 of SEQ ID NO: 613 corresponds to compliment of nt 1-84 of the HI1292 gene.
Nt 142-455 of SEQ ID NO: 613 corresponds to nt 12-324 of the contig 313 (SEQ ID NO: 313).

SEQ ID NO: 614

CAAGACTTGGGACAACTCCAGTGAAAAGTTCTTCTCCTTTACTCATATGTA
TATCTCCTTCTTAAATCTAGAGGATCTACAGTTGGTTCTGTAAACATCCCA
GAACCGATTAAAATAAAATAACCCGCGAATGCGGCACAAATCACCGCAA
AAAGTGCGGGCAAAATTTGGCTTGTTTTTTCGTGTTCATCATTGTCTTCCC
TGAAAAGAAAATATCGCTATTATCCACCTTTCACTCAGAATTTCCATATTT
AACTTCTTCACTCTTGAGCGGTTATTTATAGAATAAGCCAATTTTTTAA
GCCAGAAGGAAAAAACAATGAGCCAACCAATTTATAAACGTATTTATTG
AAATTAAGCGGTGAAGCATTACAAGGAGAAGATGGTCTTGGTATCGATCC
TCTAGAGTCGACCTGCAGGCATGCAAGCTTGGCGTAATCATGGTCATAGC
TGTTTCCTGTGTGAAATTGTTATCCGCTCACAATTCCACACAACATACGAG
CCGGAAGCATAAAGTGTAAAGCCTGGGGTGCCTAATGAGTGAGCTAACTC
ACATTAATTGCGTTGCGCTCACTGCCCGCTTTCCAGTCGGGAAA

Nt 83-265 of SEQ ID NO: 614 corresponds to compliment of nt 1-181 of the HI1064 gene.
Nt 74-406 of SEQ ID NO: 614 corresponds to nt 440-772 of the contig 178 (SEQ ID NO: 178).

GENES OF AN OTITIS MEDIA ISOLATE OF NONTYPEABLE *HAEMOPHILUS INFLUENZAE*

This application is a national phase filing under 35 U.S.C. §371 of International Application No. PCT/US2006/023428, which claims priority to U.S. Provisional Application No. 60/691,214, filed Jun. 16, 2005 and U.S. patent application Ser. No. 10/795,159 filed Mar. 5, 2004, which claims priority to U.S. Provisional Application No. 60/453,134 filed Mar. 6, 2003, all of which are incorporated by reference herein in its entirety.

Scientific work relating to the invention was supported by Grant Nos. R01 DC03915 and R01 DC005980 from the United States Institutes of Health. The United States government has certain rights in the invention.

FIELD OF INVENTION

The invention relates to the polynucleotide sequence of a nontypeable strain of *Haemophilus influenzae* (NTHi) genome, NTHi genes contained within the genome and polypeptides encoded by the polynucleotides. The invention also relates to uses of these NTHi polynucleotides and NTHi polypeptides including vaccines and methods of treating and preventing NTHi related disorders. The invention also relates to NTHi genes which are upregulated during or in response to NTHi infection of the middle ear or nasopharynx.

BACKGROUND

Otitis media (OM) is a highly prevalent pediatric disease worldwide and is the primary cause for emergency room visits by children (Infante-Rivand and Fernandez, *Epidemiol. Rev.*, 15: 444-465, 1993). Recent statistics indicate that 24.5 million physician office visits were made for OM in 1990, representing a greater than 200% increase over those reported in the 1980's. While rarely associated with mortality any longer, the morbidity associated with OM is significant. Hearing loss is a common problem associated with this disease, often times affecting a child's behavior, education and development of language skills (Baldwin, *Am. J. Otol.*, 14: 601-604, 1993; Hunter et al., *Ann. Otol. Rhinol. Laryngol. Suppl.*, 163: 59-61, 1994; Teele et al., *J. Infect. Dis.*, 162: 685-694, 1990). The socioeconomic impact of OM is also great, with direct and indirect costs of diagnosing and managing OM exceeding $5 billion annually in the U.S. alone (Kaplan et al., *Pediatr. Infect. Dis. J.*, 16: S9-11, 1997).

Whereas antibiotic therapy is common and the surgical placement of tympanostomy tubes has been successful in terms of draining effusions, clearing infection and relieving pain associated with the accumulation of fluids in the middle ear, the emergence of multiple antibiotic-resistant bacteria and the invasive nature associated with tube placement, has illuminated the need for more effective and accepted approaches to the management and preferably, the prevention of OM. Surgical management of chronic OM involves the insertion of tympanostomy tubes through the tympanic membrane while a child is under general anesthesia. While this procedure is commonplace (prevalence rates are ~13%; Bright et al., *Am. J. Public Health*, 83(7): 1026-8, 1993) and is highly effective in terms of relieving painful symptoms by draining the middle ear of accumulated fluids, it too has met with criticism due to the invasive nature of the procedure and its incumbent risks (Berman et al., *Pediatrics*, 93(3):353-63, 1994; Bright et al., supra.; Cimons, *ASM News*, 60: 527-528; Paap, *Ann. Pharmacother.*, 30(11): 1291-7, 1996).

Progress in vaccine development is most advanced for *Streptococcus pneumoniae*, the primary causative agent of acute OM (AOM), as evidenced by the recent approval and release of a seven-valent capsular-conjugate vaccine, PREVNAR® (Eskola and Kilpi, *Pediatr. Infect. Dis. J.* 16: S72-78, 2000). While PREVNAR® has been highly efficacious for invasive pneumococcal disease, coverage for OM has been disappointing (6-8%) with reports of an increased number of OM cases due to serotypes not included in the vaccine (Black et al., *Pediatr. Infect. Dis J.*, 19: 187-195; Eskola et al., *Pediatr. Infect. Dis J.*, 19: S72-78, 2000; Eskola et al., *N. Engl. J. Med.* 344: 403-409, 2001; Snow et al., *Otol. Neurotol.*, 23: 1-2, 2002). Less progress has been made for nontypeable *Haemophilus influenzae* (NTHi), the gram-negative pathogen that predominates in chronic OM with effusion (Klein, *Pediatr. Infect. Dis J.*, 16: S5-8, 1997; Spinola et al., *J. Infect. Dis.*, 154: 100-109, 1986). Hampering development of effective vaccines against NTHi, is the currently incomplete understanding of the pathogenesis of NTHi-induced middle ear disease. Contributing to this delay is a lack of understanding of the dynamic interplay between microbe-expressed virulence factors and the host's immune response as the disease progresses from one of host immunological tolerance of a benign nasopharyngeal commensal, to that of an active defensive reaction to an opportunistic invader of the normally sterile middle ear space.

Although strain Rd is the exemplar organism for the current small genome sequencing rationale, and an important model organism for studying *H. influenzae* biology, strain Rd is a poor model for the study of pathogenicity caused by members of the genus *Haemophilus*. Serotype b strains of *H. influenzae* cause invasive diseases, for example meningitis, and nontypeable *H. influenzae* (NTHi) strains principally have a role in localized respiratory disease, particularly in otitis media (OM), acute sinusitis, community acquired pneumonia and have important consequences in patients with chronic obstructive pulmonary disease or cystic fibrosis (Kilpi et al., Pediatr Infect Dis J20:654-62, 2001; Murphy, *Curr Opin Infect Dis* 16:129-34, 2003; Roman et al., *J Clin Microbiol* 42:1450-9, 2004; Sethi, Clin Microbiol Rev 14:336-63, 2001; St Geme, *Vaccine* 19 Suppl 1:S41-50, 2000). Strain Rd, however, is a derivative of a serotype d strain. Serotype d strains are rarely associated with disease (Daines et al., J Med Microbiol 52:277-82 2003; Heath et al., Pediatr Infect Dis J 20:300-5, 2001; Rodriguez et al., Infect Immun 71:1635-42, 2003, Skoczynska et al., J Clin Microbiol 43:938-41, 2005). Because one of the most useful sets of data in the study of an organism's biology is its genomic sequence, a number of investigations have identified and characterized genes found in *H. influenzae* type b strains, *H. influenzae* Biogroup Aegyptius strains or in nontypeable strains that are not present in strain Rd (Bergman et al., Infect Immun 71:1098-108, 2003; Chang et al., Infect Immun 68:2630-7, 2000; Erdos et al., Int J Pediatr Otorhinolaryngol 67:749-55. 2003; Li et al., Mol Microbiol 47:1101-11, 2003; McMichael & Green, Curr Opin Investig Drugs 4:953-8, 2003; Pomposiello & Demple, 2001; Smoot et al., Infect Immun 70:2694-9, 2002).

Currently there is a poor understanding of how NTHi causes OM in children. The identification of putative virulence factors necessary for induction of OM will contribute significantly to the understanding of the host-pathogen interaction and ultimately, the identification of potential vaccine candidates and targets of chemotherapy. There is a tremendous need to develop more effective and accepted approaches to the management and preferably, the prevention of otitis media. Vaccine development is a very promising and cost

SUMMARY OF INVENTION

The present invention provides for the identification and characterization of the genomic sequence of NTHi *H. influenzae* strain 86-028NP and the polypeptide sequences encoded thereby. The 3-fold analysis of the NTHi genomic sequence is set out in a series of contig sequences denoted as SEQ ID NO: 1-576, and the subsequent 8-fold analysis of the genomic sequence is set out in a series of 11 contig sequences denoted as SEQ ID NOS: 675-685. These contigs are raw data and one of skill in the art may assemble these contigs by comparing overlapping sequences to construct the complete genome of the NTHi stain 86-028NP using routine methods.

The complete and annotated genome of NTHi strain 86-028NP is set out as SEQ ID NO: 772. The open reading frames are set in Table 6 as SEQ ID NOS: 773-2593. The amino acid sequence of the resulting gene products are set out as SEQ ID NOS: 2594-4414. The genome is approximately 1.91 kb in size, slightly larger than the strain Rd genome. A number of regions of gross genome rearrangement relative to the strain Rd genome have been identified as well as a number of genes unique to strain 86-028NP.

The present invention also provides for antibodies specific for the NTHi polypeptides of the invention. Methods of detecting NTHi bacteria in a human or in sample, such as serum, sputum, ear fluid, blood, urine, lymphatic fluid and cerebrospinal fluid are contemplated. These methods include detecting NTHi polynucleotides with specific polynucleotide probes or detecting NTHi polypeptides with specific antibodies. The invention also contemplates diagnostic kits which utilize these methods of detecting NTHi bacteria.

The present invention also contemplates methods of eliciting an immune response by administering a NTHi polypeptide of the invention or a NTHi peptide, thereof. These methods include administering the NTHi polypeptide or NTHi peptide as a vaccine for treatment and/or prevention of diseases caused by NTHi infection, such as OM. The following NTHi genes are upregulated during or in response to middle ear and/or nasopharynx infections; and the polypeptides encoded by these genes and peptides thereof are contemplated as possible OM vaccine candidates and/or target of chemotherapy: hisB, lppB, sapA, lolA, rbsC, purE, ribB, arcB, uxuA, dsbB, ureH, licC, HI1647, ispZ, radC, mukF, glpR, ihfB, argR, cspD, HI0094, HI1163, HI1063, HI0665, HI1292, HI1064. NTHi hisB gene is set out as nucleotide sequence SEQ ID NO: 615 and encodes the amino acid sequence set out as SEQ ID NO: 616. NTHi sapA gene is set out as nucleotide sequence SEQ ID NO: 617 and encodes the amino acid sequence set out as SEQ ID NO: 618. NTHi rbsC gene is set out as nucleotide sequence SEQ ID NO: 619 and encodes the amino acid sequence set out as SEQ ID NO: 620. NTHi purE gene is set out as nucleotide sequence SEQ ID NO: 621 and encodes the amino acid sequence set out as SEQ ID NO: 622. NTHi ribB gene is set out as nucleotide sequence SEQ ID NO: 623 and encodes the amino acid sequence set out as SEQ ID NO: 624. NTHi arcB gene is set out as nucleotide sequence SEQ ID NO: 625 and encodes the amino acid sequence set out as SEQ ID NO: 626. NTHi uxuA gene is set out as nucleotide sequence SEQ ID NO: 627 and encodes the amino acid sequence set out as SEQ ID NO: 628. NTHi dsbB gene is set out as nucleotide sequence SEQ ID NO: 629 and encodes the amino acid sequence set out as SEQ ID NO: 630. NTHi ureH gene is set out as nucleotide sequence SEQ ID NO: 631 and encodes the amino acid sequence set out as SEQ ID NO: 632. NTHi licC gene is set out as nucleotide sequence SEQ ID NO: 633 and encodes the amino acid sequence set out as SEQ ID NO: 634. NTHi HI1647 gene is set out as nucleotide sequence SEQ ID NO: 635 and encodes the amino acid sequence set out as SEQ ID NO: 636. NTHi ispZ gene is set out as nucleotide sequence SEQ ID NO: 637 and encodes the amino acid sequence set out as SEQ ID NO: 638. NTHi radC gene is set out as nucleotide sequence SEQ ID NO: 639 and encodes the amino acid sequence set out as SEQ ID NO: 640. NTHi mukF gene is set out as nucleotide sequence SEQ ID NO: 641 and encodes the amino acid sequence set out as SEQ ID NO: 642. NTHi glpR gene is set out as nucleotide sequence SEQ ID NO: 643 and encodes the amino acid sequence set out as SEQ ID NO: 644. NTHi ihfB gene is set out as nucleotide sequence SEQ ID NO: 645 and encodes the amino acid sequence set out as SEQ ID NO: 646. NTHi argR gene is set out as nucleotide sequence SEQ ID NO: 647 and encodes the amino acid sequence set out as SEQ ID NO: 648. NTHi cspD gene is set out as nucleotide sequence SEQ ID NO: 649 and encodes the amino acid sequence set out as SEQ ID NO: 650. NTHi HI1163 gene is set out as nucleotide sequence SEQ ID NO: 651 and encodes the amino acid sequence set out as SEQ ID NO: 652. NTHi HI1063 gene is set out as nucleotide sequence SEQ ID NO: 653 and encodes the amino acid sequence set out as SEQ ID NO: 654. NTHi HI0665 gene is set out as nucleotide sequence SEQ ID NO: 655 and encodes the amino acid sequence set out as SEQ ID NO: 656. NTHi HI1292 gene is set out as nucleotide sequence SEQ ID NO: 657 and encodes the amino acid sequence set out as SEQ ID NO: 658.

The novel NTHi genes included in the polynucleotide sequences presented as SEQ ID NOS: 1-576, SEQ ID NOS: 675-685 and the nucleotide sequences set out in Tables 4 and 4B are also up-regulated during infection of the middle ear and/or the nasopharynx, and therefore are contemplated to encode OM vaccine candidates and/or targets of chemotherapy. In addition, the following NTHi genes are contemplated to be virulence-associated genes and therefore are contemplated to encode possible OM vaccine candidates and/or targets of chemotherapy: HI1386, HI1462, HI1369, lay, HI1598. NTHi HI1386 gene sequence is set out as SEQ ID NO: 659 and encodes the amino acid sequence set out as SEQ ID NO: 660. NTHi HI1462 gene sequence is set out as SEQ ID NO: 661 and encodes the amino acid sequence set out as SEQ ID NO: 662. NTHi HI1369 gene sequence is set out as SEQ ID NO: 665 and encodes the amino acid sequence set out as SEQ ID NO: 666. NTHi lay gene sequence is set out as SEQ ID NO: 663 and encodes the amino acid sequence set out as SEQ ID NO: 664. NTHi HI1598 gene sequence is set out as SEQ ID NO: 669 and SEQ ID NO: 671 and encodes the amino acid sequence set out as SEQ ID NO: 670 and SEQ ID NO: 672. Additional NTHi genes associated with virulence include the polynucleotide sequences presented as SEQ ID NO: 667 and SEQ ID NO: 673.

As a method of treating or preventing NTHi infection, the present invention contemplates administering a molecule that inhibits expression or the activity of the NTHi polypeptides, which are upregulated or active during infection. In particular, the invention contemplates methods of treating or preventing NTHi infection comprising modulating NTHi protein expression by administering an antisense oligonucleotide that specifically binds to NTHi genes that are upregulated during NTHi infections, such genes include hisB, lppB, sapA, lolA, rbsC, purE, ribB, arcB, uxuA, dsbB, ureH, licC, HI1647, ispZ, radC, mukF, glpR, ihfB, argR, cspD, HI0094, HI163, HI1063, HI0665, HI1292, HI1064. The invention also contemplates methods of treating or preventing NTHi infection comprising administering antibodies or small molecules that modulate the activity of the proteins encoded by theses genes. The novel NTHi genes included in the polynucleotide sequences presented as SEQ ID NOS: 1-576, SEQ ID NOS: 675-685 and the nucleotide sequences set out in Tables 4 and 4B are also up-regulated during infection of the middle ear and/or the nasopharynx and therefore antisense oligonucleotides that specifically bind these polynucleotide sequences are also contemplated.

Polynucleotides and Polypeptides of the Invention

The present invention provides for the sequences of the NTHi strain 86-028NP genome. The 3-fold anlaysis of the genomic sequence is presented as a series of contig sequences denoted herein as "contigs 1-576". Each contig is assigned a sequence identification number that correlates with its "contig number". Therefore, the contigs of the present invention as set out as SEQ ID NOS: 1-576. These contig polynucleotide sequences may be assembled into the complete genome sequence of the NTHi strain 86-028NP using routine methods. Upon completion of 8-fold sequence analysis of the NTHi strain 82-028NP genome, the genomic sequence was assembled into 11 contigs which are denoted herein as SEQ ID NOS: 675-685. Finally, the complete genome is presented as one nucleic acid sequence denoted herein as SEQ ID NO: 772.

The present invention provides for the NTHi polynucleotide sequences and open reading frames contained within the contigs of SEQ ID NOS: 1-576, SEQ ID NOS: 675-685, SEQ ID NOS: 773-2593, and the nucleotide sequences set out in Table 3B, Table 4B and Table 5. The present invention also provides for the polypeptide sequences encoded by the NTHi polynucleotides of the present invention such as the amino acid sequences set out in SEQ ID NOS: 2594-4414, Table 3B, Table 4B and Table 5. The invention provides for polynucleotides that hybridize under stringent conditions to (a) the complement of the nucleotides sequence of SEQ ID NOS: 1-576; SEQ ID NOS: 675-685, SEQ ID NOS: 773-2593 and the nucleotide sequences set out in Table 3B, Table 4B and Table 5 herein (b) a polynucleotide which is an allelic variant of any polynucleotides recited above; (c) a polynucleotide which encodes a species homolog of any of the proteins recited above; or (d) a polynucleotide that encodes a polypeptide comprising a specific domain or truncation of the NTHi polypeptides of the present invention.

The NTHi polynucleotides of the invention also include nucleotide sequences that are substantially equivalent to the polynucleotides recited above. Polynucleotides according to the invention can have, e.g., at least 65%, at least 70%, at least 75%, at least 80%, 81%, 82%; 83%, 84%, 85%, 86%, 87%, 88%, or 89%, more typically at least 90%, 91%, 92%, 93%, or 94% and even more typically at least 95%, 96%, 97%, 98% or 99% sequence identity to the NTHi polynucleotides recited above.

Included within the scope of the nucleic acid sequences of the invention are nucleic acid sequence fragments that hybridize under stringent conditions to the NTHi nucleotide sequences of SEQ ID NOS: 1-576, SEQ ID NOS: 675-685, SEQ ID NOS: 773-2593, and the nucleotide sequences set out in Table 3B, Table 4B and Table 5 herein, or compliments thereof, which fragment is greater than about 5 nucleotides, preferably 7 nucleotides, more preferably greater than 9 nucleotides and most preferably greater than 17 nucleotides. Fragments of, e.g., 15, 17, or 20 nucleotides or more that are selective for (i.e., specifically hybridize to any one of the polynucleotides of the invention) are contemplated. Probes capable of specifically hybridizing to a polynucleotide can differentiate NTHi polynucleotide sequences of the invention from other polynucleotide sequences in the same family of genes or can differentiate NTHi genes from other bacterial genes, and are preferably based on unique nucleotide sequences.

The term "stringent" is used to refer to conditions that are commonly understood in the art as stringent. Hybridization stringency is principally determined by temperature, ionic strength, and the concentration of denaturing agents such as formamide. Examples of stringent conditions for hybridization and washing are 0.015 M sodium chloride, 0.0015 M sodium citrate at 65-68° C. or 0.015 M sodium chloride, 0.0015M sodium citrate, and 50% formamide at 42° C. See Sambrook et al., *Molecular Cloning: A Laboratory Manual*, $2^{nd}$ Ed., Cold Spring Harbor Laboratory, (Cold Spring Harbor, N.Y. 1989). More stringent conditions (such as higher temperature, lower ionic strength, higher formamide, or other denaturing agent) may also be used, however, the rate of hybridization will be affected. In instances wherein hybridization of deoxyoligonucleotides is concerned, additional exemplary stringent hybridization conditions include washing in 6×SSC 0.05% sodium pyrophosphate at 37° C. (for 14-base oligos), 48° C. (for 17-base oligos), 55° C. (for 20-base oligos), and 60° C. (for 23-base oligos).

Other agents may be included in the hybridization and washing buffers for the purpose of reducing non-specific and/or background hybridization. Examples are 0.1% bovine serum albumin, 0.1% polyvinyl-pyrrolidone, 0.1% sodium pyrophosphate, 0.1% sodium dodecylsulfate, $NaDodSO_4$, (SDS), ficoll, Denhardt's solution, sonicated salmon sperm DNA (or other non-complementary DNA), and dextran sulfate, although other suitable agents can also be used. The concentration and types of these additives can be changed without substantially affecting the stringency of the hybridization conditions. Hybridization experiments are usually carried out at pH 6.8-7.4, however, at typical ionic strength conditions, the rate of hybridization is nearly independent of pH. See Anderson et al., *Nucleic Acid Hybridisation: A Practical Approach*, Ch. 4, IRL Press Limited (Oxford, England). Hybridization conditions can be adjusted by one skilled in the art in order to accommodate these variables and allow DNAs of different sequence relatedness to form hybrids.

The sequences falling within the scope of the present invention are not limited to these specific sequences, but also include allelic and species variations thereof. Allelic and species variations can be routinely determined by comparing the sequence provided in SEQ ID NOS: 1-576, SEQ ID NOS: 675-685, SEQ ID NOS: 773-2593, and nucleotide sequences out in Table 3B, Table 4B and Table 5 herein, preferably the open reading frames therein, a representative fragment thereof, or a nucleotide sequence at least 90% identical, preferably 95% identical, to the open reading frames within SEQ ID NOS: 1-576, SEQ ID NOS: 675-685, SEQ ID NOS: 773-2593, and the nucleotide sequences set out in Table 3B, Table 4B and Table 5 with a sequence from another isolate of the same species. Preferred computer program methods to determine identity and similarity between two sequences include, but are not limited to, the GCG program package, including GAP (Devereux et al., *Nucl. Acid. Res.*, 12: 387, 1984; Genetics Computer Group, University of Wisconsin, Madison, Wis.), BLASTP, BLASTN, and FASTA (Altschul et al., *J. Mol. Biol.*, 215: 403-410, 1990). The BLASTX program is publicly available from the National Center for Biotechnology Information (NCBI) and other sources (*BLAST Manual*, Altschul et al. NCB/NLM/NIH Bethesda, Md. 20894; Altschul et al., supra). The well known Smith Waterman algorithm may also be used to determine identity.

Furthermore, to accommodate codon variability, the invention includes nucleic acid molecules coding for the same amino acid sequences as do the specific open reading frames (ORF) disclosed herein. In other words, in the coding region of an ORF, substitution of one codon for another codon that encodes the same amino acid is expressly contemplated.

The isolated polypeptides of the invention include, but are not limited to, a polypeptide comprising: the amino acid sequences encoded by the nucleotide sequences included within the polynucleotide sequences set out as SEQ ID NOS: 1-576, SEQ ID NOS: 675-685, SEQ ID NOS: 773-2593, and the nucleotide sequences set out in Table 3B, Table 4B and Table 5, or the corresponding full length or mature protein. The polypeptides of the invention include the amino acid sequences of SEQ ID NO: 616, SEQ ID NO: 618, SEQ ID NO: 620, SEQ ID NO: 622, SEQ ID NO: 624, SEQ ID NO: 626, SEQ ID NO: 628, SEQ ID NO: 628, SEQ ID NO: 630, SEQ ID NO: 632, SEQ ID NO: 634, SEQ ID NO: 636, SEQ ID NO: 638, SEQ ID NO: 640, SEQ ID NO: 642, SEQ ID NO: 644, SEQ ID NO: 646, SEQ ID NO: 648, SEQ ID NO: 650, SEQ ID NO: 652, SEQ ID NO: 654, SEQ ID NO: 656, SEQ ID NO: 658, SEQ ID NO: 660, SEQ ID NO: 662, SEQ ID NO: 664, SEQ ID NO: 666, SEQ ID NO: 668, SEQ ID NO: 670, SEQ ID NO: 672, SEQ ID NO: 674, SEQ ID NO: 687, SEQ ID NO: 689, SEQ ID NO: 691, SEQ ID NO: 693, SEQ ID NO: 695, SEQ ID NO: 697, SEQ ID NO: 699, SEQ ID NO: 701, SEQ ID NO: 703, SEQ ID NO: 705, SEQ ID NO: 707, SEQ ID NO: 709, SEQ ID NO: 711, SEQ ID NO: 713, SEQ ID NO:715, SEQ ID NO: 717, SEQ ID NO: 719, SEQ ID NO: 721, SEQ ID NO:723, SEQ ID NO:725, SEQ ID NO:727, SEQ ID NO:729, SEQ ID NO: 731, SEQ ID NO: 733, SEQ ID NO: 735, SEQ ID NO: 737, SEQ ID NO: 739, SEQ ID NO: 741, SEQ ID NO: 743, SEQ ID NO: 745, SEQ ID NO: 747, SEQ ID NO: 749, SEQ ID NO: 751, SEQ ID NO: 753, SEQ ID NO: 755, SEQ ID NO: 757, SEQ ID NO: 759, SEQ ID NO: 761, 763, SEQ ID NO: 765, SEQ ID NO: 767, SEQ ID NO: 769 or SEQ ID NO: 771, SEQ ID NOS: 2594-4414 which are set out in Table 3B, Table 4B and Table 5 herein.

Polypeptides of the invention also include polypeptides preferably with biological or immunogenic activity that are encoded by: (a) an open reading frame contained within the nucleotide sequences set forth as SEQ ID NOS: 1-576, SEQ ID NOS: 675-685, SEQ ID NOS: 773-2593, and the nucleotide sequences set out in Table 3B, Table 4B and Table 5, or (b) polynucleotides that hybridize to the complement of the polynucleotides of (a) under stringent hybridization conditions.

The invention also provides biologically active or immunologically active variants of the amino acid sequences of the present invention; and "substantial equivalents" thereof (e.g., with at least about 65%, at least about 70%, at least about 75%, at least about 80%, at least about 85%, 86%, 87%, 88%, 89%, at least about 90%, 91%, 92%, 93%, 94%, typically at least about 95%, 96%, 97%, more typically at least about 98%, or most typically at least about 99% amino acid identity) that retain biological and/or immunogenic activity. Polypeptides encoded by allelic variants may have a similar, increased, or decreased activity compared to polypeptides encoded by the polynucleotides included within the nucleotide sequences presented in SEQ ID NOS: 1-576, SEQ ID NOS: 675-685, SEQ ID NOS: 773-2593, and the nucleotide sequences encoding the amino acid sequences set out as SEQ ID NOS: 2594-4414 and in Table 3B, Table 4B and Table 5 herein, and the polypeptides having an amino acid sequence set out in SEQ ID NOS: 2594-4414, Table 3B, Table 4B and Table 5 herein NTHi peptides refer to fragments of the NTHi polypeptides encoded by the nucleotide sequences presented in SEQ ID NOS: 1-576, SEQ ID NOS: 675-685, SEQ ID NOS: 773-2593, or the nucleotide sequences set out in Table 3B, Table 4B and Table 5 herein, and the polypeptides having the amino acid sequences set out in SEQ ID NOS: 2594-4414 Table 3B, Table 4B and Table 5 herein. The preferred NTHi peptides are biologically and/or immunologically active.

The present invention further provides isolated NTHi polypeptides or NTHi peptides encoded by the NTHi nucleic acid fragments of the present invention or by degenerate variants of the nucleic acid fragments of the present invention. The term "degenerate variant" refers to nucleotide fragments which differ from a nucleic acid fragment of the present invention (e.g., an ORF) by nucleotide sequence but, due to the degeneracy of the genetic code, encode an identical NTHi polypeptide sequence. Preferred nucleic acid fragments of the present invention are the ORFs that encode proteins.

The invention also provides for NTHi polypeptides with one or more conservative amino acid substitutions that do not affect the biological and/or immunogenic activity of the polypeptide. Alternatively, the NTHi polypeptides of the invention are contemplated to have conservative amino acids substitutions which may or may not alter biological activity. The term "conservative amino acid substitution" refers to a substitution of a native amino acid residue with a normative residue, including naturally occurring and nonnaturally occurring amino acids, such that there is little or no effect on the polarity or charge of the amino acid residue at that position. For example, a conservative substitution results from the replacement of a non-polar residue in a polypeptide with any other non-polar residue. Further, any native residue in the polypeptide may also be substituted with alanine, according to the methods of "alanine scanning mutagenesis". Naturally occurring amino acids are characterized based on their side chains as follows: basic: arginine, lysine, histidine; acidic: glutamic acid, aspartic acid; uncharged polar: glutamine, asparagine, serine, threonine, tyrosine; and non-polar: phenylalanine, tryptophan, cysteine, glycine, alanine, valine, proline, methionine, leucine, norleucine, isoleucine General rules for amino acid substitutions are set forth in Table 1 below.

TABLE 1

Amino Acid Substitutions

| Original Residues | Exemplary Substitutions | Preferred Substitutions |
| --- | --- | --- |
| Ala | Val, Leu, Ile | Val |
| Arg | Lys, Gln, Asn | Lys |
| Asn | Gln | Gln |
| Asp | Glu | Glu |
| Cys | Ser, Ala | Ser |
| Gln | Asn | Asn |
| Glu | Asp | Asn |
| Gly | Pro, Ala | Ala |
| His | Asn, Gln, Lys, Arg | Arg |
| Ile | Leu, Val, Met, Ala, Phe, | Leu |
| Leu | Norleucine, Ile, Val, Met, | Leu |
| Lys | Arg, 1,4 Diaminobutyric | Arg |
| Met | Leu, Phe, Ile | Leu |
| Phe | Leu, Val, Ile, Ala, Tyr | Arg |
| Pro | Ala | Gly |
| Ser | Thr, Ala, Cys | Thr |
| Thr | Ser | Ser |
| Trp | Tyr, Phe | Tyr |
| Tyr | Trp, Phe, Thr, Ser | Phe |
| Val | Ile, Met, Leu, Phe, Ala, | Leu |

Antisense polynucleotides complementary to the polynucleotides encoding the NTHi polypeptides are also provided.

The invention contemplates that polynucleotides of the invention may be inserted in a vector for amplification or expression. For expression, the polynucleotides are operatively linked to appropriate expression control sequence such as a promoter and polyadenylation signal sequences. Further provided are cells comprising polynucleotides of the invention. Exemplary prokaryotic hosts include bacteria such as *E. coli, Bacillus, Streptomyces, Pseudomonas, Salmonella* and *Serratia*.

The term "isolated" refers to a substance removed from, and essentially free of, the other components of the environment in which it naturally exists. For example, a polypeptide is separated from other cellular proteins or a DNA is separated from other DNA flanking it in a genome in which it naturally occurs.

Antibodies and Methods for Eliciting an Immune Response

The invention provides antibodies which bind to antigenic epitopes unique to (i.e., are specific for) NTHi polypeptides. Also provided are antibodies which bind to antigenic epitopes common among multiple *H. influenzae* subtypes but unique with respect to any other antigenic epitopes. The antibodies may be polyclonal antibodies, monoclonal antibodies, antibody fragments which retain their ability to bind their unique epitope (e.g., Fv, Fab and F(ab)2 fragments), single chain antibodies and human or humanized antibodies. Antibodies may be generated by techniques standard in the art.

It is known in the art that antigens that mimic the capsular polysaccharide of *H. influenzae* will generate antibodies that exhibit the ability to kill bacteria in in vitro assays. These antibodies are also known to protect against challenge with *H. influenzae* in animal model systems. These studies indicate antibody to the capsular polysachamides are likely to elicit a protective immune response in humans. The present invention provides for antibodies specific for the NTHi polypeptides of the present invention and fragments thereof, which exhibit the ability to kill both *H. influenzae* bacteria and to protect humans from NTHi infection. The present invention also provides for antibodies specific for the NTHi polypeptides of the invention which reduce the virulence, inhibit adherence, inhibit cell division, and/or inhibit penetration into the epithelium of *H. influenzae* bacteria or enhance phagocytosis of the *H. influenzae* bacteria.

In vitro complement mediated bactericidal assay systems (Musher et al., *Infect. Immun.* 39: 297-304, 1983; Anderson et al., *J. Clin. Invest.* 51: 31-38, 1972) may be used to measure the bactericidal activity of anti-NTHi antibodies. Further data on the ability of NTHi polypeptides and NTHi peptides to elicit a protective antibody response may be generated by using animal models of infection such as the chinchilla model system described herein.

It is also possible to confer short-term protection to a host by passive immunotherapy via the administration of preformed antibody against an epitope of NTHi, such as antibodies against NTHi OMP, LOS or noncapsular proteins. Thus, the contemplated vaccine formulations can be used to produce antibodies for use in passive immunotherapy. Human immunoglobulin is preferred in human medicine because a heterologous immunoglobulin may provoke an immune response to its foreign immunogenic components. Such passive immunization could be used on an emergency basis for immediate protection of unimmunized individuals exposed to special risks. Alternatively, these antibodies can be used in the production of anti-idiotypic antibody, which in turn can be used as an antigen to stimulate an immune response against NTHi epitopes.

The invention contemplates methods of eliciting an immune response to NTHi in an individual. These methods elicit immune responses which include one or more of killing NTHi bacteria, blocking NTHi attachment to cells and/or slowing NTHi replication. An "immunogenic dose" of a composition of the invention is one that generates, after administration, a detectable humoral and/or cellular immune response in comparison to the immune response detectable before administration or in comparison to a standard immune response before administration. The invention contemplates that the immune response resulting from the methods may be protective and/or therapeutic. In one embodiment, the methods comprise a step of administering an immunogenic dose of a composition comprising a NTHi protein or NTHi peptide of the invention. A NTHi protein or an antigenic peptide thereof may be fused with co-protein which may not by itself produce antibodies, but is capable of stabilizing the first protein and producing a fused protein which will have immunogenic and protective properties. Thus fused recombinant protein, preferably further comprises an antigenic co-protein, such as Glutathione-S-transferase (GST) or beta-galactosidase, relatively large co-proteins which solubilize the protein and facilitate production and purification thereof. Moreover, the co-protein may act as an adjuvant in the sense of providing a generalized stimulation of the immune system. The co-protein may be attached to either the amino or carboxy terminus of the first protein. Provided by this invention are compositions, particularly vaccine compositions, and methods comprising the NTHi polypeptides encoded by the polynucleotide of the invention or antigenic peptides thereof.

The invention also contemplates methods of eliciting an immune response to multiple *H. influenzae* subtypes in an individual. These methods elicit immune responses which include one or more of killing the *H. influenzae* bacteria, blocking *H. influenzae* attachment to cells and/or slowing *H. influenzae* replication. These methods comprise a step of administering an immunogenic dose of a composition comprising a NTHi protein or NTHi peptide of the invention which comprise an antigenic epitope that is common among multiple *H. influenzae* subtypes but unique with respect to any other antigenic epitopes.

In another embodiment, the methods comprise administering an immunogenic dose of a composition comprising a cell expressing a NTHi protein or NTHi peptide of the invention. In yet another embodiment, the methods comprise administering an immunogenic dose of a composition comprising a polynucleotide encoding a NTHi protein or NTHi peptide of the invention. The polynucleotide may be a naked polynucleotide not associated with any other nucleic acid or may be in a vector such as a plasmid or viral vector (e.g., adeno-associated virus vector or adenovirus vector). The compositions of the invention may comprise one or more NTHi proteins or NTHi peptides alone or in combination with other epitopes that elicit an immune response to NTHi bacteria. The compositions of the invention may also comprise one or more NTHi proteins or peptides in combination with epitopes that elicit an immune response to one or more *H. influenzae* subtypes. Administration of the compositions may be by routes standard in the art, for example, parenteral, intravenous, oral, buccal, nasal, pulmonary, rectal, or vaginal. The methods may be used in combination in a single individual. The methods may be used prior or subsequent to NTHi infection of an individual.

Genes that are up-regulated in NTHi infection of the middle ear and/or the nasopharynx and genes that are associated with NTHi virulence are described herein. The polypeptides and peptides thereof which are encoded by these NTHi genes are contemplated to be useful for eliciting an immune response for treating or preventing disorders associated with NTHi infection, such as OM. Some of the polypeptides encoded by these genes include: histidine biosynthesis protein, lipoprotein B, peptide ABC transporter, periplasmic SapA precursor, outer membrane lipoproteins carrier protein precursor, ribose transport system permease protein, phosphoribosylaminoimidazole carboxylase catalytic subunit, PurE, Phosphoribosylaminoimidazole carboxylase catalytic subunit, ornithine carbamolytransferase, mannonate dehydratase, disulfide oxidoreductase, urease accessory protein, phospshocholine cytidylytransferase, putative pyridoxine biosynthesis protein, singlet oxygen resistance protein, intracellular septation protein, DNA repair protein, MukF protein, glycerol-3-phosphate regulon repressor, integration host factor beta subunit, arginine repressor, cold shock like protein, stress response protein, LicA, MukF, RadA and those hypothetical proteins encoded by HI0094, HI1163, HI0665, HI1292, HI1064 HI186, HI0352 genes. NTHi OMPs, LOS and noncapsular proteins are also contemplated to elicit an immune response for prevention and treatment of disorders associated with NTHi infection.

The invention includes methods of blocking binding of NTHi bacteria to host cells in an individual. The methods comprise administering antibodies or polypeptides of the invention that block binding of NTHi cellular attachment. Alternatively, administration of one or more small molecules that block binding of NTHi cell attachment is contemplated. In vitro assays may be used to demonstrate the ability of an antibody, polypeptide or small molecule of the invention to block NTHi cell attachment.

Pharmaceutical compositions comprising antibodies of the invention, polypeptides of the invention and/or small molecules of the invention that block NTHi cellular attachment are provided. The pharmaceutical compositions may consist of one of the foregoing active ingredients alone, may comprise combinations of the foregoing active ingredients or may comprise additional active ingredients used to treat bacterial infections. The pharmaceutical compositions may comprise one or more additional ingredients such as pharmaceutically effective carriers. Dosage and frequency of the administration of the pharmaceutical compositions are determined by standard techniques and depend, for example, on the weight and age of the individual, the route of administration, and the severity of symptoms. Administration of the pharmaceutical compositions may be by routes standard in the art, for example, parenteral, intravenous, oral, buccal, nasal, pulmonary, rectal, or vaginal.

Also provided by the invention are methods for detecting NTHi infection in an individual. In one embodiment, the methods comprise detecting NTHi polynucleotides of the invention in a sample using primers or probes that specifically bind to the polynucleotides. Detection of the polynucleotide may be accomplished by numerous techniques routine in the art involving, for example, hybridization and PCR.

The antibodies of the present invention may also be used to provide reagents for use in diagnostic assays for the detection of NTHi antigens (NTHi polypeptides and peptides thereof) in various body fluids of individuals suspected of *H. influenzae* infection. In another embodiment, the NTHi proteins and peptides of the present invention may be used as antigens in immunoassays for the detection of NTHi in various patient tissues and body fluids including, but not limited to: blood, serum, ear fluid, spinal fluid, sputum, urine, lymphatic fluid and cerebrospinal fluid. The antigens of the present invention may be used in any immunoassay system known in the art including, but not limited to: radioimmunoassays, ELISA assays, sandwich assays, precipitin reactions, gel diffusion precipitin reactions, immunodiffusion assays, agglutination assays, fluorescent immunoassays, protein A immunoassays and immunoelectrophoresis assays.

Vaccines and Chemotherapeutic Targets

An aspect of the invention relates to a method for inducing an immunological response in an individual, particularly a mammal which comprises inoculating the individual with a NTHi antigen protein or an antigenic peptide thereof.

The present invention also provides for vaccine formulations which comprise an immunogenic recombinant NTHi protein or NTHi peptide of the invention together with a suitable carrier. The NTHi polypeptides and peptides thereof contemplated as vaccine candidates and/or targets of chemotherapy include, but are not limited to, histidine biosynthesis protein, lipoprotein B, peptide ABC transporter, periplasmic SapA precursor, outer membrane lipoproteins carrier protein precursor, ribose transport system permease protein, phosphoribosylaminoimidazole carboxylase catalytic subunit, PurE, 3,4-dihydroxt-2-butone 4-phosphate synthase, ornithine carbamoyltransferase, mannonate dehydratase, disulfide oxidoreductase, urease accessory protein, phospshocholine cytidylytransferase, putative pyridoxine biosynthesis protein, singlet oxygen resistance protein, intracellular septation protein, DNA repair protein, MUKF protein, glycerol-3-phosphate regulon repressor, integration host factor beta subunit, arginine repressor, cold shock like protein, stress response protein, LicA, RadA and those hypothetical proteins encoded by HI0094, HI1163, HI0665, HI1292, HI1064 HI1386, HI0352 genes, NTHi OMPs, NTHi LOS and NTHi noncapsular proteins and polypeptides encoded by the novel NTHi polynucleotide sequences present in the nucleotide sequences set out as SEQ ID NOS: 1-576, SEQ ID NOS: 675-685, SEQ ID NOS: 773-2593, and the nucleotide sequences set out in Table 3B, Table 4B and Table 5 herein, and the polypeptides having the amino acid sequences set out in SEQ ID NOS: 2594-1114, Table 3B, Table 4B and Table 5 herein.

Since the protein may be broken down in the stomach, it is preferably administered parenterally, including, for example, administration that is subcutaneous, intramuscular, intravenous, or intradermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampules and vials and may be stored in a freeze-dried condition requiring only the addition of the sterile liquid carrier immediately prior to use. The vaccine formulation may also include adjuvant systems for enhancing the immunogenicity of the formulation, such as oil-in water systems and other systems known in the art. The dosage will depend on the specific activity of the vaccine and can be readily determined by routine experimentation.

A. Peptide Vaccines

Peptide therapeutic agents, such as peptide vaccines, are well known in the art and are of increasing use in the pharmaceutical arts. Consistent drawbacks to the parenteral administration of such peptide compounds have been the rapidity of breakdown or denaturation. Infusion pumps, as well as wax or oil implants, have been employed for chronic administration of therapeutic agents in an effort to both pro-long the presence of peptide-like therapeutic agents and preserve the integrity of such agents. Furthermore, the peptide-like agent should (with particular reference to each epitope of the peptide-like agent) ideally maintain native state configuration for an extended period of time and additionally be presented in a fashion suitable for triggering an immunogenic response in the challenged animal or immunized human.

The NTHi antigenic peptides of the invention can be prepared in a number of conventional ways. The short peptides sequences can be prepared by chemical synthesis using standard means. Particularly convenient are solid phase techniques (see, e.g., Erikson et al., *The Proteins* (1976) v. 2, Academic Press, New York, p. 255). Automated solid phase synthesizers are commercially available. In addition, modifications in the sequence are easily made by substitution, addition or omission of appropriate residues. For example, a cysteine residue may be added at the carboxy terminus to provide a sulfhydryl group for convenient linkage to a carrier protein, or spacer elements, such as an additional glycine residue, may be incorporated into the sequence between the linking amino acid at the C-terminus and the remainder of the peptide. The short NTHi peptides can also be produced by recombinant techniques. The coding sequence for peptides of this length can easily be, synthesized by chemical techniques, e.g., the phosphotriester method described in Matteucci et al., *J Am Chem Soc.,* 103: 3185 (1981).

Some of the NTHi peptide sequences contemplated herein may be considered too small to be immunogenic, they may be linked to carrier substances in order to confer this property upon them. Any method of creating such linkages known in the art may be used. Linkages can be formed with heterobifunctional agents that generate a disulfide link at one functional group end and a peptide link at the other, such as a disulfide amide forming agent, e.g., N-succidimidyl-3-(2-pyridyldithio) proprionate (SPDP) (See, e.g., Jansen et al., *Immun. Rev.* 62:185, 1982) and bifunctional coupling agents that form a thioether rather than a disulfide linkage such as reactive esters of 6-maleimidocaproic acid, 2-bromoacetic acid, 2-iodoacetic acid, 4-(N-maleimido-methyl)cyclohexane-1-carboxylic acid and the like, and coupling agent which activate carboxyl groups by combining them with succinimide or 1-hydroxy-2-nitro-4-sulfonic acid, for sodium salt such as succinimmidyl 4-(N-maleimido-methyl)cyclohexane-1-carobxylate (SMCC).

B. Vaccine Compositions and Administration

A priming dose of the immunogen that is followed by one or more booster exposures to the immunogen may be necessary to be an effective vaccine (Kramp et al., *Infect. Immun.,* 25: 771-773, 1979; Davis et al., *Immunology Letters,* 14: 341-8 1986 1987). Examples of proteins or polypeptides that could beneficially enhance the immune response if co-administered include cytokines (e.g., GM-CSF), cytokine-inducing molecules (e.g. Leaf) or costimulatory molecules. Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-β) may be beneficial in certain diseases.

Ideally, an immunogen will exhibit two properties; the capacity to stimulate the formation of the corresponding antibodies and the propensity to react specifically with these antibodies. Immunogens bear one or more epitopes which are the smallest part of an immunogen recognizable by the combining site of an antibody. In particular instances, immunogen, fractions of immunogens or conditions under which the immunogen is presented are inadequate to precipitate the desired immunological response resulting in insufficient immunity. This is often the case with peptides or other small molecules used as immunogens. Other substances such as immunomodulators (e.g., cytokines such as the interleukins) may be combined in vaccines as well.

The vaccine art recognizes the use of certain substances called adjuvants to potentate an immune response when used in conjunction with an immunogen. Adjuvants are further used to elicit an immune response that is faster or greater than would be elicited without the use of the adjuvant. In addition, adjuvants may be used to create an immunological response using less immunogen than would be needed without the inclusion of adjuvant, to increase production of certain antibody subclasses that afford immunological protection or to enhance components of the immune response (e.g., humoral, cellular). Known adjuvants include emulsions such as Freund's Adjuvants and other oil emulsions, *Bordetella pertussis*, MF59, purified saponin from *Quillaja saponaria* (QS21), aluminum salts such as hydroxide, phosphate and alum, calcium phosphate, (and other metal salts), gels such as aluminum hydroxide salts, mycobacterial products including muramyl dipeptides, solid materials, particles such as liposomes and virosomes. Examples of natural and bacterial products known to be used as adjuvants include monophosphoryl lipid A (MPL), RC-529 (synthetic MPL-like acylated monosaccharide), OM-174 which is a lipid A derivative from *E. coli*, holotoxins such as cholera toxin (CT) or one of its derivatives, pertussis toxin (PT) and heat-labile toxin (LT) of *E. coli* or one of its derivatives, and CpG oligonucleotides. Adjuvant activity can be affected by a number of factors, such as carrier effect, depot formation, altered lymphocyte recirculation, stimulation of T-lymphocytes, direct stimulation of B-lymphocytes and stimulation of macrophages.

Vaccines are typically prepared as injectables, either as liquid solutions or suspensions; solid forms suitable for solution in, or suspension in, liquid prior to injection may also be prepared. The preparation may also be emulsified. The active immunogenic ingredient is often mixed with excipients, which are pharmaceutically acceptable and compatible with the active ingredient. Suitable excipients are, e.g., water, saline, dextrose, glycerol, ethanol, or the like and combinations thereof. In addition, if desired, the vaccine may contain minor amounts of auxiliary substances such as wetting or emulsifying agents, pH buffering agents, or adjuvants, which enhance the effectiveness of the vaccine. The vaccines are conventionally administered parenterally, by injection, for example, either subcutaneously or intramuscularly. Additional formulations which are suitable for other modes of administration include suppositories and, in some cases, oral formulations. For suppositories, traditional binders and carriers may include, for example, polyalkalene glycols or triglycerides; such suppositories may be formed from mixtures containing the active ingredient in the range of 0.5% to 10%, preferably 1-2%. Oral formulations include such normally employed excipients as, for example, pharmaceutical grades of mannitol, lactose, starch, magnesium stearate, sodium saccharine, cellulose, magnesium carbonate and the like. These compositions take the form of solutions, suspensions, tablets, pills, capsules, sustained release formulations or powders and contain 10%-95% of active ingredient, preferably 25-70%.

Vaccines may also be administered through transdermal routes utilizing jet injectors, microneedles, electroporation, sonoporation, microencapsulation, polymers or liposomes, transmucosal routes and intranasal routes using nebulizers, aerosols and nasal sprays. Microencapsulation using natural or synthetic polymers such as starch, alginate and chitosan, D-poly L-lactate (PLA), D-poly DL-lactic-coglycolic microspheres, polycaprolactones, polyorthoesters, polyanhydrides and polyphosphazenes polyphosphatazanes are useful for both transdermal and transmucosal administration. Polymeric complexes comprising synthetic poly-ornithate, poly-lysine and poly-arginine or amphipathic peptides are useful for transdermal delivery systems. In addition, due to their amphipathic nature, liposomes are contemplated for transdermal, transmucosal and intranasal vaccine delivery systems. Common lipids used for vaccine delivery include N-(1)2,3-(dioleyl-dihydroxypropyl)-N,N,N,-trimethylammonium-methyl sulfate (DOTAP), dioleyloxy-propyl-trimethylammonium chloride DOTMA, dimystyloxypropyl-3-dimethyl-hydroxyethyl ammonium (DMRIE), dimethyldioctadecyl ammonium bromide (DDAB) and 9N(N',N-dimethylaminoethane)carbamoyl)cholesterol (DC-Chol). The combination of helper lipids and liposomes will enhance up-take of the liposomes through the skin. These helper lipids include, dioleoyl phosphatidylethanolamine (DOPE), dilauroylphosphatidylethanolamine (DLPE), dimyristoyl phosphatidylethanolamine (DMPE), dipalmitoylphosphatidylethanolamine (DPPE). In addition, triterpenoid glycosides or saponins derived from the Chilean soap tree bark (*Quillaja saponaria*) and chitosan (deacetylated chitan) have been contemplated as useful adjuvants for intranasal and transmucosal vaccine delivery.

The proteins may be formulated into the vaccine as neutral or salt forms. Pharmaceutically acceptable salts, include the acid addition salts (formed with the free amino groups of the peptide) and which are formed with inorganic acids such as, e.g., hydrochloric or phosphoric acids, or such organic acids as acetic, oxalic, tartaric, mandelic. Salts formed with the free carboxyl groups may also be derived from inorganic bases such as, e.g., sodium, potassium, ammonium, calcium, or ferric hydroxides, and such organic bases as isopropylamine, trimethylamine, 2-ethylamino ethanol, histidine, and procaine.

The vaccines are administered in a manner compatible with the dosage formulation, and in such amount as will be therapeutically effective and immunogenic. The quantity to be administered depends on the subject to be treated, capacity of the subject's immune system to synthesize antibodies, and the degree of protection desired. Precise amounts of active ingredient required to be administered depend on the judgment of the practitioner and are peculiar to each individual. However, suitable dosage ranges are of the order of several hundred micrograms active ingredient per individual. Suitable regimes for initial administration and booster shots are also variable, but are typified by an initial administration followed in one or three month intervals by a subsequent injection or other administration.

Upon immunization with a vaccine composition as described herein, the immune system of the host responds to the vaccine by producing large amounts of CTLs specific for the desired antigen, and the host becomes at least partially immune to later infection, or resistant to developing chronic infection. Vaccine compositions containing the NTHi polypeptide or NTHi peptides of the invention are administered to a patient susceptible to or otherwise at risk of bacterial infection to elicit an immune response against the antigen and thus enhance the patient's own immune response capabilities. In this use, the precise amounts again depend on the patient's state of health and weight, the mode of administration, the nature of the formulation, etc., but generally range from about 1.0 µg to about 5000 per 70 kilogram patient, more commonly from about 10 to about 500 mg per 70 kg of body weight. For therapeutic or immunization purposes, the NTHi polypeptide or NTHi peptides of the invention can also be expressed by attenuated viral hosts, such as vaccinia or fowlpox. This approach involves the use of vaccinia virus as a vector to express nucleotide sequences that encode the peptides of the invention. Upon introduction into an acutely or chronically infected host or into a noninfected host, the recombinant vaccinia virus expresses the immunogenic peptide, and thereby elicits a host CTL response.

Humoral immune response may be measured by many well known methods, such as Single Radial Immunodiffussion Assay (SRID), Enzyme Immunoassay (EIA) and Hemagglutination Inhibition Assay (HAI). In particular, SRID utilizes a layer of a gel, such as agarose, containing the immunogen being tested. A well is cut in the gel and the serum being tested is placed in the well. Diffusion of the antibody out into the gel leads to the formation of a precipitation ring whose area is proportional to the concentration of the antibody in the serum being tested. EIA, also known as ELISA (Enzyme Linked Immunoassay), is used to determine total antibodies in the sample. The immunogen is adsorbed to the surface of a microliter plate. The test serum is exposed to the plate followed by an enzyme linked immunoglobulin, such as IgG. The enzyme activity adherent to the plate is quantified by any convenient means such as spectrophotometry and is proportional to the concentration of antibody directed against the immunogen present in the test sample. HAI utilizes the capability of an immunogen such as viral proteins to agglutinate chicken red blood cells (or the like). The assay detects neutralizing antibodies, i.e., those antibodies able to inhibit hemagglutination. Dilution of the test serum are incubated with a standard concentration of immunogen, followed by the addition of the red blood cells. The presence of neutralizing antibodies will inhibit the agglutination of the red blood cells by the immunogen. Tests to measure cellular immune response include determination of delayed-type hypersensitivity or measuring the proliferative response of lymphocytes to target immunogen.

Nontypeable *Haemophilus influenzae* (NTHi)

*H. influenzae* is a small, nonmotile gram negative bacterium. Unlike other *H. influenzae* strains, the nontypeable *H. influenzae* (NTHi) strains lack a polysaccharide capsule and are sometimes denoted as "nonencapsulated." NTHi strains are genetically distinct from encapsulated strains and are more heterogenous than the type b *H. influenzae* isolates. NTHi presents a complex array of antigens to the human host. Possible antigens that may elicit protection include OMPs, lipopolysaccharides, lipoproteins, adhesion proteins and noncapsular proteins.

Humans are the only host for *H. influenze*. NTHi strains commonly reside in the upper respiratory tract including the nasopharynx and the posterior oropharynx, the lower respiratory tract and the female genital tract. NTHi causes a broad spectrum of diseases in humans, including but not limited to, otitis media, pneumonia, sinusitis, septicemia, endocarditis, epiglottitis, septic arthritis, meningitis, postpartum and neonatal infections, postpartum and neonatal sepsis, acute and chromic salpingitis, epiglottis, pericarditis, cellulitis, osteomyelitis, endocarditis, cholecystitis, intraabdominal infections, urinary tract infection, mastoiditis, aortic graft infection, conjunctitivitis, Brazilian purpuric fever, occult bacteremia and exacerbation of underlying lung diseases such as chronic bronchitis, bronchietasis and cystic fibrosis.

Epidemiologic studies of NTHi have indicated that the strains are heterogeneous with respect to outer membrane protein profiles (Barenkamp et al., *Infect. Immun.*, 36: 535-

40, 1982), enzyme allotypes (Musser et al., *Infect. Immun.,* 52: 183-191, 1986), and other commonly used epidemiologic tools. There have been several attempts to subtype NTHi, but none of the methodologies have been totally satisfactory. The outer-membrane protein composition of NTHi consists of approximately 20 proteins. All NTHi strains contains two common OMP's with molecular weights of 30,000 and 16,600 daltons. NTHi strains may be subtyped based on two OMP's within the 32,000-42,000 dalton range. The NTHi liposaccharide profile is fundamentally different than the enteric gram negative bacteria and separates into 1-4 distinct bands ranging from less than 20,000 daltons.

A prototype NTHi isolate is the low passage isolate 86-028NP which was recovered from a child with chronic otitis media. This strain has been well characterized in vitro (Bakaletz et al., *Infect. Immun.,* 53: 331-5, 1988; Holmes et al., *Microb. Pathog.,* 23: 157-66, 1997) as well as in the chinchilla OM model (described herein) (Bakaletz et al., *Vaccine,* 15: 955-61, 1997; Suzuki et al., *Infect. Immun.,* 62: 1710-8, 1994; DeMaria et al., *Infect. Immun.,* 64: 5187-92, 1996). The 86-028NP strain was used, as described herein, to identify genes that are up-regulated in expression in the chinchilla model of otitis media and genes that are necessary for NTHi survival in the chinchilla middle ear.

DFI Strategy

A differential fluorescence induction (DFI) strategy was used herein to identify NTHi genes induced during OM in a chinchilla animal model. Several methods have been developed to identify bacterial genes that contribute to the virulence of an organism during infection. Such methods include in vivo expression technology (IVET) in which bacterial promoters regulate the expression of gene(s) required for synthesis of essential nutrients required for survival in the host; signature-tagged mutagenesis (STM) enabling tag-specific identification of genes that alter the virulence properties of a microorganism when mutated; DNA microarray technology to globally screen for transcriptionally active genes, and DFI which uses Fluorescent Activated Cell Sorting (FACS) analysis to select for transcriptionally active promoters (Chiang et al., *Annu. Rev. Microbiol.,* 53: 129-154, 1999). DFI is a high-throughput method that allows for the identification of differentially regulated genes regardless of the basal level of expression and does not exclude those that are essential for growth in vitro.

DFI has been successfully utilized in many microorganisms. For example, a Green Fluorescent Protein (GFP) reporter system and flow cytometry was used to study mycobacterial gene expression upon interaction with macrophages (Dhandayuthapani et al., *Mol. Microbiol.,* 17: 901-912, 1995). A promoter trap system was used to identify genes whose transcription was increased when Salmonellae were subjected to environments simulating in vivo growth and when internalized by cultured macrophage-like cells (Valdivia and Falkow, *Mol. Microbiol.,* 22: 367-378, 1996; Valdivia and Falkow, *Science,* 277: 2007-2011, 1997; Valdivia and Falkow, *Curr. Opin. Microbiol.,* 1: 359-363, 1998). In addition, DFI has been used to identify promoters expressed in *S. pneumoniae* and *S. aureus* when grown under varied in vitro conditions simulating infection (Marra et al., *Infect. Immun.,* 70(3): 1422-1433, 2002; Schneider et al., *Proc. Natl. Acad. Sci. U.S.A.,* 97: 1671-1676, 2000). In addition, DFI has been utilized to study gene regulation in *Bacillus cereus* in response to environmental stimuli (Dunn and Handelsman, *Gene,* 226: 297-305, 1999), in *S. pneumoniae* in response to a competence stimulatory peptide (Bartilson et al., *Mol. Microbiol.,* 39: 126-135, 2001), and upon interaction with and invasion of host cells in *Bartonella henselae* Lee and Falkow, *Infect. Immun.,* 66: 3964-3967, 1998), *Listeria monocytogenes* Wilson et al., *Infect. Immun.,* 69: 5016-5024, 2001), *Brucella abortus* (Eskra et al., *Infect. Immun.,* 69: 7736-7742, 2001), and *Escherichia coli* (Badger et al., *Mol. Microbiol.,* 36: 174-182, 2000).

Whereas DFI has been successfully used to identify promoters active in cell culture models of infection or in vitro conditions designed to simulate an in vivo environment, few have applied DFI to identify promoters regulated in a specific biological niche within the whole animal. This is likely due to the numerous challenges associated with sorting from an in vivo environment. The host inflammatory response, dissemination and/or clearance of bacterial cells from the site of infection, as well as adherence of bacteria to epithelial cells, possibly via biofilm formation, can make bacteria inaccessible for retrieval from the living animal. These factors, among others, contribute to the complexity of the microenvironment and the heterogeneity of gene expression as the bacteria sense and respond to these changes. Recently, DFI has been used to identify promoters expressed in *S. pneumoniae* when the bacteria were screened in a mouse model of respiratory tract infection and a gerbil infection model of OM (Marra et al., *Infect. Immun.* 70: 1422-33, 2002; Marra et al., *Microbiol.,* 148: 1483-91, 2002).

Animal Model

The chinchilla model is a widely accepted experimental model for OM. In particular, a chinchilla model of NTHi-induced OM has been well characterized (Bakaletz et al., *J. Infect. Dis.,* 168: 865-872, 1993; Bakaletz and Holmes, *Clin. Diagn. Lab. Immunol.,* 4: 223-225, 1997; Suzuki and Bakaletz, *Infect. Immun.,* 62: 1710-1718, 1994), and has been used to determine the protective efficacy of several NTHi outer membrane proteins, combinations of outer membrane proteins, chimeric synthetic peptide vaccine components, and adjuvant formulations as vaccinogens against OM (Bakaletz et al., *Vaccine,* 15: 955-961, 1997; Bakaletz et al., *Infect. Immun.,* 67: 2746-2762, 1999; Kennedy et al., *Infect. Immun.,* 68: 2756-2765, 2000).

In particular, there is an unique in vivo model wherein adenovirus predisposes chinchillas to *H. influenzae*-induced otitis media, which allowed for the establishment of relevant cell, tissue and organ culture systems for the biological assessment of NTHi (Bakaletz et al., *J. Infect. Dis.,* 168: 865-72, 1993; Suzuki et al., *Infect. Immunity* 62: 1710-8, 1994). Adenovirus infection alone has been used to assess for the transudation of induced serum antibodies into the tympanum (Bakaletz et al., *Clin. Diagnostic Lab Immunol.,* 4(2): 223-5, 1997) and has been used as a co-pathogen with NTHi, to determine the protective efficacy of several active and passive immunization regimens targeting various NTHi outer membrane proteins, combinations of OMPs, chimeric synthetic peptide vaccine components, and adjuvant formulations as vaccinogens against otitis media (Bakaletz et al., *Infect Immunity,* 67(6): 2746-62, 1999; Kennedy et al., *Infect Immun.,* 68(5): 2756-65, 2000; Novotny et al., *Infect Immunity* 68(4): 2119-28, 2000; Poolman et al., *Vaccine* 19 (Suppl. 1): S108-15, 2000).

Genes Unregulated In Vivo in Response to NTHi Infection of the Middle Ear

In order to identify differentially regulated promoters in response to NTHi infection of the middle ear, a promoter trap library was constructed and sorting parameters defined. A portion of the promoter trap library was inoculated directly into the chinchilla middle ear and OM development was monitored by video otoscopy and tympanometry at 24 and 48 hours. In addition, the middle ear fluids were recovered 24 and 48 hours after infection. Two-color FACS analysis was used to isolated bacteria that were expressing GFP from other cells and debris associated with the effusion. Following isolation, DNA sequence of the *Haemophilus* inserts 5' of the gfpmut3 gene were determined and analyzed. In this manner, we identified genes that are up-regulated as NTHi sense and respond to the environment of the chinchilla middle ear during AOM. The following genes were identified and due to their up-regulation during NTHi infection, they may play a role in NTHi infection and virulence.

As described below in Example 7, following the DFI procedure described above and subsequent FACS analysis of gfp-expressing clones, 52 candidate clones containing potential in vivo-regulated promoters were isolated. The genes these clones control were categorized based upon general description and function within the cell and include general metabolic processes, environmental informational processing and membrane transport, membrane proteins and hypothetical proteins. Eight of these 52 clones contain sequences that are unique to NTHi strain 86-028NP. Importantly, 3 clones were isolated from independent screens in more than one animal thereby verifying the method of isolation.

In order to independently confirm the FACS data, we determined the relative expression of candidate genes by quantitative Reverse Transcriptase-Polymerase Chain Reaction (RT-PCR). The parent strain 86-028NP, was used for these studies. Thus, wild-type gene expression without the influence of plasmid copy number on gene regulation was analyzed, allowing for the indication of false-positive clone identification by FACS. Of the 44 candidate clones containing sequence similar to that identified in *H. influenzae* strain Rd, quantitative comparison of gene expression in vitro and in vivo confirmed up-regulated gene expression for twenty-six genes (60%) when NTHi respond to environmental cues present in the chinchilla middle ear. This analysis identified in vivo-regulated promoters which drive expression of genes involved in membrane transport, environmental informational processing, cellular metabolism, gene regulation, as well as hypothetical proteins with unknown function. (See Table 4 in Example 6).

Quantitative RT-PCR demonstrated a two-fold increase in lolA expression, enabling lipoprotein transport from the inner membrane to the outer membrane. Bacteria grow rapidly in the middle ear environment reaching $5.0 \times 10^8$ CFU NTHi ml middle ear fluid within 48 hours. The bacteria sense and respond to the environment, acquiring or synthesizing the necessary nutrients for growth and survival. The gene encoding the membrane component in ribose sugar transport, rbsC (SEQ ID NO: 619), showed a 5-fold increase in expression in vivo compared to cells growing in vitro. In addition, many genes involved in metabolic processes show a dramatic increase in gene expression in vivo compared to cells growing in vitro. These include a riboflavin synthesis gene, ribB (SEQ ID NO: 623), a purine nucleotide biosynthetic gene purE (SEQ ID NO: 621), ornithine carbamoyltransferase, arcB (SEQ ID NO: 625), involved in arginine degradation via the urea cycle and uxuA (SEQ ID NO: 627), encoding mannonate hydrolase, required for the uptake of D-glucuronate and transformation into glyceraldehyde 3-phosphate. In addition, but to a lesser degree, genes for histidine biosynthesis (hisB; SEQ ID NO: 615), DNA repair (radC; SEQ ID NO: 639) and a putative intracellular septation transmembrane protein (ispZ; SEQ ID NO: 637) were up-regulated.

Disulfide bond formation is important for folding and assembly of many secreted proteins in bacteria. In prokaryotes, DsbA and DsbB make up the oxidative pathway responsible for the formation of disulfides. DsbB reoxidizes DsbA, which donates disulfide bonds directly to unfolded polypeptides, and DsbB has been demonstrated to generate disulfides de novo from oxidized quinones (Collet and Bardwell, *Mol. Microbial.*, 44: 1-8, 2002). In *H. influenzae* strain Rd, DsbA is required for competence for transformation (Tomb, *Proc. Natl. Acad. Sci. U.S.A.*, 89: 10252-10256, 1992). Herein, an approximate 3-fold increase in dsbB gene (SEQ ID NO: 629) transcription was demonstrated, illuminating an important role for disulfide interchange for NTHi growing in the middle ear environment.

Bacteria colonization of the middle ear, a normally sterile environment, results in a host inflammatory response and subsequent neutrophil infiltration. Bacteria have evolved numerous strategies to combat this host response. NTHi increase gene expression (4-fold) of ureH (SEQ ID NO:631), a homologue of a gene required for expression of active urease in *Helicobacter*, shown to be involved in acid tolerance (Young et al., *J. Bacterol.*, 178: 6487-6495, 1996). Recently, it has been reported that urease activity may play a role in chronic *Actinobacillus pleuropneumoniae* infection by counteracting the decrease in pH occurring upon infection (Baltes et al., *Infect. Immun.*, 69: 472-478, 2000; Baltes et al., *Infect. Immun.*, 69: 472-478, 2001; Bosse and Machines, *Can. J. Vet. Res.*, 64: 145-150). A biotype analysis on NTHi isolates from middle ear effusions demonstrated that 87% are urease positive (DeMaria et al., *J. Clin. Microbiol.*, 20: 1102-1104, 1984). However, the role of urease in NTHi virulence is unknown. Similarly, an increase in expression of a gene whose product demonstrates 88% sequence identity to a pyridoxine biosynthesis protein in *S. pneumoniae* and 60% homology to a putative singlet oxygen resistance protein that may function as an antioxidant. Phosphorylcholine (ChoP) has been implicated in the pathogenesis of NTHi (Weiser et al., *Infect. Immun.*, 65: 943-950, 1997). NTHi modulates ChoP expression by phase variation, decorating the LOS on the cell surface. ChoP may contribute to NTHi persistence in the respiratory tract via decreased susceptibility to antimicrobial peptides (Lysecko et al., *Infect. Immun.*, 68: 1664-1671, 2000) and alter the sensitivity to serum killing mediated by C-reactive protein (CRP) (Weiser et al., *J. Exp. Med.*, 187: 631-640, 1998). The microenvironment of the nasopharynx and middle ear cavity may select for the $ChoP^+$ phenotype, as $ChoP^+$ strains show greater colonization of the chinchilla nasopharynx (Tong et al., *Infect. Immun.*, 68: 4593-4597, 2000). Expression of the licC gene (SEQ ID NO: 633) was also increased. The licC gene encodes a phosphorylcholine cytidylyltransferase that plays a role in the biosynthesis of phosphorylcholine-derivatized LOS (Rock et al., *J. Bacterol.*, 183: 4927-4931, 2001).

Also included among the in vivo-induced genes is a set whose products subsequently regulate gene expression or DNA replication. These genes include transcriptional regulation of glycerol metabolism by the glp repressor, glpR (SEQ ID NO: 643), the arginine repressor gene, argR (SEQ ID NO: 647), and the integration host factor (1HF) beta subunit, ihfB (SEQ ID NO: 645). IHF is a histone-like protein that binds DNA at specific sequences, an accessory factor involved in replication, site-specific recombination and transcription, altering the activity of a large number of operons (Goosen and van de Putte, *Mol. Microbiol.* 16: 1-7, 1995). In addition, CspD inhibits DNA replication during stationary phase-induced stress response in *E. coli* (Yamanaka et al., *Mol. Microbiol.*, 39: 1572-1584, 2001) and the mukF (SEQ ID NO: 641) gene protein homologue contributes to a remodeling of the nucleiod structure into a more compact form prior to cell segregation (Sawitzke and Austin, *Proc. Natl. Acad. Sci. U.S.A.*, 62: 1710-1718, 2000). The DFI strategy described herein also identified promoters induced in vivo for genes of unknown function. The hypothetical protein, HI0094, demonstrated an 8-fold increase in gene expression during early OM but its role remains unknown. HI1163 (SEQ ID NO: 651) showed 58% amino acid identity with the hypothetical YdiJ proteins, a putative oxidase, of E. coli.

A high-density transposon mutagenesis strategy was used to identify H. influenzae genes essential for growth on rich medium (Akerley et al., Proc. Natl. Acad. Sci. U.S.A., 99: 966-971, 2002). Six genes were identified in the screen described herein that are included in essential gene set described in Akerley' et al., supra. (hisB, lppB, lolA, ispZ, mukF and unknown HI0665). Recently genes of non-typeable H. influenzae that are expressed upon interaction with two human respiratory tract-derived epithelial cell lines have been identified. These genes included those involved in metabolic processes, stress responses, gene expression, cell envelope biosynthesis, DNA-related processes, cell division and ORF's encoding proteins of unknown function. (Ulsen et al., Mol. Microbiol., 45: 485-500, 2002). Similarly the stress response gene, cspD (SEQ ID NO: 649), genes involved in purine and riboflavin biosynthesis, and a protein of unknown function, vapA was identified in the screen described herein. Expression of vapA was detected in vitro, yet vapA gene expression increased two-fold in vivo. These unique approaches identified known genes that are upregulated in NTHi-induced OM and therefore are likely to play a role in NTHi infection and virulence; and may be potential candidates for vaccines and antisense therapies and other therapeutic methods of treatment of NTHi related disorders.

The DFI strategy resulted in the identification of promoters induced in vivo for genes of unknown function as well. The hypothetical protein, HI0094, demonstrated a 8-fold increase in gene expression during early OM but its role remains unknown. HI1163 (SEQ ID NO: 651) showed 58% amino acid identity with the hypothetical YdiJ proteins, a putative oxidase, of E. coli. Therefore, these hypothetical genes are likely to play a role in OM induced by NTHi infection.

BRIEF DESCRIPTION OF FIGURES

FIGS. 3A-3M set out the nucleotide sequences (SEQ ID NOS: 589-614) described in Table 4, which were identified to be upregulated during OM infection (see Example 6). The nucleotides (nt.) which correspond to known genes and those nt. which correspond to the contig sequences set out as SEQ ID NO: 1-576 are also presented.

DETAILED DESCRIPTION

Figure 1:
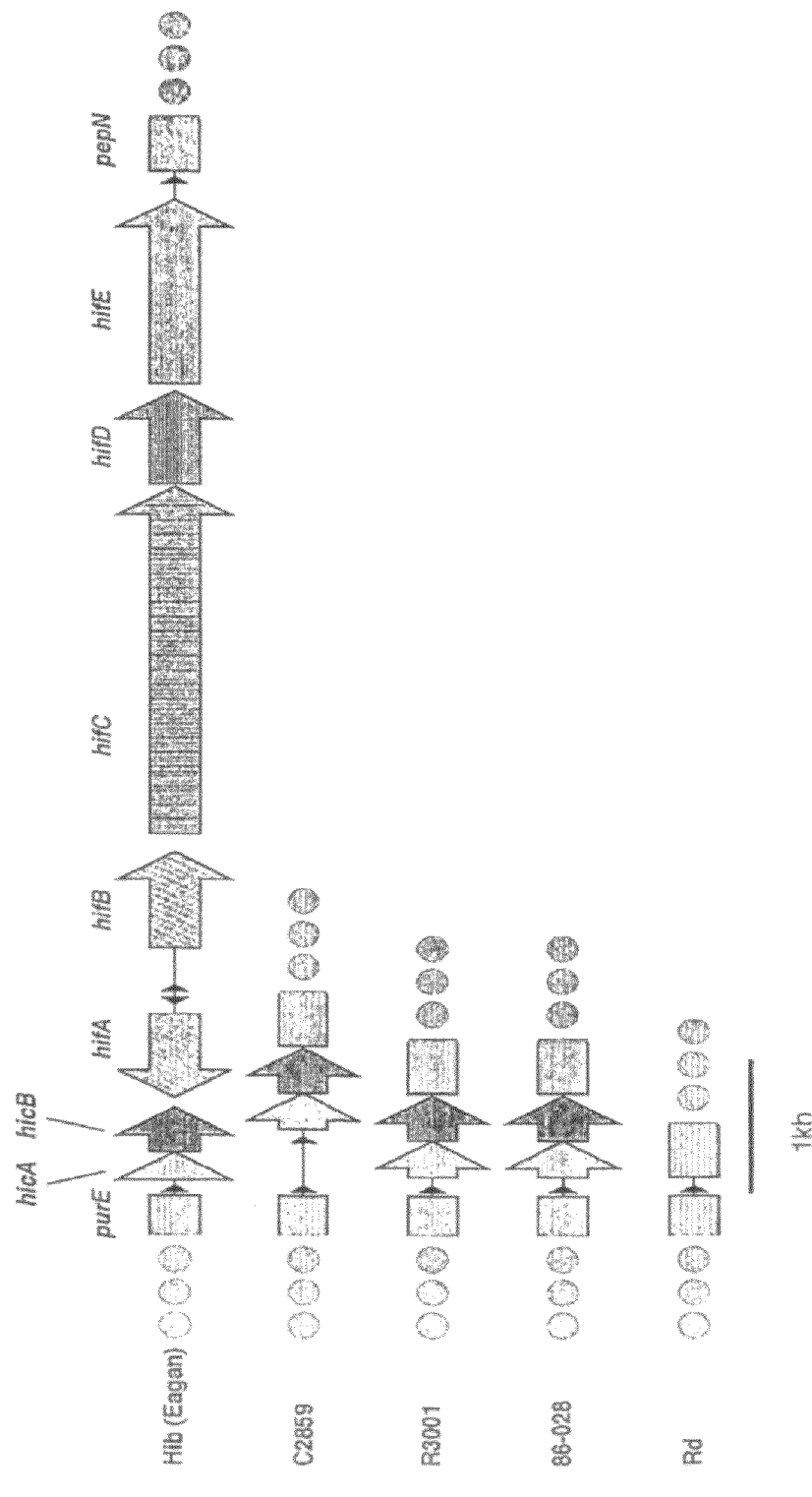
FIG. 1 depicts the LKP gene region in a panel of Haemophilus isolates. The strain 86-028NP sequence is identical in this region to the sequence in NTHi strain R3001. Both of these NTHi lack the hif gene cluster encoding the hemagglutinating pilus.

The following examples illustrate the invention wherein Example 1 describes the sequence of the NTHi genome, Example 2 describes the identified contigs and initial gene discovery, Example 3 describes construction of the NTHi promoter trap library, Example 4 describes the analyses of 86-028NP derivatives expressing GFP, Example 5 demonstrates direct labelling of bacteria from middle ear fluids, Example 6 describes identification of promoters induced in vivo in acute otitis media, Example 7 describes identification of virulence-associated genes, Example 8 describes identification of unique NTHi gene sequences, Example 9 described the analysis of the complete NTHi 86-028NP genome, and Example 10 compares the genomic DNA sequences of NTHi, strain 86-028NP and H. influenzae serotype d, strain kw20

EXAMPLE 1

Sequence of a Non-Typeable Haemophilus influenzae Genome

NTHi strain 86-028NP is a minimally passaged clinical isolate obtained from a pediatric patient who underwent tympanostomy and tube insertion for chronic OM at Columbus Children's Hospital. (Bakaletz et al. Infection and Immunity, 56(2): 331-335, 1988) The 86-028NP strain was deposited with the American Type Tissue Collection (Manassas, Va. 20108 USA) on Oct. 16, 2002 and assigned accession no. PTA-4764.

In an effort to more broadly approach the identification of the virulence determinants in NTHi, the genome of the NTHi 86-028NP strain was sequenced to 3-fold coverage. Chromosomal DNA was prepared from strain 86-028NP using the Puregene protocol and sheared to 2-4 kb in size with a Hydroshear instrument (Gene Machines). The sheared DNA was ethanol-precipitated, end-repaired using a mixture of Klenow enzyme and T4 DNA polymerase, and size-selected by agarose gel electrophoresis to obtain 2-4 kb fragments as described in Chissoe et al. (Methods: a Companion to Methods of Enzymology 3: 55-65, 1991) and Sambrook et al. (Molecular Cloning: a Laboratory Manual, $2^{nd}$ Ed. Cold Springs Harbor, N.Y., 1989). These fragments were cloned into vector pUC18 using the SmaI restriction site (phosphatase-treated) and transformed into E. coli XL-1 Blue, selecting for ampicillin resistance. Colonies that contain inserts were identified by blue/white screening on LB-Amp plates containing X-gal, and transferred into 96-deep well plates containing 1.5 ml of TB-Amp (TB=Terrific Broth) broth. The deep-well plate cultures were grown overnight (18-22 hours) at 37° C. Template preparation, sequencing and contig assembly were performed.

Automated template preparation was performed on the Beckman Biomek 2000 automated robotics workstation as described in Chissoe et al., (supra.) Briefly, each 96-deep well plate, containing the clones prepared above, was centrifuged to pellet the cells, the supernatant decanted, and the cells frozen (if necessary) at −20° C. Four 96-deep well blocks were placed on the Biomek table, and the liquid handling robot was used to prepare the template using an automated version of a typical SDS-NaOH lysis protocol as described in Chissoe et al., (supra.). The final ethanol-precipitated templates were each dissolved in 50 µl ddH$_2$O, and used for DNA sequencing.

Sequencing reactions were run by re-arraying the templates (from 96-well plates) into 384-well plates, using the Robbins Hydra 96 robot. Cycle-sequencing reactions were run using PE Big-Dye™ terminators and universal primers (M13 forward and reverse), cleaned up over Sephadex G50 columns, and analyzed on a PE Biosystems 3700 capillary electrophoresis DNA sequencer according to the manufacturer's instructions. Sequencing reads (8219) were assembled into 576 contigs (SEQ ID NOS: 1-576 herein). The statistics for the 3-fold sequencing are shown in Table 2A. The total unique sequence in assembly 17 is 1.74 Mb.

TABLE 2A

| Contig Size | Total Number | Total Length | % of Cumulative |
|---|---|---|---|
| 0-1 kb | 65 | 55961 | 3.2% |
| 1-2 kb | 228 | 333665 | 19.2% |
| 2-3 kb | 101 | 243059 | 14.0% |
| 3-4 kb | 49 | 172385 | 9.9% |
| 4-5 kb | 45 | 196699 | 11.3% |
| 5-10 kb | 74 | 515152 | 29.6% |
| 10-20 kb | 11 | 144591 | 8.3% |
| 20-30 kb | 3 | 77352 | 4.4% |

Subsequently, 8-fold sequencing analysis of the NTHi genome was carried out. The 8-fold sequencing assembled the NTHi genome into 11 contigs. Contigs 5, 8, 9, 10, 12-18 are denoted as SEQ ID NOS: 675-685 herein. The statistics for the 8-fold sequencing are shown in Table 2B.

TABLE 2B

| Contig Size | Total Number | Total Length | % of Cumulative |
|---|---|---|---|
| 0-1 kb | 5 | 3950 | 0.2% |
| 1-2 kb | 3 | 4316 | 0.2% |
| 2-3 kb | 0 | 0 | 0.0% |
| 3-4 kb | 1 | 3964 | 0.2% |
| 4-5 kb | 0 | 0 | 0.0% |
| 5-10 kb | 0 | 0 | 0.0% |
| 10-20 kb | 1 | 15147 | 0.8% |
| 20-30 kb | 2 | 51888 | 2.7% |
| 30-40 kb | 0 | 0 | 0.0% |
| 40-50 kb | 0 | 0 | 0.0% |
| 50-100 kb | 1 | 85814 | 4.5% |
| >100 kb | 5 | 1760339 | 91.4% |

EXAMPLE 2

Contig Description and Initial Gene Discovery

Seventy-five of the 88 contigs with length ≧5000 bp, identified with the 3-fold sequence analysis, show significant similarity via BLASTN to genes in *H. influenzae* strain Rd. To visualize the potential relationship between the gene order in *H. influenzae* strain 86-028NP and *H. influenzae* strain Rd, the 86-028NP three-fold contig set and the Rd gene set were bidirectionally compared using BLASTN. The results were plotted in gene-order verses contig space by sorting the contigs based on gene coordinates of the Rd genes hit, anchoring each contig at the smallest coordinate found as described in Ray et al., (*Bioinformatics* 17: 1105-12, 2001). Compared in this fashion, an incomplete assembly of a genome with identical gene order to a completely known genome would display a monotonically increasing stair-stepped form.

BLASTX was used to identify hits to sequences with homology to genes in the strain Rd genome as well as genes not found in *H. influenzae* strain Rd. Hits to strain Rd sequences were removed from the data set and the other hits summarized in Table 3A. The data are presented as follows: contig # (SEQ ID NO: #), column 1; E score for each hit, column 2; the name of the protein that had homology to a portion of the amino acid translation of the cited contig, column 3; the organism producing the homologue, column 4; and the Genbank protein identifier for each of the proteins cited in column 3, column 5; the corresponding nucleotides within the contig (referenced by SEQ ID NO:). In most instances, several homologues were identified but for clarity, the protein of greatest homology is cited in Table 3A.

The sequences for some of the genes listed in Table 3A were identified within the 8-fold sequencing of the NTHi genome. Table 3B lists the location of these genes within the 11 contigs, the full length open reading frame sequence (identified by SEQ ID NO:), the derived amino acid sequence encoded by the open reading frame and the gene with high homology identified by BLASTX (as listed in Table 3A).

Figure 2:
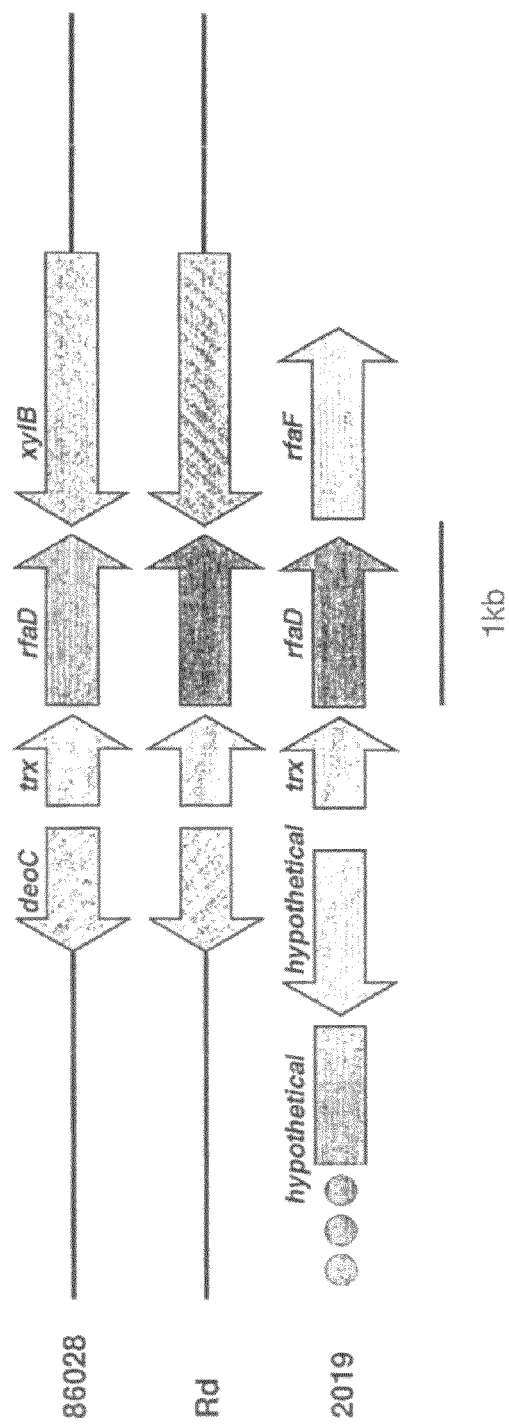
FIG. 2 depicts the rfaD region in a panel of Haemophilus isolates. The gene arrangement in the rfaD region of the strain 86-028NP genome is similar to that of the strain Rd genome but different than the arrangement of these genes seen in the genome of most NTHi examined.

To examine the relative short range gene arrangements in NTHi and the Rd strain, the gene order in two gene clusters that have been well-described were compared. First, the genes present in the hemagglutinating pilus (LKP) gene region were examined. (Mhlanga-Mutangadura et al., *J Bacteriol.* 180(17): 4693-703, 1998). The pilus gene cluster is located between the purE and pepN genes, only fragments of which are depicted in FIG. 1. The serotype b strain, Eagan, contains the hifABCDE gene cluster and produces hemagglutinating pili. Strain Rd lacks the hicAB genes as well as the hifABCDE gene cluster. In general, the nontypeable strains previously examined contained the hicAB genes but not the hif genes that encode the hemagglutinating pilus. The strain 86-028NP sequence (described herein) is identical in this region to the sequence in NTHi strain R3001 (FIG. 1). The rfaD gene encodes an enzyme involved in the biosynthesis of endotoxin. In addition, the rfaD gene from NTHi strain 2019 has been characterized by Nichols et al. (*Infect Immunity* 65(4): 1377-86, 1997). In strain 2019, the rfaD gene is immediately upstream of the rfaF gene that encodes another enzyme involved in endotoxin biosynthesis. The gene arrangement in strain Rd is different; the rfaD and rfaF genes are separated by approximately 11 kb of sequence. Most nontypeable strains examined contained the gene arrangement seen in strain 2019. In contrast, strain 86-028NP has a gene arrangement identical to that seen in strain Rd (FIG. 2).

A global analysis of the current assembly indicates that the gene content and order are similar to that in strain Rd. A more detailed analysis revealed that there are a substantial number of NTHi genes not previously seen in the Pasteurellaceae and some regions where the NTHi gene content and order is different than that seen in strain Rd. Thus, the current data suggest that the strain 86-028NP genome will contain a complex mosaic of Rd and non-Rd like features.

The DFI strategy also identified novel NTHi sequences that had increased gene expression. A list of these novel contig sequences that contain genes or gene fragments that have homology to ORFs in other organisms (primarily grain-negative bacteria) is set out in Table 3A. For example, the nucleotide sequence of contig 442 (SEQ ID NO: 442), nucleotides 1498-1845 are highly homologous to the sequences encoding amino acids 1-116 of *H. influenzae* strain Rd lipoprotein B (LppB). The gene is positioned between the stationary phase survival gene, surE, and a gene encoding a 43 kD antigenic outer membrane lipoprotein that is highly homologous to the recently identified bacterial lipoprotein, LppB/NlpD, which has been associated with virulence (Padmalayam et al., *Infect. Immun.*, 68: 4972-4979, 2000). Recently, Zhang and coworkers demonstrated that nlpD and surE gene expression was induced during stationary phase of bacterial growth in *Thermotoga maritima* (Zhang et al., *Structure (Camb)*, 9: 1095-1106, 2001). Therefore, under stress-induced conditions in the middle ear, this NTHi lipoprotein may be expressed.

TABLE 3A

| Contig | E score | Hit Identity | Organism | Genbank Protein | SEQ ID NO: |
|---|---|---|---|---|---|
| 104 | 4.00E−59 | CpdB | *Pasteurella multocida* | NP_246953.1 | nt. 204-659 of SEQ ID NO: 104 |
| 106 | 9.00E−10 | hypothetical protein PH0217 - | *Pyrococcus horikoshii* | G71244 | nt. 40-309 of SEQ ID NO: 106 |
| 106 | 1.00E−08 | unknown | *Pasteurella multocida* | NP_246871.1 | nt. 605-694 of SEQ ID NO: 106 |
| 106 | 2.00E−20 | Orf122 | *Chlorobium tepidum* | AAG12204.1 | nt. 7-210 of SEQ ID NO: 106 |
| 110 | 3.00E−05 | ArdC antirestriction protein | IncW plasmid pSa | AAD52160.1 | compliment of nt. 959-1162 of SEQ ID NO: 110 |
| 110 | 1.00E−33 | hypothetical protein | *Salmonella enterica* subsp. *enterica serovar Typhi* | NP_458676.1 | compliment of nt. nt. 181-825 of SEQ ID NO: 110 |
| 111 | 5.00E−12 | putative membrane protein | *Salmonella enterica* subsp. *enterica serovar Typhi* | NP_458664.1 | compliment of nt. 45-287 of SEQ ID NO: 111 |
| 111 | 6.00E−41 | hypothetical protein | *Salmonella enterica* subsp. *enterica serovar Typhi* | NP_458658.1 | compliment of nt. 1091-1480 of SEQ ID NO: 111 |
| 114 | 7.00E−80 | unknown | *Pasteurella multocida* | NP_245828.1 | compliment of nt. 118-696 of SEQ ID NO: 114 |
| 115 | 2.00E−09 | A111R | *Paramecium bursaria Chlorella virus 1* | NP_048459.1 | nt. 555-869 of SEQ ID NO: 115 |
| 118 | 5.00E−45 | DNA methylase HsdM, putative | *Vibrio cholerae* | NP_231404.1 | nt. 44-439 of SEQ ID NO: 118 |
| 122 | 2.00E−18 | unknown | *Pasteurella multocida* | NP_245314.1 | nt. 865-1302 of SEQ ID NO: 122 |
| 123 | 4.00E−99 | RNA POLYMERASE SIGMA-32 FACTOR | *Proteus mirabilis* | P50509 | nt. 351-782 of SEQ ID NO: 123 |
| 124 | 9.00E−58 | ACETOLACTATE SYNTHASE (ACETOHYDROXY-ACID SYNTHASE) (ALS) | *Spirulina platensis* | P27868 | nt. 603-1025 of SEQ ID NO: 124 |
| 130 | 0 | restriction modification system-R protein | *Neisseria meningitidis* | CAA09003.1 | nt. 495-1559 of SEQ ID NO: 130 |
| 131 | 6.00E−91 | uronate isomerase (glucuronate isomerase) | *Salmonella enterica* subsp. *enterica serovar Typhi* | NP_457532.1 | compliment of nt. 661-1380 of SEQ ID NO: 131 |
| 133 | 3.00E−30 | GyrA | *Pasteurella multocida* | NP_245778.1 | compliment of nt. 1447-1626 of SEQ ID NO: 133 |
| 133 | 1.00E−27 | DNA GYRASE SUBUNIT A | *Pectobacterium carotovorum* | P41513 | compliment of nt. 1302-1442 of SEQ ID NO: 133 |
| 138 | 7.00E−06 | KicA | *Pasteurella multocida* | NP_245545.1 | compliment of nt. 92-157 of SEQ ID NO: 138 |
| 138 | 1.00E−148 | TYPE II RESTRICTION ENZYME HAEII (ENDONUCLEASE HAEII) (R. HAEII) | *Haemophilus aegyptius* | O30869 | compliment of nt. 164-1045 of SEQ ID NO: 138 |
| 143 | 4.00E−06 | Gifsy-1 prophage protein | *Salmonella typhimurium* LT2 | NP_461555.1 | compliment of nt. 228-632 of SEQ ID NO: 143 |
| 143 | 1.00E−14 | hypothetical protein | Bacteriophage VT2-Sa | NP_050531.1 | compliment of nt. 778-1248 of SEQ ID NO: 143 |
| 143 | 5.00E−09 | hypothetical protein | *Salmonella enterica* subsp. *enterica serovar Typhi* | CAD09979.1 | compliment of nt. 715-1026 of SEQ ID NO: 143 |
| 143 | 6.00E−10 | hypothetical 14.9 kd protein | *Escherichia coli* | NP_065324.1 | nt. 3-173 of SEQ ID NO: 143 |

TABLE 3A-continued

| Contig | E score | Hit Identity | Organism | Genbank Protein | SEQ ID NO: |
|---|---|---|---|---|---|
| 147 | 1.00E−38 | GTP-binding elongation factor, may be inner membrane protein | Escherichia coli O157:H7 EDL933 | NP_289127.1 | compliment of nt. 172-342 of SEQ ID NO: 147 |
| 147 | 2.00E−14 | GTP-binding membrane protein (lepA) | Borrelia burgdorferi | NP_212222.1 | compliment of nt. 17-181 of SEQ ID NO: 147 |
| 148 | 6.00E−17 | galactokinase | Homo sapiens | AAC35849.1 | compliment of nt. 746-1246 of SEQ ID NO: 148 |
| 148 | 7.00E−96 | GALACTOKINASE (GALACTOSE KINASE) | Actinobacillus pleuropneumoniae | P94169 | compliment of nt. 232-741 of SEQ ID NO: 148 |
| 149 | 1.00E−92 | GTP-binding protein TypA/BipA | Buchnera sp. APS | NP_240245.1 | compliment of nt. 265-1077 of SEQ ID NO: 149 |
| 15 | 2.00E−21 | ORF 1 | Escherichia coli | CAA39631.1 | nt. 665-850 of SEQ ID NO: 15 |
| 150 | 6.00E−17 | unknown | Pasteurella multocida | NP_245919.1 | nt. 171-665 of SEQ ID NO: 150 |
| 153 | 7.00E−07 | outer membrane protein A | Rickettsia conorii | T30852 | nt. 51-623 of SEQ ID NO: 153 |
| 155 | 7.00E−40 | cytochrome d ubiquinol oxidase, subunit II | Vibrio cholerae | NP_233259.1 | nt. 583-1002 of SEQ ID NO: 155 |
| 157 | 7.00E−13 | unknown | Pasteurella multocida | NP_245490.1 | compliment of nt. 1170-1367 of SEQ ID NO: 157 |
| 157 | 2.00E−05 | glycosyl transferase | Neisseria gonorrhoeae | AAA68012.1 | nt. 85-189 of SEQ ID NO: 157 |
| 158 | 1.00E−152 | MltC | Pasteurella multocida | NP_246259.1 | compliment of nt. 36-530 of SEQ ID NO: 158 |
| 161 | 3.00E−25 | lipoprotein, putative | Vibrio cholerae | NP_230232.1 | nt. 870-1439 of SEQ ID NO: 161 |
| 163 | 9.00E−53 | chorismate synthase | Caulobacter crescentus | NP_421948.1 | nt. 1283-2029 of SEQ ID NO: 163 |
| 168 | 3.00E−13 | COPPER-TRANSPORTING ATPASE 1 (COPPER PUMP 1) | Mus musculus | Q64430 | nt. 66-995 of SEQ ID NO: 168 |
| 168 | 2.00E−22 | Cu transporting ATPase P | Homo sapiens | 2001422A | nt. 135-989 of SEQ ID NO: 168 |
| 174 | 8.00E−48 | magnesium/cobalt transport protein | Mesorhizobium loti | NP_103977.1 | nt. 918-1205 of SEQ ID NO: 174 |
| 175 | 5.00E−26 | vacB protein | Buchnera sp. APS | NP_240369.1 | compliment of nt. 1-1587 of SEQ ID NO: 175 |
| 176 | 3.00E−21 | putative ABC transport system permease protein [ | Campylobacter jejuni | NP_282774.1 | compliment of nt. 259-1089 of SEQ ID NO: 176 |
| 183 | 5.00E−29 | PROBABLE ATP SYNTHASE A CHAIN TRANSMEMBRANE PROTEIN | Ralstonia solanacearum | NP_521442.1 | compliment of nt. 42-677 of SEQ ID NO: 183 |
| 185 | 6.00E−85 | putative exported protein | Salmonella enterica subsp. enterica serovar Typhi | NP_458655.1 | compliment of nt. 162-1529 of SEQ ID NO: 185 |
| 187 | 2.00E−05 | transketolase | Homo sapiens | AAA61222.1 | nt. 709-819 of SEQ ID NO: 187 |
| 188 | 1.00E−116 | ribonuclease E | Xylella fastidiosa 9a5c | NP_299884.1 | compliment of nt. 280-1704 of SEQ ID NO: 188 |
| 192 | 1.00E−38 | ImpA | Pasteurella multocida | NP_245829.1 | nt. 35-448 of SEQ ID NO: 192 |
| 193 | 3.00E−08 | Orf80 | Enterobacteria phage 186 | NP_052285.1 | nt. 1612-1818 of SEQ ID NO: 193 |
| 193 | 1.00E−06 | holin | Haemophilus somnus | AAC45168.1 | nt. 370-576 of SEQ ID NO: 193 |
| 193 | 0.007 | unknown | Enterobacteria phage 186 | NP_052260.1 | nt. 1376-1609 of SEQ ID NO: 193 |
| 193 | 2.00E−48 | lysozyme | Haemophilus somnus | AAC45169.1 | nt. 608-1093 of SEQ ID NO: 193 |

TABLE 3A-continued

| Contig | E score | Hit Identity | Organism | Genbank Protein | SEQ ID NO: |
|---|---|---|---|---|---|
| 199 | 4.00E−21 | unknown protein | *Escherichia coli* O157:H7 EDL933, prophage CP-933V | NP_288675.1 | nt. 398-778 of SEQ ID NO: 199 |
| 199 | 2.00E−49 | hypothetical protein | Bacteriophage 933W | NP_049495.1 | compliment of nt. 1907-2392 of SEQ ID NO: 199 |
| 20 | 1.00E−62 | RpL14 | *Pasteurella multocida* | NP_246344.1 | compliment of nt. 233-601 of SEQ ID NO: 20 |
| 200 | 2.00E−62 | hypothetical protein | *Salmonella enterica* subsp. *enterica* serovar *Typhi* | NP_458658.1 | compliment of nt. 431-997 of SEQ ID NO: 200 |
| 200 | 3.00E−16 | hypothetical protein | *Salmonella enterica* subsp. *enterica* serovar *Typhi* | NP_458657.1 | compliment of nt. 1028-1264 of SEQ ID NO: 200 |
| 201 | 2.00E−26 | TsaA | *Pasteurella multocida* | NP_245732.1 | compliment of nt. 1618-1809 of SEQ ID NO: 201 |
| 209 | 6.00E−16 | TsaA | *Pasteurella multocida* | NP_245732.1 | compliment of nt. 2-136 of SEQ ID NO: 209 |
| 211 | 2.00E−15 | unknown | *Pasteurella multocida* | NP_245535.1 | compliment of nt. 23-211 of SEQ ID NO: 211 |
| 211 | 1.00E−70 | PUTATIVE ATPASE PROTEIN | *Ralstonia solanacearum* | NP_520082.1 | compliment of nt. 475-915 of SEQ ID NO: 211 |
| 212 | 3.00E−18 | hypothetical protein | *Escherichia coli* O157:H7 | NP_309775.1 | compliment of nt. 895-1035 of SEQ ID NO: 212 |
| 216 | 1.00E−173 | unknown | *Pasteurella multocida* | NP_245069.1 | nt. 35-1543 of SEQ ID NO: 216 |
| 217 | 9.00E−18 | diacylglycerol kinase | *Vibrio cholerae* | NP_233101.1 | nt. 2083-2208 of SEQ ID NO: 217 |
| 221 | 4.00E−34 | Tail-Specific Protease | *Chlamydia trachomatis* | NP_219953.1 | nt. 849-1421 of SEQ ID NO: 221 |
| 222 | 4.00E−23 | AGR_C_3689p | *Agrobacterium tumefaciens* str. C58 (Cereon) | NP_355005.1 | compliment of nt. 940-1305 of SEQ ID NO: 222 |
| 224 | 9.00E−19 | unknown | *Pasteurella multocida* | NP_245536.1 | nt. 15-308 of SEQ ID NO: 224 |
| 225 | 1.00E−89 | portal vector-like protein, in phage P2 [Salmonella typhimurium LT2] | *Salmonella typhimurium* LT2Fels-2 prophage | NP_461651.1 | nt. 31-750 of of SEQ ID NO: 225 |
| 229 | 2.00E−25 | anaerobic ribonucleotide reductase | *Salmonella typhimurium* | CAB62266.1 | nt. 1806-2108 of SEQ ID NO: 229 |
| 234 | 3.00E−08 | conserved hypothetical protein | *Xylella fastidiosa* 9a5c | NP_299850.1 | nt. 1680-2048 of SEQ ID NO: 234 |
| 234 | 1.00E−42 | Methionine sulfoxide reductase C-terminal domain related protein, YPPQ ortholog | *Clostridium acetobutylicum* | NP_348177.1 | compliment of nt. 415-654 of SEQ ID NO: 234 |
| 235 | 4.00E−16 | phage-related tail protein | *Wolbachia* endosymbiont of *Drosophila melanogaster* | AAK85310.1 | compliment of nt. 931-1929 of SEQ ID NO: 235 |
| 235 | 6.00E−56 | similar to orfG protein in phage 186, Salmonella typhimurium LT2 | *Salmonella typhimurium* LT2, Fels-2 prophage | NP_461625.1 | compliment of nt. 313-1863 of SEQ ID NO: 235 |
| 236 | 6.00E−20 | conserved hypothetical protein | *Pseudomonas aeruginosa* | NP_252693.1 | nt. 1572-1916 of SEQ ID NO: 236 |
| 240 | 5.00E−27 | MODIFICATION METHYLASE BEPI | *Brevibacterium epidermidis* | P10283 | compliment of nt. 922-1305 of SEQ ID NO: 240 |
| 241 | 2.00E−15 | phage-related protein | *Xylella fastidiosa* 9a5c | NP_299573.1 | compliment of nt. 865-1305 of SEQ ID NO: 241 |

TABLE 3A-continued

| Contig | E score | Hit Identity | Organism | Genbank Protein | SEQ ID NO: |
|---|---|---|---|---|---|
| 241 | 4.00E−08 | hypothetical protein | phage SPP1 | T42296 | nt. 73-636 of SEQ ID NO: 241 |
| 241 | 4.00E−07 | hypothetical protein | *Salmonella enterica* subsp. *enterica serovar Typhi* | NP_458686.1 | nt. 10-468 of SEQ ID NO: 241 |
| 242 | 2.00E−29 | translation elongation factor EF-G | chloroplast-soybean | S35701 | compliment of nt. 18-1085 of SEQ ID NO: 242 |
| 247 | 3.00E−23 | GTP CYCLOHYDROLASE I (GTP-CH-I) | *Synechococcus* sp. PCC 7942 | Q54769 | compliment of nt. 1009-1257c of SEQ ID NO: 247 |
| 248 | 6.00E−05 | phospho-N-acetylmuramoyl-pentapeptide-transferase | *Aquifex aeolicus* | NP_213025.1 | nt. 830-1747 of SEQ ID NO: 248 |
| 25 | 2.00E−86 | PROBABLE TRANSPORT TRANSMEMBRANE PROTEIN | *Ralstonia solanacearum* | NP_522358.1 | compliment of nt. 309-854 of SEQ ID NO: 25 |
| 25 | 7.00E−06 | major facilitator family transporter | *Caulobacter crescentus* | NP_419155.1 | compliment of nt. 134-283 of SEQ ID NO: 25 |
| 250 | 1.00E−150 | CpdB | *Pasteurella multocida* | NP_246953.1 | compliment of nt. 36-1016 of SEQ ID NO: 250 |
| 252 | 3.00E−57 | alanyl-tRNA synthetase | *Vibrio cholerae* | AAA99922.1 | compliment of nt. 1418-1951 of SEQ ID NO: 252 |
| 253 | 1.00E−108 | similar to glutathione Reductase | *Listeria monocytogenes* EGD-e | NP_464432.1 | compliment of nt. 411-1358 of of SEQ ID NO: 253 |
| 259 | 3.00E−39 | hypothetical protein | *Salmonella enterica* subsp. *enterica serovar Typhi* | NP_458654.1 | compliment of nt. 342-1037 of SEQ ID NO: 259 |
| 259 | 3.00E−17 | possible exported protein | *Salmonella enterica* subsp. *enterica serovar Typhi* | NP_458653.1 | compliment of nt. 1251-1607 of SEQ ID NO: 259 |
| 261 | 5.00E−74 | hypothetical protein 6 - Haemophilus influenzae | *Haemophilus influenzae* | S27582 | compliment of nt. 3-422 of SEQ ID NO: 261 |
| 263 | 1.00E−94 | putative transposase | *Haemophilus paragallinarum* | AAD01406.1 | nt. 2142-2672 of SEQ ID NO: 263 |
| 264 | 1.00E−126 | unknown | *Actinobacillus actinomycetemcomitans* | NP_067554.1 | nt. 40-714 of SEQ ID NO: 264 |
| 264 | 1.00E−103 | unknown | *Actinobacillus actinomycetemcomitans* | NP_067555.1 | nt. 695-1309 of SEQ ID NO: 264 |
| 264 | 2.00E−21 | unknown | *Actinobacillus actinomycetemcomitans* | NP_067556.1 | nt. 1302-1448 of SEQ ID NO: 264 |
| 265 | 6.00E−27 | Aminopeptidase 2 | chloroplast | Q42876 | nt. 556-1539 of SEQ ID NO: 265 |
| 268 | 1.00E−116 | MutY | *Pasteurella multocida* | NP_246257.1 | nt. 1003-1581 of SEQ ID NO: 268 |
| 272 | 1.00E−07 | hypothetical protein | Bacteriophage 933W | NP_049495.1 | compliment of nt. 77-232 of SEQ ID NO: 272 |
| 274 | 3.00E−13 | unknown | *Pasteurella multocida* | NP_246952.1 | compliment of nt. 1658-1975 of SEQ ID NO: 274 |
| 275 | 3.00E−20 | CafA | *Neisseria gonorrhoeae* | AAG24267.1 | nt. 1299-1571 of SEQ ID NO: 275 |
| 276 | 1.00E−45 | mukE protein | *Vibrio cholerae* | NP_231351.1 | compliment of nt. 650-1390 of SEQ ID NO: 276 |
| 276 | 1.00E−69 | KicA | *Pasteurella multocida* | NP_245545.1 | compliment of nt. 647-1321 of SEQ ID NO: 276 |

TABLE 3A-continued

| Contig | E score | Hit Identity | Organism | Genbank Protein | SEQ ID NO: |
|---|---|---|---|---|---|
| 278 | 2.00E−56 | 3-oxoacyl-[acyl-carrier-protein] synthase III | Salmonella enterica subsp. enterica serovar Typhi | NP_455686.1 | nt. 1366-1944 of SEQ ID NO: 278 |
| 281 | 5.00E−56 | unknown | Pasteurella multocida | NP_246261.1 | compliment of nt. 31-678 of SEQ ID NO: 281 |
| 282 | 3.00E−09 | orf25; similar to T gene of P2 | bacteriophage phi CTX | NP_490625.1 | compliment of nt. 511-1032 of SEQ ID NO: 282 |
| 282 | 1.00E−08 | orf11; similar to phage P2 gene S-like product, which is involved in tail synthesis, | Haemophilus somnus | AAC45165.1 | compliment of nt. 1450-1584 of SEQ ID NO: 282 |
| 282 | 9.00E−27 | putative bacteriophage tail protein | Salmonella enterica subsp. enterica serovar Typhi | NP_457167.1 | compliment of nt. 3-509 of SEQ ID NO: 282 |
| 286 | 5.00E−18 | plasmid-related protein | Listeria innocua plasmid | NP_471066.1 | compliment of nt. 887-1501 of SEQ ID NO: 286 |
| 287 | 8.00E−20 | GTP cyclohydrolase II | Escherichia coli O157:H7 EDL933 | NP_287920.1 | nt. 2-145 of SEQ ID NO: 287 |
| 289 | 1.00E−168 | MODIFICATION METHYLASE HAEII | Haemophilus aegyptius | O30868 | compliment of nt. 138-1091 of SEQ ID NO: 289 |
| 289 | 5.00E−11 | TYPE II RESTRICTION ENZYME HAEII | Haemophilus aegyptius | O30869 | compliment of nt. 22-132 of SEQ ID NO: 289 |
| 289 | 6.00E−47 | mukF homolog | Haemophilus influenzae biotype aegyptius | AAB70828.1 | compliment of nt. 1107-1385 of SEQ ID NO: 289 |
| 294 | 1.00E−171 | LICA PROTEIN | Haemophilus influenzae RM7004 | P14181 | compliment of nt. 677-1564 of SEQ ID NO: 294 |
| 297 | 1.00E−158 | DNA methylase HsdM, putative | Vibrio cholerae | NP_231404.1 | compliment of nt. 12-1136 of SEQ ID NO: 297 |
| 302 | 0 | HEME-BINDING PROTEIN A | Haemophilus influenzae DL42 | P33950 | nt.3-1316 of SEQ ID NO: 302 |
| 304 | 6.00E−19 | hypothetical protein 6 | Haemophilus influenzae | S27582 | nt. 121-267 of SEQ ID NO: 304 |
| 305 | 6.00E−40 | putative recombinase - phage associated | Streptococcus pyogenes M1 GAS | NP_269557.1 | nt. 65-805 of SEQ ID NO: 305 |
| 305 | 7.00E−22 | single stranded DNA-binding protein | Shewanella sp. F1A | AAB57886.1 | nt. 1607-2014 of SEQ ID NO: 305 |
| 305 | 1.00E−43 | phage-related protein | Bacillus halodurans | NP_244410.1 | nt. 92-751 of SEQ ID NO: 305 |
| 312 | 1.00E−28 | PUTATIVE BACTERIOPHAGE-RELATED TRANSMEMBRANE PROTEIN | Ralstonia solanacearum | NP_518994.1 | nt. 1819-2673 of SEQ ID NO: 312 |
| 312 | 9.00E−25 | similar to BASEMENT MEMBRANE-SPECIFIC HEPARAN SULFATE PROTEOGLYCAN CORE PROTEIN PRECURSOR (HSPG) | Homo sapiens | XP_068727.1 | nt. 27-1001 of SEQ ID NO: 312 |
| 315 | 2.00E−45 | uracil permease | Deinococcus radiodurans | NP_296001.1 | compliment of nt. 525-1592 of SEQ ID NO: 315 |
| 318 | 7.00E−15 | CzcD | Pasteurella multocida | NP_246276.1 | compliment of nt. 3-227 of SEQ ID NO: 318 |

TABLE 3A-continued

| Contig | E score | Hit Identity | Organism | Genbank Protein | SEQ ID NO: |
|---|---|---|---|---|---|
| 320 | 2.00E−60 | orf3; similar to endonuclease subunit of the phage P2 terminase (gene M) | *Haemophilus somnus* | AAC45159.1 | compliment of nt. 606-1241 of SEQ ID NO: 320 |
| 320 | 2.00E−09 | orf4; similar to head completion/stabilization protein (gene L) of phage P2 | *Haemophilus somnus* | AAC45160.1 | compliment of nt. 52-285 of SEQ ID NO: 320 |
| 320 | 3.00E−35 | orf2; similar to major capsid protein precursor of phage P2 (gene N) | *Haemophilus somnus* | AAC45158.1 | compliment of nt. 1271-1624 of SEQ ID NO: 320 |
| 323 | 4.00E−37 | dedC protein | *Escherichia coli* | AAA23966.1 | compliment of nt. 74-463 of SEQ ID NO: 323 |
| 324 | 1.00E−153 | conserved hypothetical protein | *Neisseria meningitidis* MC58 | NP_274972.1 | compliment of nt. 930-1943 of SEQ ID NO: 324 |
| 326 | 5.00E−52 | selenophosphate synthetase | *Eubacterium acidaminophilum* | CAB53511.1 | compliment of nt. 1186-2292 of SEQ ID NO: 326 |
| 328 | 1.00E−129 | secretion protein SecD | *Pseudomonas aeruginosa* | NP_252510.1 | compliment of nt. 8-625 of SEQ ID NO: 328 |
| 333 | 3.00E−08 | unknown | *Pasteurella multocida* | NP_245489.1 | compliment of nt. 5-418 of SEQ ID NO: 333 |
| 336 | 6.00E−38 | probable methyl transferase | *Pseudomonas aeruginosa* | NP_253353.1 | compliment of nt. 2547-2819 of SEQ ID NO: 336 |
| 338 | 2.00E−98 | Pmi | *Pasteurella multocida* | NP_245766.1 | nt. 144-842 of SEQ ID NO: 338 |
| 339 | 2.00E−07 | tRNA nucleotidyltransferase | *Escherichia coli* | QQECPE | nt. 2331-2540 of SEQ ID NO: 339 |
| 340 | 0 | DNA gyrase, subunit A, type II topoisomerase | *Salmonella typhimurium* LT2 | NP_461214.1 | compliment of nt. 93-1799 of SEQ ID NO: 340 |
| 342 | 4.00E−12 | tolA protein | *Haemophilus influenzae* | JC5212 | nt. 980-1318 of SEQ ID NO: 342 |
| 344 | 1.00E−07 | MODIFICATION METHYLASE HPHIA | *Haemophilus parahaemolyticus* | P50192 | compliment of nt. 849-1034 of SEQ ID NO: 344 |
| 344 | 8.00E−05 | ABC transporter protein 1 | *Leishmania major* | AAF31030.1 | compliment of nt. 17-205 of SEQ ID NO: 344 |
| 349 | 3.00E−44 | conserved hypothetical protein | *Neisseria meningitidis* MC58 | NP_273467.1 | compliment of nt. 1397-1903 of SEQ ID NO: 349 |
| 349 | 8.00E−09 | hypothetical protein | *Pseudomonas aeruginosa* | NP_252667.1 | compliment of nt. 795-1121 of SEQ ID NO: 349 |
| 349 | 9.00E−10 | conserved hypothetical secreted protein | *Helicobacter pylori* 26695 | NP_207009.1 | compliment of nt. 1319-1816 of SEQ ID NO: 349 |
| 349 | 2.00E−06 | putative TPR repeat protein | *Salmonella typhimurium* LT2 | NP_463149.1 | compliment of nt. 2244-2558 of SEQ ID NO: 349 |
| 35 | 1.00E−23 | type I restriction-modification system specificity determinant | *Xylella fastidiosa* 9a5c | NP_300003.1 | compliment of nt. 29-388 of SEQ ID NO: 35 |
| 352 | 1.00E−116 | putative peptidase | *Escherichia coli* K12 | NP_416827.1 | compliment of nt. 951-1640 of SEQ ID NO: 352 |
| 352 | 0 | unknown | *Pasteurella multocida* | NP_245275.1 | compliment of nt. 86-946 of SEQ ID NO: 352 |
| 354 | 5.00E−86 | putative uronate isomerase | *Salmonella typhimurium* LT2 | NP_462052.1 | compliment of nt. 168-914 of SEQ ID NO: 354 |
| 356 | 1.00E−07 | isomerase-like protein (DsbD) - | *Escherichia coli* | S57220 | nt. 5-73 of SEQ ID NO: 356 |

TABLE 3A-continued

| Contig | E score | Hit Identity | Organism | Genbank Protein | SEQ ID NO: |
|---|---|---|---|---|---|
| 358 | 1.00E−07 | USG protein | *Pediococcus pentosaceus* | CAC16793.1 | nt.534-1307 of SEQ ID NO: 358 |
| 358 | 0.005 | HsdS protein | *Escherichia coli* | CAA10700.1 | nt. 26-205 of SEQ ID NO: 358 |
| 361 | 1.00E−152 | maltodextrin phosphorylase | *Escherichia coli* O157:H7 EDL933 | NP_289957.1 | compliment of nt. 77-922 of SEQ ID NO: 361 |
| 363 | 6.00E−06 | BH2505~unknown conserved protein | *Bacillus halodurans* | NP_243371.1 | nt. 554-844 of SEQ ID NO: 363 |
| 368 | 1.00E−12 | H02F09.3.p | *Caenorhabditis elegans* | NP_508295.1 | compliment of nt. 1069-1977 of SEQ ID NO: 368 |
| 368 | 6.00E−27 | hypothetical glycine-rich protein | *Mesorhizobium loti* | NP_102360.1 | compliment of nt. 1201-1986 of SEQ ID NO: 368 |
| 37 | 6.00E−09 | putative ATP-binding component of a transport system | *Escherichia coli* K12 | NP_415469.1 | compliment of nt. 455-691 of SEQ ID NO: 37 |
| 372 | 7.00E−18 | conserved hypothetical protein | *Clostridium perfringens* | BAB80319.1 | compliment of nt. 1763-1924 of SEQ ID NO: 372 |
| 376 | 7.00E−24 | putative bacteriophage protein | *Salmonella enterica* subsp. *enterica serovar Typhi* | NP_456379.1 | compliment of nt. 158-808 of SEQ ID NO: 376 |
| 376 | 8.00E−10 | hypothetical protein | *Xylella fastidiosa* 9a5c | NP_298882.1 | compliment of nt. 1129-1671 of SEQ ID NO: 376 |
| 376 | 9.00E−06 | lin1713 | *Listeria innocua* | NP_471049.1 | compliment of nt. 913-1557 of SEQ ID NO: 376 |
| 377 | 6.00E−05 | Vng1732c | *Halobacterium* sp. NRC-1 | NP_280487.1 | nt. 2378-2587 of SEQ ID NO: 377 |
| 377 | 1.00E−11 | INVASIN PRECURSOR (OUTER MEMBRANE ADHESIN) | *Yersinia enterocolitica* | P31489 | compliment of nt. 127-345 of SEQ ID NO: 377 |
| 382 | 4.00E−16 | unknown | *Pasteurella multocida* | NP_246871.1 | compliment of nt. 967-1068 of SEQ ID NO: 382 |
| 383 | 4.00E−36 | putative transposase | *Streptomyces avermitilis* | BAB69302.1 | nt. 488-1162 of SEQ ID NO: 383 |
| 383 | 3.00E−58 | recombinase | IncN plasmid R46 | NP_511241.1 | compliment of nt. 1-393 of SEQ ID NO: 383 |
| 383 | 4.00E−24 | transposase | *Escherichia coli* | I69674 | nt. 1294-1740 of SEQ ID NO: 383 |
| 383 | 0 | tnpA | *Yersinia enterocolitica* | CAA73750.1 | nt. 1782-2834 of SEQ ID NO: 383 |
| 385 | 2.00E−31 | unknown | *Pasteurella multocida* | NP_246065.1 | nt. 1515-1772 of SEQ ID NO: 385 |
| 386 | 5.00E−65 | cydC [ | *Escherichia coli* | AAA66172.1 | compliment of nt. 3438-4115 of SEQ ID NO: 386 |
| 386 | 4.00E−33 | ABC transporter, ATP-binding protein | *Mesorhizobium loti* | NP_105463.1 | compliment of nt. 2569-3390 of SEQ ID NO: 386 |
| 388 | 3.00E−45 | 60 KDA INNER-MEMBRANE PROTEIN HOMOLOG | *Coxiella burnetii* | P45650 | compliment of nt. 3211-3759 of SEQ ID NO: 388 |
| 390 | 4.00E−25 | putative DNA-binding protein | *Salmonella enterica* subsp. *enterica serovar Typhi* | NP_458175.1 | nt. 1051-1416 of SEQ ID NO: 390 |
| 390 | 3.00E−13 | transcriptional regulator | *Bacillus halodurans* | NP_241773.1 | compliment of nt. 84-578 of SEQ ID NO: 390 |
| 390 | 3.00E−06 | DNA translocase stage III sporulation prot homolog | *Staphylococcus aureus* subsp. *aureus* Mu50 | NP_372265.1 | compliment of nt. 620-871 of SEQ ID NO: 390 |

TABLE 3A-continued

| Contig | E score | Hit Identity | Organism | Genbank Protein | SEQ ID NO: |
|---|---|---|---|---|---|
| 395 | 7.00E−31 | ATPase, Cu++ transporting, beta polypeptide | *Homo sapiens* | NP_000044.1 | compliment of nt. 615-1406 of SEQ ID NO: 395 |
| 397 | 3.00E−23 | terminase large subunit | Bacteriophage HK620 | NP_112076.1 | compliment of nt. 2363-2725 of SEQ ID NO: 397 |
| 397 | 3.00E−16 | hypothetical protein | *Xylella fastidiosa* 9a5c | NP_297824.1 | compliment of nt. 1517-1744 of SEQ ID NO: 397 |
| 398 | 4.00E−67 | orf32 | *Haemophilus* phage HP2 | NP_536839.1 | compliment of nt. 1288-1866 of SEQ ID NO: 398 |
| 398 | 8.00E−24 | putative cytoplasmic protein | *Salmonella typhimurium* LT2 | NP_463063.1 | compliment of nt. 798-1220 of SEQ ID NO: 398 |
| 398 | 2.00E−83 | orf31 | *Haemophilus* phage HP1 | NP_043502.1 | compliment of nt. 1881-2510 of SEQ ID NO: 398 |
| 399 | 1.00E−94 | HEME/HEMOPEXIN-BINDING PROTEIN | *Haemophilus influenzae* N182 | P45355 | nt. 88-774 of SEQ ID NO: 399 |
| 401 | 3.00E−63 | Sty SBLI | *Salmonella enterica* | CAA68058.1 | nt. 1690-2742 of SEQ ID NO: 401 |
| 401 | 3.00E−06 | RESTRICTION-MODIFICATION ENZYME SUBUNIT M3 | *Mycoplasma pulmonis* | NP_325912.1 | nt. 79-489 of SEQ ID NO: 401 |
| 402 | 2.00E−13 | OPACITY PROTEIN OPA66 PRECURSOR | *Neisseria gonorrhoeae* | Q05033 | compliment of nt. 2634-2915 of SEQ ID NO: 402 |
| 406 | 8.00E−13 | type I restriction enzyme EcoR124IIR | *Neisseria meningitidis* MC58 | NP_273876.1 | nt. 281-520 of SEQ ID NO: 406 |
| 407 | 6.00E−65 | unknown | *Pasteurella multocida* | NP_246237.1 | nt. 938-2450 of SEQ ID NO: 407 |
| 407 | 5.00E−99 | PepE | *Pasteurella multocida* | NP_245391.1 | nt. 1216-1917 of SEQ ID NO: 407 |
| 407 | 1.00E−16 | Hemoglobin-haptoglobin binding protein A | *Haemophilus influenzae* Tn106 | Q48153 | nt. 1-141 of SEQ ID NO: 407 |
| 409 | 1.00E−106 | hypothetical protein 1 | *Haemophilus influenzae* | S27577 | compliment of nt. 2524-3159 of SEQ ID NO: 409 |
| 411 | 4.00E−29 | heme-repressible hemoglobin-binding protein | *Haemophilus influenzae*, type b, strain HI689 | AAB46794.1 | nt. 391-615 of SEQ ID NO: 411 |
| 411 | 0 | Hemoglobin-haptoglobin binding protein A | *Haemophilus influenzae* Tn106 | Q48153 | nt. 651-3263 of SEQ ID NO: 411 |
| 412 | 2.00E−07 | REGULATORY PROTEIN CRO (ANTIREPRESSOR) | bacteriophage 434 | P03036 | compliment of nt. 59-259 of SEQ ID NO: 412 |
| 412 | 4.00E−06 | hypothetical protein | Bacteriophage P27 | CAC83535.1 | nt. 1436-1654 of SEQ ID NO: 412 |
| 413 | 8.00E−07 | hypothetical protein | *Deinococcus radiodurans* | NP_294301.1 | compliment of nt. 791-1012 of SEQ ID NO: 413 |
| 414 | 9.00E−65 | conserved hypothetical protein | *Vibrio cholerae* | NP_230092.1 | nt. 1696-2103 of SEQ ID NO: 414 |
| 414 | 3.00E−93 | unknown | *Pasteurella multocida* | NP_246834.1 | nt. 1777-2109 of SEQ ID NO: 414 |
| 416 | 2.00E−17 | unknown | *Pasteurella multocida* | NP_246629.1 | compliment of nt. 2565-2831 of SEQ ID NO: 416 |
| 416 | 4.00E−26 | hypothetical protein o154 | *Escherichia coli* | S30728 | compliment of nt. 1928-2254 of SEQ ID NO: 416 |
| 416 | 3.00E−37 | transport protein TatC | *Pseudomonas aeruginosa* | NP_253757.1 | compliment of nt. 1494-2018 of of SEQ ID NO: 416 |
| 417 | 1.00E−66 | weakly similar to methyltransferases | *Listeria innocua* | NP_471073.1 | compliment of nt. 999-1928 of SEQ ID NO: 417 |

TABLE 3A-continued

| Contig | E score | Hit Identity | Organism | Genbank Protein | SEQ ID NO: |
|---|---|---|---|---|---|
| 417 | 5.00E−05 | DNA-BINDING PROTEIN RDGA | *Pectobacterium carotovorum* | Q47587 | compliment of nt. 3526-4212 of SEQ ID NO: 417 |
| 417 | 2.00E−29 | putative phage-related protein | *Yersinia pestis* | NP_407132.1 | compliment of nt. 2546-2938 of SEQ ID NO: 417 |
| 417 | 3.00E−06 | Adenine-specific DNA methylase | *Thermoplasma acidophilum* | NP_393798.1 | compliment of nt. 826-1020 of SEQ ID NO: 417 |
| 43 | 9.00E−16 | PcnB | *Pasteurella multocida* | NP_245801.1 | nt. 511-870 of SEQ ID NO: 43 |
| 434 | 2.00E−97 | beta' subunit of RNA polymerase | *Nephroselmis olivacea* | NP_050840.1 | compliment of nt. 32-1534 of SEQ ID NO: 434 |
| 435 | 4.00E−52 | MODIFICATION METHYLASE BEPI | *Brevibacterium epidermidis* | P10283 | compliment of nt. 11-565 of SEQ ID NO: 435 |
| 435 | 4.00E−57 | pentafunctional arom polypeptide (contains: 3-dehydroquinate synthase, 3-dehydroquinate dehydratase (3-dehydroquinase), shikimate 5-dehydrogenase, shikimate kinase, and epsp synthase) | *Saccharomyces cerevisiae* | NP_010412.1 | compliment of nt. 757-2064 of SEQ ID NO: 435 |
| 437 | 5.00E−70 | dihydrofolate reductase | *Haemophilus influenzae* (clinical isolate R1042) | S52336 | nt. 2393-2767 of SEQ ID NO: 437 |
| 438 | 1.00E−106 | polyA polymerase | *Vibrio cholerae* | NP_230244.1 | nt. 3-1124 of SEQ ID NO: 438 |
| 439 | 6.00E−60 | Porphyrin biosynthetic protein | *Salmonella enterica* subsp. *enterica* serovar Typhi | NP_457816.1 | nt. 2343-2783 of SEQ ID NO: 439 |
| 441 | 5.00E−73 | RimM | *Pasteurella multocida* | NP_246234.1 | compliment of nt. 151-441 of SEQ ID NO: 441 |
| 442 | 9.00E−31 | LIPOPROTEIN NLPD | *Salmonella typhimurium* | P40827 | compliment of nt. 3362-3520 of SEQ ID NO: 442 |
| 444 | 6.00E−24 | glycine betaine transporter | *Staphylococcus aureus* subsp. *aureus* Mu50 | NP_371872.1 | compliment of nt. 2242-2514 of SEQ ID NO: 444 |
| 452 | 6.00E−28 | unknown | *Pasteurella multocida* | NP_245616.1 | compliment of nt. 533-883 of SEQ ID NO: 452 |
| 452 | 0 | Type I restriction enzyme Ecoprrl M protein | *Escherichia coli* | Q47163 | nt. 3291-4154 of SEQ ID NO: 452 |
| 452 | 2.00E−75 | type I restriction enzyme M protein | *Ureaplasma urealyticum* | NP_077929.1 | nt. 4156-4662 of SEQ ID NO: 452 |
| 455 | 9.00E−56 | PROBABLE BACTERIOPHAGE PROTEIN | *Ralstonia solanacearum* | NP_520059.1 | nt. 2028-2774 of SEQ ID NO: 455 |
| 455 | 2.00E−55 | orf2; similar to major capsid protein precursor of phage P2 (gene N), | *Haemophilus somnus* | AAC45158.1 | nt. 2864-3490 of SEQ ID NO: 455 |
| 455 | 1.00E−175 | gpP | Enterobacteria phage P2 | NP_046758.1 | compliment of nt. 127-1812 of SEQ ID NO: 455 |
| 456 | 1.00E−38 | hypothetical protein | *Pseudomonas putida* | NP_542872.1 | compliment of nt. 1010-1282 of SEQ ID NO: 456 |
| 456 | 1.00E−172 | hypothetical protein | *Pseudomonas putida* | NP_542873.1 | compliment of nt. 1443-2006 of SEQ ID NO: 546 |
| 457 | 1.00E−116 | hypothetical protein (galE 5' region) - Haemophilus influenzae | *Haemophilus influenzae* | S15287 | compliment of nt. 62-961 of SEQ ID NO: 457 |

TABLE 3A-continued

| Contig | E score | Hit Identity | Organism | Genbank Protein | SEQ ID NO: |
|---|---|---|---|---|---|
| 457 | 1.00E−134 | dTDPglucose 4,6-dehydratase | *Actinobacillus actinomycetemcomitans* | T00102 | nt. 2637-3656 of SEQ ID NO: 457 |
| 459 | 2.00E−10 | RNA polymerase gamma-subunit | *Synechocystis* sp. PCC 6803 | NP_441586.1 | nt. 25-117 of SEQ ID NO: 459 |
| 461 | 9.00E−51 | conserved hypothetical protein | *Staphylococcus aureus* subsp. *aureus* Mu50 | NP_370593.1 | nt. 4124-4624 of SEQ ID NO: 461 |
| 462 | 9.00E−06 | NADH dehydrogenase | *Burkholderia pseudomallei* | AAG01016.1 | nt. 703-828 of SEQ ID NO: 462 |
| 465 | 3.00E−41 | GTP-binding protein Era | *Synechocystis* sp. PCC 6803 | NP_441951.1 | compliment of nt. 2470-2787 of SEQ ID NO: 465 |
| 466 | 1.00E−15 | putative bacteriophage protein | *Salmonella enterica* subsp. *enterica* serovar *Typhi* | NP_455548.1 | nt. 837-1478 of SEQ ID NO: 466 |
| 466 | 1.00E−90 | orf31 | *Haemophilus* phage HP1 | NP_043502.1 | nt. 2396-3199 of SEQ ID NO: 466 |
| 469 | 0 | Hemoglobin and hemoglobin-haptoglobin binding protein C precursor | *Haemophilus influenzae* HI689 | Q9X442 | compliment of nt. 427-3459 of SEQ ID NO: 469 |
| 471 | 8.00E−05 | transposase, putative | *Neisseria meningitidis* MC58 | NP_274608.1 | nt. 2957-3217 of SEQ ID NO: 471 |
| 472 | 6.00E−08 | hypothetical protein | *Salmonella enterica* subsp. *enterica* serovar *Typhi* | NP_458660.1 | compliment of nt. 2881-3270 of SEQ ID NO: 472 |
| 472 | 5.00E−23 | antirestriction protein | *Mesorhizobium loti* | NP_106707.1 | nt. 4908-5324 of SEQ ID NO: 472 |
| 472 | 1.00E−75 | hypothetical protein | *Salmonella enterica* subsp. *enterica* serovar *Typhi* | NP_458661.1 | compliment of nt. 1931-2776 of SEQ ID NO: 472 |
| 472 | 9.00E−72 | hypothetical protein | *Salmonella enterica* subsp. *enterica* serovar *Typhi* | NP_458662.1 | compliment of nt. 544-1689 of SEQ ID NO: 472 |
| 475 | 3.00E−25 | unknown | *Pasteurella multocida* | NP_244952.1 | nt. 3207-3626 of SEQ ID NO: 475 |
| 476 | 8.00E−73 | putative DNA-binding protein | *Salmonella enterica* subsp. *enterica* serovar *Typhi* | NP_458175.1 | compliment of nt. 3339-4310 of SEQ ID NO: 476 |
| 476 | 6.00E−47 | anticodon nuclease | *Neisseria meningitidis* MC58 | NP_273873.1| | compliment of nt. 4397-4885 of SEQ ID NO: 476 |
| 478 | 3.00E−06 | methionin synthase-like enzyme | *Arabidopsis thaliana* | CAB38313.1 | compliment of nt. 3554-3679 of SEQ ID NO: 478 |
| 478 | 3.00E−05 | unknown | *Pasteurella multocida* | NP_245444.1 | compliment of nt. 164-250 of SEQ ID NO: 478 |
| 479 | 1.00E−18 | conserved hypothetical protein | *Xylella fastidiosa* 9a5c | NP_298841.1 | nt. 2302-2658 of SEQ ID NO: 479 |
| 48 | 3.00E−19 | Dca | *Neisseria gonorrhoeae* | AAF12796.1 | compliment of nt. 225-746 of SEQ ID NO: 48 |
| 482 | 1.00E−06 | hypothetical protein | *Neisseria meningitidis* MC58 | NP_275122.1 | nt. 2055-2189 of SEQ ID NO: 482 |
| 482 | 9.00E−28 | conserved hypothetical protein | *Neisseria meningitidis* MC58 | NP_274383.1 | nt. 1689-1898 of SEQ ID NO: 482 |
| 487 | 5.00E−75 | conserved hypothetical protein | *Neisseria meningitidis* Z2491 | NP_284304.1 | nt. 2541-2978 of SEQ ID NO: 487 |
| 488 | 2.00E−64 | unknown | *Pasteurella multocida* | NP_246617.1 | nt. 2983-3540 of SEQ ID NO: 488 |
| 488 | 8.00E−93 | 1-deoxy-D-xylulose 5-phosphate reductoisomerase | *Zymomonas mobilis* | AAD29659.1 | nt. 1344-1880 of SEQ ID NO: 488 |
| 491 | 5.00E−51 | rubredoxin oxidoreductase homolog | *Clostridium acetobutylicum* | AAB50346.1 | compliment of nt. 1690-2439 of SEQ ID NO: 491 |

TABLE 3A-continued

| Contig | E score | Hit Identity | Organism | Genbank Protein | SEQ ID NO: |
|---|---|---|---|---|---|
| 492 | 1.00E−27 | phosphotransferase system enzyme IIA-like protein | *Staphylococcus aureus* | AAK83253.1 | compliment of nt. 755-970 of SEQ ID NO: 492 |
| 493 | 2.00E−84 | unknown | *Actinobacillus actinomycetemcomitans* | AAC70895.1 | nt. 3333-3935 of SEQ ID NO: 493 |
| 493 | 4.00E−49 | unknown | *Helicobacter pylori* J99 | NP_223898.1 | nt. 3345-4010 of SEQ ID NO: 493 |
| 493 | 9.00E−31 | transcriptional factor MdcH | *Acinetobacter calcoaceticus* | AAF20290.1 | nt. 1885-2793 of SEQ ID NO: 493 |
| 493 | 6.00E−30 | HimA | *Pasteurella multocida* | NP_245565.1 | nt. 1129-1260 of SEQ ID NO: 493 |
| 494 | 4.00E−85 | putative prophage integrase | *Yersinia pestis* | NP_404712.1 | nt. 900-2099 of SEQ ID NO: 494 |
| 494 | 4.00E−63 | DNA methyltransferase | *Xylella fastidiosa* 9a5c | NP_299063.1 | compliment of nt. 5544-6170 of SEQ ID NO: 494 |
| 494 | 6.00E−19 | MODIFICATION METHYLASE SCRFIA | *Lactococcus lactis* subsp. *cremoris* | P34877 | compliment of nt. 5019-6113 of SEQ ID NO: 494 |
| 497 | 0 | transferrin-binding protein 1 | *Haemophilus influenzae* (strain PAK 12085) | S70906 | nt. 3251-4999 of SEQ ID NO: 497 |
| 50 | 5.00E−07 | AcpP | *Pasteurella multocida* | NP_246856.1 | nt. 2-136 of SEQ ID NO: 50 |
| 501 | 7.00E−50 | conserved hypothetical protein | *Vibrio cholerae* | NP_231403.1 | compliment of nt. 3649-4872 of SEQ ID NO: 501 |
| 501 | 0 | type I restriction enzyme HsdR, putative | *Vibrio cholerae* | NP_231400.1 | compliment of nt. 1551-3440 of SEQ ID NO: 501 |
| 501 | 4.00E−13 | ATP-dependent DNA helicase RecG-related protein | *Deinococcus radiodurans* | NP_295921.1 | compliment of nt. 5317-5844 of SEQ ID NO: 501 |
| 501 | 5.00E−11 | conserved hypothetical | *Ureaplasma urealyticum* | NP_077868.1 | compliment of nt. 5098-5769 of SEQ ID NO: 501 |
| 504 | 2.00E−44 | OUTER MEMBRANE PROTEIN P2 PRECURSOR (OMP P2) | *Haemophilus influenzae* AG30010 | Q48218 | compliment of nt. 4681-5019 of SEQ ID NO: 504 |
| 507 | 0 | SpoT | *Pasteurella multocida* | NP_245857.1 | compliment of nt. 3685-5316 of SEQ ID NO: 507 |
| 51 | 6.00E−87 | glucosamine--fructose-6-phosphate aminotransferase (isomerizing) | *Vibrio cholerae* | NP_230141.1 | nt. 30-470 of SEQ ID NO: 51 |
| 512 | 2.00E−28 | dipeptide transport system permease protein | *Yersinia pestis* | NP_407439.1 | compliment of nt. 1095-1580 of SEQ ID NO: 512 |
| 512 | 3.00E−82 | SapC | *Pasteurella multocida* | NP_245850.1 | compliment of nt. 730-1095 of SEQ ID NO: 512 |
| 514 | 9.00E−06 | putative integral membrane protein | *Campylobacter jejuni* | NP_281236.1 | compliment of nt. 577-684 of SEQ ID NO: 514 |
| 514 | 3.00E−11 | orf, hypothetical protein | *Escherichia coli* O157:H7 EDL933 | NP_286004.1 | compliment of nt. 449-568 of SEQ ID NO: 514 |
| 518 | 0 | putative inner membrane transacylase protein | *Neisseria meningitidis* Z2491 | NP_284893.1 | nt. 92-1927 of SEQ ID NO: 518 |
| 519 | 4.00E−30 | hypothetical protein | *Mesorhizobium loti* | NP_108196.1 | compliment of nt. 2221-3159 of SEQ ID NO: 519 |
| 519 | 2.00E−12 | conserved hypothetical protein | *Listeria innocua* | NP_471067.1 | compliment of nt. 3994-5241 of SEQ ID NO: 519 |
| 519 | 6.00E−20 | hypothetical protein | *Mesorhizobium loti* | NP_108198.1 | compliment of nt. 707-1552 of SEQ ID NO: 519 |

TABLE 3A-continued

| Contig | E score | Hit Identity | Organism | Genbank Protein | SEQ ID NO: |
|---|---|---|---|---|---|
| 519 | 4.00E−26 | putative bacteriophage protein | Salmonella enterica subsp. enterica serovar Typhi | NP_455526.1 | compliment of nt. 3982-5163 of SEQ ID NO: 519 |
| 52 | 3.00E−94 | OUTER MEMBRANE PROTEIN P2 PRECURSOR (OMP P2) | Haemophilus influenzae | Q48218 | nt. 45-788 of SEQ ID NO: 52 |
| 520 | 0 | excision nuclease subunit A | Escherichia coli K12 | NP_418482.1 | compliment of nt. 6309-7745 of SEQ ID NO: 520 |
| 521 | 5.00E−08 | zinc/manganese ABC transporter substrate binding protein | Rickettsia conorii | NP_359651.1 | nt. 2236-2652 of SEQ ID NO: 521 |
| 521 | 1.00E−140 | unknown | Pasteurella multocida | NP_245865.1| | nt. 338-1390 of SEQ ID NO: 521 |
| 521 | 1.00E−86 | ORF_f432 | Escherichia coli | AAB40463.1 | nt. 203-1390 of SEQ ID NO: 521 |
| 522 | 3.00E−22 | unknown | Pasteurella multocida | NP_246093.1 | nt. 670-885 of SEQ ID NO: 522 |
| 526 | 5.00E−33 | exodeoxyribonuclease V alpha chain | Yersinia pestis | NP_404635.1 | nt. 5582-6202 of SEQ ID NO: 526 |
| 526 | 1.00E−62 | exodeoxyribonuclease V, 67 kDa subunit | Vibrio cholerae | NP_231950.1 | nt. 5675-6193 of SEQ ID NO: 526 |
| 527 | 1.00E−147 | unknown | Pasteurella multocida | NP_245980.1 | nt. 4283-5203 of SEQ ID NO: 527 |
| 527 | 0 | Mfd | Pasteurella multocida | NP_245978.1 | nt. 7545-8759 of SEQ ID NO: 527 |
| 527 | 0 | transcription-repair coupling factor (TrcF) | Salmonella enterica subsp. enterica serovar Typhi | NP_455708.1 | nt. 7611-8762 of SEQ ID NO: 527 |
| 527 | 0 | PROBABLE TRANSCRIPTION-REPAIR COUPLING FACTOR PROTEIN | Ralstonia solanacearum | NP_519763.1 | nt. 7611-8870 of SEQ ID NO: 527 |
| 528 | 1.00E−48 | undecaprenyl pyrophosphate synthetase | Chlamydia muridarum | NP_297109.1 | nt. 2918-3712 of SEQ ID NO: 528 |
| 528 | 0 | leucyl-tRNA synthetase | Vibrio cholerae | NP_230603.1 | compliment of nt. 180-2822 of SEQ ID NO: 528 |
| 529 | 1.00E−104 | DNA PRIMASE | Legionella pneumophila | P71481 | compliment of nt. 3316-3960 of SEQ ID NO: 529 |
| 534 | 9.00E−29 | putative integrase | Salmonella typhimurium LT2 | NP_461690.1 | nt. 4668-5009 of SEQ ID NO: 534 |
| 534 | 6.00E−18 | hypothetical protein NMA0153 | Neisseria meningitidis Z2491 | NP_283002.1 | compliment of nt. 5933-6337 of SEQ ID NO: 534 |
| 534 | 2.00E−23 | hypothetical protein | Deinococcus radiodurans | NP_294868.1 | nt. 6908-7654 of SEQ ID NO: 534 |
| 534 | 1.00E−88 | prophage CP4-57 integrase | Escherichia coli K12 | NP_417111.1 | nt. 5057-5875 of SEQ ID NO: 534 |
| 535 | 1.00E−115 | phosphate acetyltransferase | Buchnera sp. APS | NP_240007.1 | nt. 3385-4596 of SEQ ID NO: 535 |
| 536 | 3.00E−35 | cobalt membrane transport protein CbiQ | Actinobacillus pleuropneumoniae | AAD49727.1 | compliment of nt. 3531-4136 of SEQ ID NO: 536 |
| 536 | 6.00E−37 | unknown | Pasteurella multocida | NP_245305.1 | compliment of nt. 6478-6921 of SEQ ID NO: 536 |
| 539 | 2.00E−26 | Orf122 | Chlorobium tepidum | AAG12204.1 | compliment of nt. 1778-2008 of SEQ ID NO: 539 |
| 540 | 1.00E−77 | heat shock protein HtpX | Neisseria meningitidis MC58 | NP_273864.1 | compliment of nt. 2567-3481 of SEQ ID NO: 540 |
| 541 | 0 | IleS | Pasteurella multocida | NP_246601.1 | nt. 3167-4549 of SEQ ID NO: 541 |

TABLE 3A-continued

| Contig | E score | Hit Identity | Organism | Genbank Protein | SEQ ID NO: |
|---|---|---|---|---|---|
| 545 | 2.00E−09 | DNA-BINDING PROTEIN RDGB | *Pectobacterium carotovorum* | Q47588 | nt. 3816-3977 of SEQ ID NO: 545 |
| 545 | 2.00E−11 | putative transposase | *Sinorhizobium meliloti* | NP_437741.1 | compliment of nt. 2786-3019 of SEQ ID NO: 544 |
| 545 | 2.00E−07 | Hypothetical 42.5 kd protein in thrW-argF intergenic region | *Escherichia coli* | BAA77933.1 | compliment of nt. 2614-2811 of SEQ ID NO: 545 |
| 545 | 4.00E−18 | putative IS element transposase | *Salmonella enterica* subsp. *enterica* serovar *Typhi* | NP_454711.1 | nt. 1955-2230 of SEQ ID NO: 545 |
| 546 | 0 | HEME/HEMOPEXIN-BINDING PROTEIN | *Haemophilus influenzae* | P45354 | nt. 5551-7809 of SEQ ID NO: 546 |
| 546 | 0 | HEME/HEMOPEXIN UTILIZATION PROTEIN B | *Haemophilus influenzae* | P45356 | nt. 3842-5536 of SEQ ID NO: 546 |
| 546 | 0 | HEME/HEMOPEXIN UTILIZATION PROTEIN C | *Haemophilus influenzae* | P45357 | nt. 1638-3176 of SEQ ID NO: 546 |
| 546 | 2.00E−12 | HasR | *Pasteurella multocida* | NP_246561.1 | nt. 3149-3763 of SEQ ID NO: 546 |
| 549 | 0 | unknown | *Pasteurella multocida* | NP_246821.1 | nt. 2526-3512 of SEQ ID NO: 549 |
| 549 | 1.00E−121 | putative membrane protein | *Yersinia pestis* | NP_404859.1 | nt. 605-1108 of SEQ ID NO: 549 |
| 549 | 0 | unknown | *Pasteurella multocida* | NP_246822.1 | nt. 1122-1664 of SEQ ID NO: 549 |
| 551 | 1.00E−157 | type I restriction-modification system endonuclease | *Xylella fastidiosa* 9a5c | NP_300016.1 | compliment of nt. 7396-8322 of SEQ ID NO: 551 |
| 552 | 1.00E−100 | valyl-tRNA synthetase | *Deinococcus radiodurans* | NP_293872.1 | compliment of nt. 6691-8688 of SEQ ID NO: 552 |
| 552 | 0 | VALYL-TRNA SYNTHETASE | *Haemophilus parainfluenzae* | P36432 | compliment of nt. 5850-6647 of SEQ ID NO: 552 |
| 553 | 0 | DNA-directed RNA polymerase, beta subunit | *Vibrio cholerae* | NP_229982.1 | nt. 2668-6699 of SEQ ID NO: 553 |
| 554 | 0 | iron utilization protein B | *Haemophilus influenzae* | T10887 | nt. 991-2508 of SEQ ID NO: 554 |
| 559 | 1.00E−100 | PREPROTEIN TRANSLOCASE SECA SUBUNIT | *Bacillus firmus* | P96313 | nt. 3420-4472 of SEQ ID NO: 559 |
| 56 | 2.00E−23 | RpL30 | *Pasteurella multocida* | NP_246336.1 | compliment of nt. 656-832 of SEQ ID NO: 56 |
| 56 | 9.00E−13 | RpS5 | *Pasteurella multocida* | NP_246337.1 | compliment of nt. 843-1064 of SEQ ID NO: 56 |
| 560 | 1.00E−157 | Na+/H+ antiporter | *Vibrio cholerae* | NP_231535.1 | 2 compliment of nt. 279-2989 of SEQ ID NO: 560 |
| 562 | 1.00E−72 | putative biotin sulfoxide reductase 2 | *Yersinia pestis* | NP_404419.1 | nt. 7862-8878 of SEQ ID NO: 562 |
| 562 | 1.00E−125 | restriction modification system-R protein | *Neisseria meningitidis* | CAA09003.1 | nt. 2-985 of SEQ ID NO: 562 |
| 563 | 0 | IMMUNOGLOBULIN A1 PROTEASE | *Haemophilus influenzae* HK715 | P45384 | compliment of nt. 4127-9508 of SEQ ID NO: 563 |
| 563 | 0 | 3-ISOPROPYLMALATE DEHYDRATASE (IPMI) | *Schizosaccharomyces pombe* | O14289 | nt. 1980-3983 of SEQ ID NO: 563 |
| 564 | 2.00E−79 | orf32 | *Haemophilus* phage HP2 | NP_536839.1 | nt. 6241-6831 of SEQ ID NO: 564 |
| 564 | 7.00E−33 | probable variable tail fibre protein | *Salmonella enterica* subsp. *enterica* serovar *Typhi* | NP_457882.1 | nt. 3707-4177 of SEQ ID NO: 564 |

TABLE 3A-continued

| Contig | E score | Hit Identity | Organism | Genbank Protein | SEQ ID NO: |
|---|---|---|---|---|---|
| 564 | 2.00E−14 | M protein | Enterobacteria phage 186 | NP_052264.1 | nt. 1905-2213 of SEQ ID NO: 564 |
| 564 | 4.00E−44 | similar to tail fiber protein (gpH) in phage P2 | Salmonella typhimurium LT2, Fels-2 prophage | NP_461635.1 | nt. 3171-3692 of SEQ ID NO: 564 |
| 564 | 2.00E−85 | gpJ | Enterobacteria phage P2 | NP_046773.1 | nt. 2267-3166 of SEQ ID NO: 564 |
| 564 | 1.00E−24 | hypothetical protein | Neisseria meningitidis Z2491 | NP_284534.1 | nt. 6852-7334 of SEQ ID NO: 564 |
| 564 | 4.00E−26 | gpV | Enterobacteria phage P2 | NP_046771.1 | nt. 1337-1912 of SEQ ID NO: 564 |
| 564 | 2.00E−47 | similar to [SwissProt P44255 | Escherichia coli | BAA16182.1 | nt. 11383-11961 of SEQ ID NO: 564 |
| 564 | 2.00E−51 | hypothetical protein NMA1315 | Neisseria meningitidis Z2491 | NP_284066.1 | nt. 10452-11180 of SEQ ID NO: 564 |
| 564 | 0 | orf31 | Haemophilus phage HP1 | NP_043502.1 | nt. 4160-6226 of SEQ ID NO: 564 |
| 564 | 2.00E−09 | rep | Haemophilus phage HP2 | NP_536816.1 | compliment of nt. 9986-10234 of SEQ ID NO: 564 |
| 565 | 2.00E−57 | resolvase/integrase-like protein | Haemophilus influenzae biotype aegyptius | AAL47097.1 | nt. 11885-12445 of SEQ ID NO: 565 |
| 565 | 1.00E−93 | integrase | Actinobacillus actinomycetemcomitans | AAC70901.1 | compliment of nt. 4118-4900 of SEQ ID NO: 565 |
| 565 | 6.00E−35 | probable phage integrase | Salmonella enterica subsp. enterica serovar Typhi | NP_458745.1 | compliment of nt. 4148-4990 of SEQ ID NO: 565 |
| 565 | 1.00E−107 | hypothetical protein | Xylella fastidiosa 9a5c | NP_299042.1 | compliment of nt. 5066-6817 of SEQ ID NO: 565 |
| 566 | 1.00E−126 | hypothetical protein (galE 5' region) - | Haemophilus influenzae | S15287 | compliment of nt. 10726-11607 of SEQ ID NO: 566 |
| 567 | 0 | unknown | Pasteurella multocida | NP_246387.1 | nt.5343-7688 of SEQ ID NO: 567 |
| 568 | 1.00E−151 | multidrug resistance membrane translocase | Escherichia coli O157:H7 | NP_311575.1 | nt. 6-1403 of SEQ ID NO: 568 |
| 568 | 1.00E−141 | YhbX/YhjW/YijP/YjdB family protein | Neisseria meningitidis MC58 | |NP_275002.1 | compliment of nt. 11213-12634 of SEQ ID NO: 568 |
| 570 | 1.00E−180 | hypothetical protein 3 (ksgA-lic2B intergenic region) | Haemophilus influenzae (strain RM7004) | S71024 | compliment of nt. 12845-13720 of SEQ ID NO: 570 |
| 571 | 0 | glycerophosphodiester phosphodiesterase | Haemophilus influenzae (isolate 772) | A43576 | nt. 1656-2693 of SEQ ID NO: 571 |
| 571 | 1.00E−137 | outer membrane protein P4 precursor - Haemophilus influenzae | Haemophilus influenzae | A43604 | nt. 6145-6909 of SEQ ID NO: 571 |
| 571 | 2.00E−72 | CG8298 gene product [alt 1] | Drosophila melanogaster | AAF58597.1 | nt. 3813-5339 of SEQ ID NO: 571 |
| 572 | 1.00E−40 | hypothetical protein TC0130 | Chlamydia muridarum (strain Nigg) | G81737 | nt. 3734-4099 of SEQ ID NO: 572 |
| 572 | 5.00E−10 | hypothetical protein | Pyrococcus horikoshii | NP_142215.1 | nt. 4472-4888 of SEQ ID NO: 572 |
| 572 | 3.00E−11 | 109aa long hypothetical protein | Sulfolobus tokodaii | NP_377117.1 | nt. 7303-7470 of SEQ ID NO: 572 |
| 572 | 8.00E−43 | hypothetical protein | Chlamydophila pneumoniae AR39 | NP_445524.1 | nt. 4289-4618 of SEQ ID NO: 572 |

TABLE 3A-continued

| Contig | E score | Hit Identity | Organism | Genbank Protein | SEQ ID NO: |
|---|---|---|---|---|---|
| 572 | 9.00E−08 | CDH1-D | *Gallus gallus* | AAL31950.1 | nt. 7183-7521 of SEQ ID NO: 572 |
| 575 | 1.00E−173 | topoisomerase B | *Salmonella enterica* subsp. *enterica serovar Typhi* | NP_458624.1 | nt. 18980-20923 of SEQ ID NO: 575 |
| 575 | 1.00E−100 | DNA helicase | *Salmonella enterica* subsp. *enterica serovar Typhi* | NP_458617.1 | nt. 10399-11706 of SEQ ID NO: 575 |
| 65 | 2.00E−53 | SufI | *Pasteurella multocida* | NP_245041.1 | nt. 3-821 of SEQ ID NO: 65 |
| 67 | 4.00E−39 | putative MFS family tranport protein (1st mdule) | *Salmonella typhimurium* LT2 | NP_462786.1 | compliment of nt. 125-1033 of SEQ ID NO: 67 |
| 7 | 4.00E−29 | putative membrane protein | *Salmonella enterica* subsp. *enterica serovar Typhi* | NP_458664.1 | compliment of nt. 2-559 of SEQ ID NO: 7 |
| 72 | 2.00E−51 | serine transporter | *Vibrio cholerae* | NP_230946.1 | nt. 18-803 of SEQ ID NO: 72 |
| 74 | 3.00E−90 | hypothetical 21.8K protein (in locus involved in transformation) - | *Haemophilus influenzae* | JH0436 | compliment of nt. 248-766 of SEQ ID NO: 74 |
| 77 | 2.00E−18 | RecX protein | *Legionella pneumophila* | CAC33485.1 | nt. 480-920 of SEQ ID NO: 77 |
| 82 | 4.00E−95 | unknown | *Pasteurella multocida* | NP_246414.1 | nt. 128-955 of SEQ ID NO: 82 |
| 83 | 2.00E−66 | unknown | *Pasteurella multocida* | NP_246777.1 | nt. 5-556 of SEQ ID NO: 83 |
| 83 | 6.00E−33 | CTP SYNTHASE | *Helicobacter pylori* J99 | NP_223042.1 | compliment of nt. 1027-1338 of SEQ ID NO: 83. |
| 83 | 4.00E−34 | CTP synthase | *Campylobacter jejuni* | NP_281249.1 | compliment of nt. 1024-1275 of SEQ ID NO: 83 |
| 84 | 1.00E−16 | REPRESSOR PROTEIN CI | Bacteriophage phi-80 | P14819 | nt. 823-1233 of SEQ ID NO: 84 |
| 84 | 2.00E−05 | orf, hypothetical protein | *Escherichia coli* K12 | NP_415875.1 | compliment of nt. 533-700 of SEQ ID NO: 84 |
| 84 | 4.00E−11 | orf33 | bacteriophage phi CTX | NP_490633.1 | compliment of nt. 32-466 of SEQ ID NO: 84 |
| 85 | 3.00E−42 | SpoT | *Pasteurella multocida* | NP_245857.1 | nt. 899-1261 of SEQ ID NO: 85 |
| 90 | 1.00E−103 | putative methylase | Bacteriophage Tuc2009 | NP_108695.1 | compliment of nt. 478-1206 of SEQ ID NO: 90 |
| 90 | 4.00E−11 | probable adenine specific DNA methyltransferase | *Thermoplasma acidophilum* | NP_394624.1 | compliment of nt. 397-1140 of SEQ ID NO: 90 |

TABLE 3B

| Hit Identity | Full Length Nucleotide Sequence | Amino Acid Sequence | Location in Contig | Homology to Genbank Protein |
|---|---|---|---|---|
| CpdB | SEQ ID NO: 686 | SEQ ID NO: 687 | nt. 38041-36068 of SEQ ID NO: 681 (contig 14) | NP_246953.1 |
| putative membrane protein | SEQ ID NO: 688 | SEQ ID NO: 689 | nt. 906601-908094 of SEQ ID NO: 685 (contig 18) | NP_458664.1 |
| GTP-binding protein TypA/BipA | SEQ ID NO: 690 | SEQ ID NO: 691 | nt. 42557-40995 of SEQ ID NO: 683 (contig 16) | NP_240245.1 |
| outer membrane protein A | SEQ ID NO: 692 | SEQ ID NO: 693 | nt. 7000420-704187 of SEQ ID NO: 685 (contig 18) | T30852 |

TABLE 3B-continued

| Hit Identity | Full Length Nucleotide Sequence | Amino Acid Sequence | Location in Contig | Homology to Genbank Protein |
|---|---|---|---|---|
| vacB protein | SEQ ID NO: 694 | SEQ ID NO: 695 | nt. 39184-36836 of SEQ ID NO: 683 (contig 16) | NP_240369.1 |
| putative ABC transport system permease protein [ | SEQ ID NO: 696 | SEQ ID NO: 697 | nt. 59155-58370 of SEQ ID NO: 685 (contig 18) | NP_282774.1 |
| putative exported protein | SEQ ID NO: 698 | SEQ ID NO: 699 | nt. 901142-902542 of SEQ ID NO: 685 (contig 18) | NP_458655.1 |
| ImpA | SEQ ID NO: 700 | SEQ ID NO: 701 | nt. 348187-347747 of SEQ ID NO: 685 (contig 18) | NP_245829.1 |
| TsaA | SEQ ID NO: 702 | SEQ ID NO: 703 | nt. 74941-75548 of SEQ ID NO: 684 (contig 17) | NP_245732.1 |
| PROBABLE TRANSPORT TRANSMEMBRANE PROTEIN | SEQ ID NO: 704 | SEQ ID NO: 705 | nt. 74436-75176 of SEQ ID NO: 685 (contig 18) | NP_522358.1 |
|  | SEQ ID NO: 706 | SEQ ID NO: 707 | nt. 75160-75660 of SEQ ID NO: 685 (contig 18) |  |
| possible exported protein | SEQ ID NO: 708 | SEQ ID NO: 709 | nt. 899618-900262 of SEQ ID NO: 685 (contig 18) | NP_458653.1 |
| LICA PROTEIN | SEQ ID NO: 710 | SEQ ID NO: 711 | nt. 356917-355958 of SEQ ID NO: 685 (contig 18) | P14181 |
| HEME-BINDING PROTEIN A | SEQ ID NO: 712 | SEQ ID NO: 713 | NT. 26114-27739 of SEQ ID NO: 683 (contig 16) | P33950 |
| similar to BASEMENT MEMBRANE-SPECIFIC HEPARAN SULFATE PROTEOGLYCAN CORE PROTEIN PRECURSOR (HSPG) | SEQ ID NO: 714 | SEQ ID NO: 715 | nt. 311610-312683 of SEQ ID NO: 685 (contig 18) | XP_068727.1 |
| CzcD | SEQ ID NO: 716 | SEQ ID NO: 717 | nt. 34865-35542 of SEQ ID NO: 681 (contig 14) | NP_246276.1 |
| conserved hypothetical protein | SEQ ID NO: 718 | SEQ ID NO: 719 | nt. 194993-193977 of SEQ ID NO: 685 (contig 18) | NP_274972.1 |
| secretion protein SecD | SEQ ID NO: 720 | SEQ ID NO: 721 | nt. 203707-201857 of SEQ ID NO: 683 (contig 17) | NP_252510.1 |
| ABC transporter protein 1 | SEQ ID NO: 722 | SEQ ID NO: 723 | nt. 3943-5859 of SEQ ID NO: 681 (contig 14) | AAF31030.1 |
| conserved hypothetical protein | SEQ ID NO: 724 | SEQ ID NO: 725 | nt. 331090-331749 of SEQ ID NO: 685 (contig 18) | NP_273467.1 |
|  | SEQ ID NO: 726 | SEQ ID NO: 727 | nt. 331938-332492 of SEQ ID NO: 685 (contig 18) |  |
|  | SEQ ID NO: 728 | SEQ ID NO: 729 | nt. 332681-33232 of SEQ ID NO: 685 (contig 18) |  |
| INVASIN PRECURSOR (OUTER MEMBRANE ADHESIN) | SEQ ID NO: 730 | SEQ ID NO: 731 | nt. 416757-417020 of SEQ ID NO: 685 (contig 18) | P31489 |
| HEME/HEMOPEXIN-BINDING PROTEIN | SEQ ID NO: 732 | SEQ ID NO: 733 | nt. 229430-232195 of SEQ ID NO: 384 (contig 17) | P45355 |
| OPACITY PROTEIN OPA66 PRECURSOR | SEQ ID NO: 734 | SEQ ID NO: 735 | nt. 375592-375879 of SEQ ID NO: 384 (contig 17) | Q05033 |
| Hemoglobin-haptoglobin binding protein A | SEQ ID NO: 736 | SEQ ID NO: 737 | nt. 45709-42566 of SEQ ID NO: 681 (contig 14) | Q48153 |

TABLE 3B-continued

| Hit Identity | Full Length Nucleotide Sequence | Amino Acid Sequence | Location in Contig | Homology to Genbank Protein |
|---|---|---|---|---|
| transport protein TatC | SEQ ID NO: 738 | SEQ ID NO: 739 | nt. 134452-135222 of SEQ ID NO: 384 (contig 17) | NP_253757.1 |
| LIPOPROTEIN NLPD | SEQ ID NO: 740 | SEQ ID NO: 741 | nt. 18895-20112 of SEQ ID NO: 682 (contig 15) | P40827 |
| Hemoglobin and hemoglobin-haptoglobin binding protein C precursor | SEQ ID NO: 742 | SEQ ID NO: 743 | nt. 34181-31041 of SEQ ID NO: 682 (contig 15) | Q9X442 |
| HimA | SEQ ID NO: 744 | SEQ ID NO: 745 | nt. 382795-383085 of SEQ ID NO: 685 (contig 18) | NP_245565.1 |
| transferrin-binding protein 1 | SEQ ID NO: 746 | SEQ ID NO: 747 | nt. 178537-175799 of SEQ ID NO: 683 (contig 16) | S70906 |
| SapC | SEQ ID NO: 748 | SEQ ID NO: 749 | nt. 197754-196867 of SEQ ID NO: 685 (contig 18) | NP_245850.1 |
| heat shock protein HtpX | SEQ ID NO: 750 | SEQ ID NO: 751 | nt. 40414-41265 of SEQ ID NO: 682 (contig 15) | NP_273864.1 |
| HEME/HEMOPEXIN-BINDING PROTEIN | SEQ ID NO: 752 | SEQ ID NO: 753 | nt. 229430-232195 of SEQ ID NO: 684 (contig 17) | P45354 |
| HEME/HEMOPEXIN UTILIZATION PROTEIN B | SEQ ID NO: 754 | SEQ ID NO: 755 | nt. 227721-229418 of SEQ ID NO: 684 (contig 17) | P45356 |
| HEME/HEMOPEXIN UTILIZATION PROTEIN C | SEQ ID NO: 756 | SEQ ID NO: 757 | nt. 225516-227645 of SEQ ID NO: 684 (contig 17) | P45357 NP_246561.1 |
| iron utilization protein B | SEQ ID NO: 758 | SEQ ID NO: 759 | nt. 32076-33611 of SEQ ID NO: 684 (contig 17) | T10887 |
| PREPROTEIN TRANSLOCASE SECA SUBUNIT | SEQ ID NO: 760 | SEQ ID NO: 761 | nt. 82314-84785 of SEQ ID NO: 683 (contig 16) | P96313 |
| IMMUNOGLOBULIN A1 PROTEASE | SEQ ID NO: 762 | SEQ ID NO: 763 | nt. 171647-166263 of SEQ ID NO: 683 (contig 16) | P45384 |
| multidrug resistance membrane translocase | SEQ ID NO: 764 | SEQ ID NO: 765 | nt. 74524-72992 of SEQ ID NO: 683 (contig 16) | NP_311575.1 |
| YhbX/YhjW/YijP/YjdB family protein | SEQ ID NO: 766 | SEQ ID NO: 767 | nt. 61734-63200 of SEQ ID NO: 683 (contig 16) | NP_275002.1 |
| putative membrane protein | SEQ ID NO: 768 | SEQ ID NO: 769 | nt. 906601-908094 of SEQ ID NO: 685 (contig 18) | NP_458664.1 |
| putative membrane protein | SEQ ID NO: 770 | SEQ ID NO: 771 | nt. 16185-17942 of SEQ ID NO: 683 (contig) | NP_404859.1 |

EXAMPLE 3

Construction of the NTHi Promoter Trap Library

To identify potential virulence determinants of NTHi, bacterial gene expression was monitored by differential fluorescence induction (DFI) during early disease progression in one specific anatomical niche of a chinchilla model of NTHi-induced otitis media (OM). Genomic DNA fragments from NTHi strain 86-028NP were cloned upstream of the promoterless gfpmut3 gene using a promoter trap library. Plasmid pGZRS39A, a derivative of pGZRS-1 isolated from *Actinobacillus pleuropneumoniae*, is an *A. pleuropneumoniae-Escherichia coli* shuttle vector. This plasmid contains the origin of replication from *A. pleuropneumoniae*, the lacZα gene from pUC19 and the kanamycin resistance gene from Tn903. (West et al., *Genes,* 160: 81-86, 1995).

The promoter trap vector was constructed by cloning the GTP mutant gfpmut3 gene, as a BamHI to EcoRI fragment into pGZRS-39A to form pRSM2167. This mutant GTP gene contains two amino acid changes, S65G and S72A, that enhance fluorescence emission when excited at 488 nm. This mutant also has high solubility and fast kinetics of chromophore formation (Cormack et al., *Gene,* 173: 33-38, 1996). This plasmid was transformed by electroporation into NTHi strain 86-028NP, generating the parent-plasmid strain 86-028NP/pRSM2169.

Random genomic DNA fragments (described in Example 1) were prepared for ligation into the promoter probe vector. Genomic DNA was isolated from strain 86-028NP using the Puregene DNA isolation kit (Gentra Systems, Minneapolis, Minn.) according to the manufacturer's protocol. Due to restriction barriers, it was necessary to isolate the plasmid DNA and use this for the library generation. The isolated DNA was partially digested with Sau3AI (NEB, Beverly, Mass.; 0.25 units/μg DNA) for 1 hour at 37° C., separated by gel electrophoresis and DNA fragments 0.5-1.5 kb in size were recovered using the Qiagen gel extraction kit. For vector preparation, pRSM2167 was isolated from an overnight culture using the Wizard Plus Maxiprep DNA purification system (Promega, Madison Wis.) according to the manufacturer's protocol.

Plasmid DNA was linearized by BamHI digestion and 5' phosphate groups removed by treatment with calf intestinal alkaline phosphatase (CIAP; GibcoBRL Life Technologies). Genomic DNA fragments were ligated with the linearized, phosphatase-treated vector and electroporated into competent NTHi strain 86-028NP prepared for electroporation according to a modified protocol (Mitchell et al., *Nucleic Acids Res.*, 19: 3625-3628, 1991). When plasmid DNA was electroporated back into NTHi strain 86-028NP, transformation efficiency was improved by one-thousand fold. Briefly, cells were grown to an $OD_{600}$=0.3 in sBHI (brain heart infusion) broth at 37° C., 220 rpm. Cells were chilled on ice for 30 minutes and subsequently washed with an equal volume of 0.5×SG (1×SG: 15% glycerol, 272 mM sucrose) at 4° C. Washes were repeated a total of three times. Subsequently, the cells were diluted in 1×SG to a 100× concentrated volume. The cells were electroporated using the BioRad Gene Pulser II set at 200 ohms, 2.5 kV and 25 μF and then diluted in 1 ml prewarmed sBHI, incubated for 2 hours at 37° C., 5% $CO_2$ and plated on chocolate agar for overnight growth of transformants.

Transformants were selected and frozen in pools of 1000 clones in skim milk containing 20% glycerol (vol/vol). A 68,000 member gfp promoter probe library was generated. Using the probability calculation of Clarke and Carbon (*Cell*, 9: 91-99, 1976); to achieve a 99% probability of having a given DNA sequence represented in a library of 300 bp fragments of strain 86-028NP DNA ($1.8 \times 10^6$ bp/genome), a library of 27,629 clones was needed. Therefore the present library represents 2.5 fold coverage of the 86-028NP genome.

In order to assess the quality of the library, fifty clones were selected at random, grown overnight on chocolate agar and the plasmids were isolated and insert DNA sequenced. A majority (64%) of the selected clones had insert sizes ranging between 200 and 500 bp while 32% exceeded 500 bp. The majority of inserts showed homology to unique *H. influenzae* strain Rd open reading frames (ORFs), and 15 clones had sequence unique to strain 86-028NP DNA. Of those clones with homology to strain Rd, 60% were in the correct orientation, 36% of which contained sequence upstream an ORF. Although a majority of clones had an insert size less than 500 bp, no correlation was found between small insert size and increased GFP expression. In fact four clones exhibited slight to moderate fluorescence in vitro, 3 of which had insert sizes between 200-500 base pairs and one had an insert that was greater than 700 base pairs.

A fraction of the library (approximately 1000 clones) was grown on chocolate agar, harvested in PBS and analyzed by flow cytometry for GFP fluorescence. Compared to strain 86-028NP/pRSM2169 that contains the promoter trap vector without insert DNA, the pool of library clones displays an increased fluorescence intensity. Thus, the library contains clones with promoters at varying levels of activity.

EXAMPLE 4

Analysis of 86-028NP Derivatives Expressing GFP

In order to establish the FACS parameters necessary to identify and sort gfp-expressing bacteria, a panel of isolates demonstrating varying levels of gfp expression was utilized. Background fluorescence was assessed using strain 86-028NP/pRSM2169 (negative control), therefore any observed fluorescence would be due to the lacZ promoter driving gfp expression. However, this strain does not produce detectable levels of GFP and in fact, does not demonstrate increased fluorescence when compared to the parent strain 86-028NP. A high-level gfp-expressing isolate was generated by cloning a 500 bp fragment containing the strong promoter for outer membrane protein P2 expression into SalI-BamHI digested pRSM2167. This plasmid was transformed into 86-028NP by electroporation, generating the high-level gfp expressing strain 86-028NP/pRSM2211 (highly fluorescent control). This strain demonstrated an approximate 100 fold increase in GFP fluorescence compared to strain 86-028NP/pRSM2169. An intermediate fluorescent derivative clone, 86-028NP/pKMM4B5 (intermediate fluorescent control), was isolated by FACS analysis and used both in preliminary experiments and as a control for cell sorting. The DNA fragment containing a promoter driving gfp expression in vitro is unique to strain 86-028NP, having no known homology to DNA of other organisms. This clone exhibits an approximate 10 fold increase in fluorescence compared to strain 86-028NP/pRSM2169.

The control strains were resuspended from growth on chocolate agar and labeled with cross-reactive Phycoprobe R-PE anti-human IgG (H+L) antibody (10 μg/ml in 100 μl PBS; Biomeda Corp) for 30 minutes at 4° C. Following three successive washes to remove unbound antibody, bacteria were resuspended in 300 μl Dulbecco's Phosphate Buffered Saline (DPBS) for FACS analysis. These control preparations were used to set the appropriate size and fluorescence gates using a Coulter Epics Elite flow cytometer (Coulter Corp.) equipped with an argon laser emitting at 488 nm. Bacteria were gated for size based on log forward angle and side scatter detection and for sorting by FITC/PE labeling of bacteria. Sorted cells were collected into cold sBHI and plated on chocolate agar. After overnight growth, cells were collected for a secondary round of infection or were individually selected and grown overnight, screened by individual clone for fluorescence when grown in vitro, and frozen in skim milk containing 20% (vol/vol) glycerol prior to plasmid isolation and sequencing of insert DNA. Sorting efficiency of control strains was confirmed using a Coulter EPICS flow cytometer (Coulter Corp.).

Many plasmids were segregated rapidly in vitro in the absence of antibiotic selection. Thus, in order to assess whether the promoter trap vector used here was prone to this event, a single colony of strain 86-028NP/pRSM2211 (highly fluorescent control) was isolated on chocolate agar and passaged 20 times in the absence of antibiotic selection. No significant decrease in fluorescence intensity was observed when compared to bacteria grown in the presence of antibiotic. In addition, the plasmid is maintained in the absence of antibiotic selection in vivo. Similar bacterial counts were observed when bacteria-containing middle ear fluids collected from a chinchilla were plated on chocolate agar with or without kanamycin. These data demonstrate that the promoter trap vector was stably maintained in the absence of antibiotic selection.

In addition to problems with plasmid stability, early studies on the use of GFP as a reporter to study host-pathogen interactions demonstrated that GFP could be continuously synthesized as a cytoplasmic protein with low toxicity, having minimal effects on the bacterial cell-surface dynamics (Chalfie et al., *Science*, 263: 802-805, 1994). The construction of a high level gfp-expressing derivative allowed the assessment of the GFP toxicity on NTHi. Growth curves of both the wild-type strain (86-028NP) and the high GFP producing strain 86-028NP/pRSM2211 were compared when grown under similar conditions. The growth rates were similar, indicating that GFP expression was not toxic to the cells.

The 86-028NP gfp-expressing derivatives were used to define the parameters for efficient cell sorting. Strain 86-028NP/pRSM2169 was mixed with the intermediate gfp-expressing derivative, strain 86-028NP/pKMM4B5, at a 100:1 ratio, simulating the in vivo environment that is expected to contain a small percentage of gfp-expressing clones relative to the total bacterial population. This mixture was subjected to FACS analysis, collecting the 1.8% most fluorescent population and the 52% least fluorescent population. Flow cytometric analysis of the sorted populations revealed an enrichment of strain 86-028NP/pKMM4B5 to 65% of the bacterial population, a phenomenon that was not observed when sorting on the negative population. Subsequent rounds of sorting would be expected to further enrich for this intermediate fluorescent population. The inability to decrease the amount of fluorescent bacteria in the negative sort was attributed to the size of the gate set for negative sorting. GFP-negative cells were enriched by gating on the 10% least fluorescent population.

EXAMPLE 5

Direct Labeling of Bacteria from Middle Ear Fluids

A similar strategy (as described in Example 5) was applied to sort fluorescent clones from effusions obtained from the chinchilla middle ear during AOM. Our ability to use differential fluorescence induction (DFI) in vivo was dependent upon our ability to sort gfp-expressing bacteria from non-fluorescent bacteria, fluorescent and non-fluorescent cellular debris, and eukaryotic cells.

Healthy adult chinchillas (*Chinchilla lanigera*) with no evidence of middle ear infection by either otoscopy or tympanometry were used to screen the library for promoter activity in vivo. Two pools of the NTHi/pRSM2169 library (1000 clones each) were grown overnight on chocolate agar containing kanamycin. The library was combined and diluted in cold 10 mM sterile PBS to $3.3 \times 10^6$ CFU/ml and 300 µl (1.0× $10^6$ CFU; 500 CFU/clone) was used to inoculate the left and the right chinchilla transbullar cavity (2000 clones/ear). OM development was monitored by video otoscopy and tympanometry at 24 and 48 hours. The bacteria multiplied in the middle ear cavity, reaching a concentration 500 times the inoculum dose by 48 hours as expected (Bakaletz et al., *Infect. Immunity* 67: 2746-62, 1999). This bacterial adaptation to the host environment results in an inflammatory response, indicated by erythema, vessel dilation and bulging of the tympanic membrane, infiltration of polymorphonuclear cells (PMN's), and accumulation of fluid in the middle ear cavity as observed by otoscopy and microscopic examination of recovered effusions. Twenty-four and 48 hours later, middle ear fluids were retrieved by epitympanic tap, and prepared for FACS.

It is important to note that this analysis was limited to those bacteria recoverable in the middle ear fluid. In some cases it was necessary to lavage the middle ear cavity to collect the bacteria for FACS analysis. Thus, this analysis includes genes up-regulated when NTHi are loosely adherent to mucosae. NTHi has been observed to form a biofilm in the middle ear cavity in a chinchilla model of OM (Erhlich et al., *JAMA*, 287: 1710-5, 2002). Since the protocols described herein select for clones recovered from the planktonic population, it is not expected to recover those clones in which genes are up-regulated when the bacteria are associated with mucosal biofilms. Homogenization of middle ear mucosae and subsequent bacterial cell isolation however, would enable us to recover these clones. It is also possible that some GFP-expressing clones were recovered in the effusion, yet were adherent to eukaryotic cells present in the effusion as exfoliated cells, or in aggregates. These bacteria are difficult to recover from the effusion without compromising the sorting efficiency. Therefore the middle ear fluids were treated with a mucolytic agent, then centrifuged to remove large aggregates and eukaryotic cells and prior to labeling.

Chinchilla middle ear fluids were diluted, if necessary, to 250 µl with sterile saline. An equal volume of N-acetyl-L-cysteine (0.5%; w/v) in DPBS (pH 7.4) was added for 5 minutes at room temperature as a mucolytic agent (Miyamoto and Bakaletz, *Microb. Pathog.*, 21: 343-356 1996). Fluids were centrifuged (300×g, 5 min) to remove cellular debris, red blood cells and inflammatory cells, and supernatants containing bacteria were transferred to a fresh tube. Bacteria were incubated with chinchilla antiserum (1:50 dilution) directed against a whole OMP preparation, derived from NTHi strain 86-028NP, for 45 minutes at 4° C., pelleted by centrifugation (2000×g, 5 min) and washed twice with cold DPBS containing 0.05% bovine serum albumin. Bacteria were subsequently labeled with cross-reactive phycoprobe R-PE anti-human IgG (H+L) antibody (10 µg/ml in 100 µl PBS; Biomeda Corp) for 30 minutes at 4° C. Following three successive washes to remove unbound antibody, cells were resuspended in 300 µl DPBS for FACS analysis.

EXAMPLE 6

Identification of Promoters Induced In Vivo in Acute Otitis Media

*H. influenzae* 86-028NP transformed with the promoter trap library was grown overnight on chocolate agar. To select against those clones containing promoters that expressed gfp in vitro, the library was subjected to one round of FACS analysis (as described in Example 6), collecting only those clones expressing low-level amounts of GFP. These clones were pooled and used to inoculate the chinchilla middle ear transbullarly. Following 24 and 48 hours of infection, bacteria-containing effusions were removed by epitympanic tap. Bacteria were indirectly labeled with R-PE-labeled antibody and subjected to FACS analysis by gating on fluorescently tagged bacteria but sorting for those that were also expressing. These clones were used to reinfect animals for further enrichment. Following the final round of sorting, single colony isolates were screened in vitro for lack of fluorescence.

Those clones isolated by FACS analysis (positive for GFP fluorescence in vivo), which did not emit fluorescence in vitro were prepared for plasmid isolation and identification of insert DNA sequence. These clones were grown overnight on chocolate agar plates containing kanamycin and prepared for plasmid isolation using the Qiaprep Miniprep Kit (Qiagen) according to the manufacturer's protocol. Plasmid insert DNA was sequenced using the primer 5'-TGCCCATTAA-CATCACCATCTA-3' (SEQ ID NO: 588) that is complementary to the gfpmut3 gene and downstream of the insert DNA. Sequencing reactions were performed using the ABI prism BigDye® terminator cycle sequencing ready reaction kit (Applied Biosystems) according to manufacturer's protocol using a GeneAmp PCR System 9700 (Applied Biosystems). The sequences were then purified by passage through sephadex G-50 in a 96-well multiscreen HV plate (Millipore) and subsequently analyzed on an ABI Prism 3100 DNA analyzer (Applied Biosystems).

Insert sequences were compared to the complete annotated sequence of *H. influenzae* strain Rd. Those inserts with no nucleotide homology to strain Rd were subsequently analyzed using the BLASTN and BLASTX algorithms. Further sequence analysis was performed with DNASTAR (Madison, Wis.). Inserts in the correct orientation and containing sequence 5' to a predicted ORF contained a putative promoter that was preferentially active when the NTHi bacteria were in the chinchilla middle ear.

Fifty-two clones with putative promoters that were regulated in vivo were isolated. Of the 44 candidate clones containing sequence similar to that identified in *H. influenzae* strain Rd, quantitative comparison of gene expression in vitro and in vivo confirmed up-regulated gene expression for twenty-six genes (60%) when NTHi respond to environmental cues present in the chinchilla middle ear and these genes are summarized in Table 4A below. The in vivo-regulated promoters driving expression of genes are predicted to be involved in membrane transport, environmental informational processing, cellular metabolism, gene regulation, as well as hypothetical proteins with unknown function.

In order to confirm the induction of putative promoter candidates in vivo, the relative amount of messenger RNA expression was compared when NTHi strain 86-028NP was grown in vitro to mid-log phase or in vivo for 48 hours. The RNA was isolated using TRIzol LS reagent (Gibco Life Technologies) according to the manufacturer's protocol. DNA was removed from the RNA preparation using DNA-free kit (Ambion) according to the manufacturer's protocol. DNase I treated RNA samples were purified by passage through a Qiagen RNeasy column. RNA purity and integrity was assessed by 260/280 nm spectrophotometer readings and on the Agilent 2100 Bioanalyzer (Agilent Technologies), respectively.

In order to independently confirm the FACS data, we determined the relative expression of candidate genes by quantitative RT-PCR. The parent strain 86-028NP, was used for these studies. Real-time quantitative RT-PCR using the one-step QuantiTect SYBR Green RT-PCR kit (Qiagen) assessed transcription levels according to the manufacture's instructions. Briefly, using primers generated to an open reading frame downstream of the putative in vivo-induced promoters identified by FACS analysis, gene-specific mRNA was reverse transcribed and amplified by RT-PCR on the ABI Prism 7700 sequence detection system (Applied Biosystems). The amount of product was calculated using a standard curve generated to known amounts of bacterial genomic DNA ($10^2$-$10^7$ genomic copies DNA) by amplifying a fragment of the gyrase (gyr) gene. Controls were analyzed in parallel to verify the absence of DNA in the RNA preparation (-RT control) as well as the absence of primer dimers in control samples lacking template RNA. In addition, RT-PCR products were analyzed by gel electrophoresis and, in all cases, a single product was observed at the appropriate base pair size. Amounts of bacterial RNA between samples were normalized relative to gyr expression, shown to be constitutively expressed under various growth conditions that we tested in vitro. Known amounts of bacterial genomic DNA ($10^2$-$10^7$ genomic copies DNA) were used to generate a standard curve for RT-PCR quantitation by amplifying a fragment of the gyrase (gyr) gene. Gyrase is constitutively expressed in vitro under various growth conditions and was therefore used to normalize total bacterial RNA levels between samples. Relative gene expression in vivo was compared to that of gene expression in vitro and data expressed as fold-increase are summarized in Table 4A.

The 8-fold sequencing of the NTHi genome identified the full length open reading frames for the majority of genes listed in Table 4A. Table 4B provides the full length nucleotide sequence within the NTHi genome and the corresponding amino acid sequence. The fold induction of the gene due to environmental cues present in the chinichilla middle ear and the product or function of the gene are repeated in Table 4B for convenience.

TABLE 4A

| Category | Gene or ORF | SEQ ID NO: | GenBank Protein ID | Fold Induction | Product or Function |
|---|---|---|---|---|---|
| Amino acid metabolism | hisB | 589 | NP_438632 | 2.9 | Histidine biosynthesis bifunctional protein |
| Lipoprotein | lppB | 590 | NP_438862.1 | 2.6 | Lipoprotein B homologue |
| Membrane transport | sapA | 591 | NP_439780.1 | 2.8 | Peptide ABC transporter; periplasmic SapA precursor |
| | lolA | 592 | NP_439736.1 | 2.4 | Outer membrane lipoproteins carrier protein precursor |
| | rbsC | 593 | NP_438661.1 | 5.1 | Ribose transport system permease protein |
| Purine synthesis | purE | 594 | NP_439757.1 | 51.7 | Phosphoribosylaminoimidazole carboxylase catalytic subunit; PurE |
| Biosynthetic and metabolic functions | ribB | 595 | NP_438923.1 | 8.3 | 3,4-dihydroxy-2-butanone 4-phosphate synthase; riboflavin biosynthesis |
| | arcB | 596 | NP_438753.1 | 10 | Ornithine carbamoyltransferase; arginine degradation |
| | uxuA | 597 | NP_438228.1 | 3.1 | Mannonate dehydratase; production of glyceraldehyde 3-phosphate |
| | dsbB | 598 | NP_438589.1 | 2.6 | Disulfide oxidoreductase; disulfide bond formation protein B |

TABLE 4A-continued

| Category | Gene or ORF | SEQ ID NO: | GenBank Protein ID | Fold Induction | Product or Function |
|---|---|---|---|---|---|
| | ureH | 599 | NP_438693.1 | 3.9 | Urease accessory protein |
| | licC | 600 | NP_439688.1 | 2.3 | Phosphocholine (ChoP) cytidylyltransferase |
| | HI1647 | 601 | NP_439789.1 | 2.0 | Putative pyridoxin biosynthesis protein; singlet oxygen resistance protein |
| DNA replication, repair | ispZ | 602 | P43810 | 2.5 | Probable intracellular septation protein |
| | radC | 603 | NP_439113.1 | 2.1 | DNA repair protein |
| | mukF | 604 | P45185 | 2.0 | MukF protein homologue; remodeling of nucleiod structure |
| Gene regulation | glpR | 605 | NP_438777.1, NP_439170.1 | 2.8 | Glycerol-3-phosphate regulon repressor |
| | ihfB | 606 | P43724 | 2.5 | Integration host factor beta subunit |
| | argR | 607 | NP_439365.1 | 2.7 | Arginine repressor |
| | cspD | 608 | NP_439584.1 | 2.1 | Cold shock like protein; stress response protein |
| Hypothetical or unknown proteins | HI0094 | 609 | NP_438267.1 | 8.3 | Hypothetical protein |
| | HI1163 | 610 | NP_439321.1 | 2.3 | Conserved hypothetical protein; putative oxidase |
| | HI1063 | 611 | NP_439221.1 | 2.7 | Hypothetical protein |
| | HI0665 | 612 | NP_438824.1 | 2.8 | Hypothetical protein |
| | HI1292 | 613 | NP_439444.1 | 2.6 | Hypothetical protein |
| | HI1064 | 614 | NP_439222.1 | 2.6 | Hypothetical protein |

TABLE 4B

| Category | Gene or ORF | Full Length Nucleotide Sequence | Amino Acid Sequence | Location in Contig | Fold Induction | Product or Function |
|---|---|---|---|---|---|---|
| Amino acid metabolism | hisB | SEQ ID NO: 615 | SEQ ID NO: 616 | nt. 68378-67290 of SEQ ID NO: 680 (contig 13) | 2.9 | Histidine biosynthesis bifunctional protein |
| Membrane transport | sapA | SEQ ID NO: 617 | SEQ ID NO: 618 | nt. 200403-198709 of SEQ ID NO: 685 (contig 18) | 2.8 | Peptide ABC transporter; periplasmic SapA precursor |
| | rbsC | SEQ ID NO: 619 | SEQ ID NO: 620 | nt. 42773-41802 of SEQ ID NO: 680 (contig 13) | 5.1 | Ribose transport system permease protein |
| Purine synthesis | purE | SEQ ID NO: 621 | SEQ ID NO: 622 | nt. 219625-219131 of SEQ ID NO: 685 (contig 18) | 51.7 | Phosphoribosylaminoimidazole carboxylase catalytic subunit; PurE |
| Biosynthetic and metabolic functions | ribB | SEQ ID NO: 623 | SEQ ID NO: 624 | nt. 131537-132184 of SEQ ID NO: 682 (contig 15) | 8.3 | 3,4-dihydroxy-2-butanone 4-phosphate synthase; riboflavin biosynthesis |
| | arcB | SEQ ID NO: 625 | SEQ ID NO: 626 | nt. 49710-48706 of SEQ ID NO: 681 (contig 14) | 10 | Ornithine carbamolytransferase; arginine degradation |
| | uxuA | SEQ ID NO: 627 | SEQ ID NO: 628 | nt. 840671-841855 of SEQ ID NO: 685 (contig 18) | 3.1 | Mannonate dehydratase; production of glyceraldehyde 3-phosphate |
| | dsbB | SEQ ID NO: 629 | SEQ ID NO: 630 | nt. 388050-388583 of SEQ ID NO: 384 (contig 17) | 2.6 | Disulfide oxidoreductase; disulfide bond formation protein B |
| | ureH | SEQ ID NO: 631 | SEQ ID NO: 632 | nt. 4452-5267 of SEQ ID NO: 680 (contig 13) | 3.9 | Urease accessory protein |
| | licC | SEQ ID NO: 633 | SEQ ID NO: 634 | nt. 355083-354382 of SEQ ID NO: 385 (contig 18) | 2.3 | Phosphocholine (ChoP) cytidylyltransferase |

TABLE 4B-continued

| Category | Gene or ORF | Full Length Nucleotide Sequence | Amino Acid Sequence | Location in Contig | Fold Induction | Product or Function |
|---|---|---|---|---|---|---|
| | HI1647 | SEQ ID NO: 635 | SEQ ID NO: 636 | nt. 664017-664892 of SEQ ID NO: 685 (contig 18) | 2.0 | Putative pyridoxin biosynthesis protein; singlet oxygen resistance protein |
| DNA replication, repair | ispZ | SEQ ID NO: 637 | SEQ ID NO: 638 | nt. 4512-5069 of SEQ ID NO: 683 (contig 16) | 2.5 | Probable intracellular septation protein |
| | radC | SEQ ID NO: 639 | SEQ ID NO: 640 | nt. 132695-132030 of SEQ ID NO: 683 (contig 16) | 2.1 | DNA repair protein |
| | mukF | SEQ ID NO: 641 | SEQ ID NO: 642 | nt. 504549-503215 of SEQ ID NO: 685 (contig 18) | 2.0 | MukF protein homologue; remodeling of nucleiod structure |
| Gene regulation | glpR | SEQ ID NO: 643 | SEQ ID NO: 644 | nt. 72716-73483 of SEQ ID NO: 682 (contig 15) | 2.8 | Glycerol-3-phosphate regulon repressor |
| | ihfB | SEQ ID NO: 645 | SEQ ID NO: 646 | nt. 661004-660720 of SEQ ID NO: 685 (contig 18) | 2.5 | Integration host factor beta subunit |
| | argR | SEQ ID NO: 647 | SEQ ID NO: 648 | nt. 178540-178085 of SEQ ID NO: 685 (contig 18) | 2.7 | Arginine repressor |
| | cspD | SEQ ID NO: 649 | SEQ ID NO: 650 | nt. 435310-435528 of SEQ ID NO: 685 (contig 18) | 2.1 | Cold shock like protein; stress response protein |
| Hypothetical or unknown proteins | HI1163 | SEQ ID NO: 651 | SEQ ID NO: 652 | nt. 137202-134119 of SEQ ID NO: 685 (contig 18) | 2.3 | Conserved hypothetical protein; putative oxidase |
| | HI1063 | SEQ ID NO: 653 | SEQ ID NO: 654 | nt. 35158-34937 of SEQ ID NO: 685 (contig 18) | 2.7 | Hypothetical protein |
| | HI0665 | SEQ ID NO: 655 | SEQ ID NO: 656 | nt. 17949-18980 of SEQ ID NO: 679 (contig 12) | 2.8 | Hypothetical protein |
| | HI1292 | SEQ ID NO: 657 | SEQ ID NO: 658 | nt. 555002-555799 of SEQ ID NO: 685 (contig 18) | 2.6 | Hypothetical protein |

EXAMPLE 7

Identification of Virulence-Associated Genes

In many bacterial species, a subset of virulence-associated genes is regulated by errors in replication of short repeats. These repeats may be 5' to a gene or in the coding sequence, and their presence is an indication of controlled expression of the gene, which indicates association with virulence. Addition or deletion of a repeat results in the expression or of lack of expression of the particular virulence determinant.

The NTHi *H. influenzae* strain 86-028NP contig set was queried for short oligonucleotide repeats. The region surrounding the repeats was analyzed to identify the gene(s) associated with the repeat. Table 5 lists the identified repeats and the ORF (identified by BLAST) associated with each repeat.

Further sequence analysis has identified the full length nucleotide sequence of the virulence-associated genes and the corresponding amino acid sequences encoded by the ORF. The derived amino acid sequences are highly homologous to the listed Genbank sequence.

TABLE 5

| Repeat | Location in 3-fold Contigs | Location in 8-fold Contigs | Full Length Nucleotide Sequence | Amino Acid Sequence | Genebank Accession No. |
|---|---|---|---|---|---|
| SEQ ID NO: 581 | 115 nt. 473-540 of SEQ ID NO: 115 | nt. 484533-483643 of SEQ ID NO: 685 (contig 18) | SEQ ID NO: 659 | SEQ ID NO: 660 | NP_439538.1 |

TABLE 5-continued

| Repeat | Location in 3-fold Contigs | Location in 8-fold Contigs | Full Length Nucleotide Sequence | Amino Acid Sequence | Genebank Accession No. |
|---|---|---|---|---|---|
| SEQ ID NO: 582 | 377 nt. 546-597 of SEQ ID NO: 337 | nt. 416274-414910 of SEQ ID NO: 685 (contig 18) | SEQ ID NO: 661 | SEQ ID NO: 662 | P45217 |
| SEQ ID NO: 583 | 505 nt. 310-393 of SEQ ID NO: 505 | nt. 414500-416614 of SEQ ID NO: 684 (contig 17) | SEQ ID NO: 663 | SEQ ID NO: 664 | AAK76425 |
| SEQ ID NO: 584 | 508 nt. 2079-2120 of SEQ ID NO: 508 | nt. 506516-507913 of SEQ ID NO: 685 (contig 18) | SEQ ID NO: 665 | SEQ ID NO: 666 | NP_439520 |
| SEQ ID NO: 585 | 518 nt. 758-789 of SEQ ID NO: 518 | nt. 354274-352406 of SEQ ID NO: 684 (contig 17) | SEQ ID NO: 667 | SEQ ID NO: 668 | NP_284893 |
| SEQ ID NO: 586 | 543 nt. 1814-196 of SEQ ID NO: 543 | nt. 347864-243236 of SEQ ID NO: 685 (contig 18) | SEQ ID NO: 669 | SEQ ID NO: 670 | AAA20524 |
| SEQ ID NO: 586 | 543 nt. 1814-196 of SEQ ID NO: 543 | nt. 699709-704187 of SEQ ID NO: 685 (contig 18) | SEQ ID NO: 671 | SEQ ID NO: 672 | AAD56660 |
| SEQ ID NO: 587 | 567 nt. 13309-13320 of SEQ ID NO: 567 | nt. 85546-84689 of SEQ ID NO: 681 (contig 14) | SEQ ID NO: 673 | SEQ ID NO: 674 | ZP_00053190 |

EXAMPLE 8

Identification of Unique NTHi Gene Sequences

Genes associated with NTHi virulence were also identified by comparing the level of expression of the gene when the NTHi bacterium was infecting a tissue verses the level of expression of the same gene when the NTHi was grown on artificial laboratory media. These novel genes were identified using the promoter trap techniques described above in Examples 4-6, and subsequently comparisons with the known Rd genome demonstrated these genes are unique to NTHi strain 86-028NP.

The DNA sequence identified using this screening procedure are set forth as SEQ ID NOS: 577-580. These sequences did not contain genes or gene fragments that have homologues in the H. influenzae Rd. genome sequence. Even though these are completely novel sequences, due to their expression level during NTHi infection in the chinchilla middle ear, it is likely that expression of these genes are involved in NTHi virulence.

EXAMPLE 9

Complete Sequence Analysis of NTHi Strain 86-028NP

Library construction: Chromosomal DNA was prepared from strain 86-028NP using Puregene reagents (Gentra Systems, Minneapolis, Minn.). For the initial shotgun sequencing of the genome, 1 to 2 kb and 2 to 4 kb libraries of genomic DNA were constructed in pUC18 as previously described (Munson et al., Infect Immun 72:3002-10, 2004). For the scaffolding library, genomic DNA was manually sheared into a mean fragment size of 40 kb using a Hamilton syringe. After end repair, fragments were fractionated using a 0.7% low melting temperature agarose gel. Fragments larger than 30 kb were excised and an in-gel ligation to pEpiFOS-5 was performed. The ligation mixture recovered from the gel was packaged into Lambda phage, in vitro, and used to transfect EPI100 cells (Epicentre, Madison, Wis.).

Sequencing: For the shotgun portion of the sequencing, cycle-sequencing reactions were run using PE Big-Dye™ terminators and universal primers (M13 forward and reverse) as previously described (Munson et al., Infect Immun 72:3002-10, 2004). To end-sequence the scaffolding library, plasmid was first purified using a R.E.A.L. Prep 96 Plasmid Kit (QIAGEN Inc., Valencia, Calif.), then amplified using a TempliPhi™ DNA Amplification Kit (Amersham Biosciences Corp., Piscataway, N.J.) before running reactions using PE Big-Dye™ terminators and pEpiFOS-5 forward and reverse sequencing primers (Epicentre, Madison, Wis.). The reactions for the clean-up portions of the project were run using PE Big-Dye™ terminators and custom primers (Integrated DNA Technologies, Coralville, Iowa). Excess dye terminators were removed with Sephadex G50 columns in 96-well format and sequence determined on either an ABI 3700 or an ABI 3100 capillary electrophoresis DNA sequencer (Applied Biosystems, Foster City, Calif.).

Genome closure: Paired end-sequences from the scaffolding library and PCR were used to order the contigs and to add sequence in areas of low sequence coverage. Paired custom primers (Integrated DNA Technologies, Coralville, Iowa) were designed to bind at the ends of each contig as well as regions flanking areas of low sequence coverage. The intervening regions were amplified with a standard PCR protocol as described in Sambrook et al., Molecular Cloning: A Laboratory Manual (Third Edition). Cold Spring Harbor Laboratory Press., 2001 using Taq polymerase (Roche Diagnostics, Indianapolis, Ind.) and sequenced on both strands. Ribosomal RNA operons and the HMW gene clusters were completely sequenced using clones from the scaffolding library as templates.

Assembly: Phred/Phrap was used for data assembly, employing the default assembly parameters (Ewing et al., *Genome Res* 8:186-94, 1998; Ewing et al., *Genome Res* 8:175-85, 1988; Gordon et al., *Genome Res* 8:195-202, 1998) as described in Munson et al., *Infect Immun* 72:3002-10, 2004. Assemblies were checked using the paired-end sequence data from 507 clones using the Seqman II program from the DNASTAR suite.

Data analyses: Coding regions were identified using Glimmer2 (v2.13) trained on the set of 1178 longest ORFs identified by the Glimmer2 long-orfs program (Delcher et al., *Nucleic Acids Res* 27:4636-41, 1999). Automated annotation by similarity was done by searching the Glimmer ORF set against the strain Rd proteome, the SwissProt database, the NCBI COGs database, and the KEGG database. The strain Rd database was compared bi-directionally with the strain 86-028NP ORF set using tricross to determine high-confidence regions of similarity and to produce the dotplot comparison of genome organization Ray et al., *Bioinformatics* 17:1105-12, 2001).

The automatically predicted annotation information was further manually curated using Artemis (Rodriguez et al., *Infect Immun* 71:1635-42, 2003) for visualization and demarcation of genomic regions of interest, and a custom FileMaker Pro database was generated which was then used to apply manual revisions and archive data related to the functional assignment. FASTA analyses were used for the primary automated comparisons. The strong synteny between the strain 80-028NP and strain Rd genomes allowed assignment of a function to the majority of the genes automatically, with similarity held to 90% or better at the amino acid level for matching. The near one-to-one mapping from the strain 86-028NP genome to the strain Rd genome was confirmed by assembly of the strain RdORFs onto the strain 86-028NP genome sequence, and the reverse assembly of the strain 86-028NP ORFs onto the Rd genome, using the SeqMan program with the assembly criteria of 80% identity at the nucleotide level.

Manual BLAST analyses were used to explore the potential function of ORFs that did not show strong similarity to known genes. Manual curation of the automatic assignments was carried out to conform annotations to the current literature and repair the few places where the automated algorithm was easily led astray (notably the HMW gene clusters, the hemoglobin-binding proteins and the hsd gene clusters, whose high family similarity confounds automated assignment).

The tRNA genes were identified by tRNAscan-SE v1.11 (Lowe et al., *Nucleic Acids Res* 25:955-64, 1997). The rRNA operons were identified based on 16, 23 and 5S rRNA similarity with strain Rd, and the CLUSTALW alignment of the neighborhoods containing these genes to determine the boundaries of the semi-conserved regions.

The complete genomic DNA sequence of the *H. influenzae*, strain 86-028NP, is set out as SEQ ID NO: 772. The open reading frames within the genomic DNA are set out as SEQ ID NOS: 773-2593 and are described in Table 6. The resulting gene products are set out as SEQ ID NOS: 2581-4414 and are described in Table 7. The "c" preceding the nucleotides of the open reading frames indicates the open reading frame is complementary to the 5' to 3' sequence set out as SEQ ID NO: 722. The unique NTHi genes are marked in Table 6. The genome sequence will be available from GenBank as Accession number CP000057, which is incorporated by reference herein in its entirety.

The following open reading frames are defined as pseudogenes in Table 6 because these nucleotide sequences contain a frameshift or a stop codon within the sequence: SEQ ID NO: 822 (kdgK), SEQ ID NO: 928, SEQ ID NO: 994 (bolA), SEQ ID NO: 276 (adhC) SEQ ID NO: 1102 (dusC), SEQ ID NO: 1121 (merP), SEQ ID NO: 1135, SEQ ID NO:1236, SEQ ID NO: 1254, SEQ ID NO: 1376 (lic2C), SEQ ID NO: 1431 (hgpD), SEQ ID NO: 1502, SEQ ID NO:1505 (ppx), SEQ ID NO: 1523 (hgpC), SEQ ID NO: 1585 (lex2A), SEQ ID NO: 1637 SEQ ID NO: 1713, SEQ ID NO: 1856 (mod), SEQ ID NO: 1899, SEQ ID NO: 2006, SEQ ID NO: 2080, SEQ ID NO: 2155, SEQ ID NO: 2202, SEQ ID NO:2257, SEQ ID NO: 2331, SEQ ID NO:2345, SEQ ID NO: 2365, SEQ ID NO: 2555 (metE) and SEQ ID NO:2563 (pmi). The hgpD, hgpC, lex2A and NTHI1769 genes contain contingency repeats that cause the sequence to shift in and out of reading frame and the resulting amino acid sequences (SEQ ID NOS: 3242, 3332 and 4142) are partial translation. These contingency repeats regulate gene expression in the *H. influenzae* and therefore the genes encoding these proteins will be correctly translated after insertion or deletion of 1 or more repeats

TABLE 6

NTHi Open Reading Frames and Gene Poducts

| CDS | Gene Name | Unique to NTHi 86-0268 | Product Name | SEQ ID NO: |
|---|---|---|---|---|
| 2-1021 | gapA | | glyceraldehyde 3-phosphate dehydrogenase | 773 |
| 1191-3014 | — | | putative long-chain-fatty-acid--CoA ligase | 774 |
| C 3051-3839 | — | | conserved hypothetical protein | 775 |
| C 3855-4319 | — | | conserved hypothetical protein | 776 |
| C 4581-5393 | fdhD | | FdhD protein homolog | 777 |
| 5664-8750 | fdxG | | formate dehydrogenase major subunit | 778 |
| 8752-9690 | fdxH | | formate dehydrogenase, iron-sulfur subunit | 779 |
| 9683-10399 | fdxI | | formate dehydrogenase, cytochrome B556 subunit | 780 |
| 10469 . . . 11377 | fdhE | | FdhE homolog | 781 |
| C 11421 . . . 11861 | rimI | | ribosomal-protein-alanine acetyltransferase | 782 |
| C 11864 . . . 12268 | holD | | DNA polymerase III, psi subunit | 783 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 12374 ... 13366 | rsmC | | ribosomal RNA small subunit methyltransferase C | 784 |
| C 13434 ... 14342 | era | | GTP-binding protein era homolog | 785 |
| C 14339 ... 15022 | rnc | | ribonuclease III | 786 |
| C 15024 ... 16073 | lepB | | Signal peptidase I | 787 |
| C 16082 ... 17878 | lepA | | GTP-binding protein LepA | 788 |
| C 18047 ... 18430 | — | | conserved hypothetical acid-induced glycyl radical enzyme | 789 |
| 18688 ... 19347 | ung | | uracil-DNA glycosylase | 790 |
| C 19417 ... 20841 | — | | conserved hypothetical protein | 791 |
| C 21224 ... 22663 | — | | conserved hypothetical protein | 792 |
| C 22665 ... 24062 | citG | | CitXG | 793 |
| C 24243 ... 25745 | citF | | citrate lyase alpha chain | 794 |
| C 25760 ... 26635 | citE | | citrate lyase beta chain | 795 |
| C 26632 ... 26919 | citD | | citrate lyase acyl carrier protein | 796 |
| C 26957 ... 27964 | citC | | [citrate [pro-3S]-lyase] ligase | 797 |
| C 28215 ... 29177 | lipA | | Lipoic acid synthetase | 798 |
| C 29231 ... 29869 | lipB | | lipoate-protein ligase B | 799 |
| C 29871 ... 30149 | — | | conserved hypothetical protein | 800 |
| C 30205 ... 31386 | dacA | | penicillin-binding protein 5 precursor | 801 |
| C 31402 ... 32265 | rlpA | | RlpA-like protein | 802 |
| C 32318 ... 33433 | mrdB | | Rod shape-determining protein RodA | 803 |
| C 33423 ... 35378 | mrdA | | penicillin-binding protein 2 | 804 |
| C 35400 ... 35867 | — | | conserved hypothetical protein | 805 |
| C 35921 ... 36229 | — | | conserved hypothetical protein | 806 |
| C 36354 ... 38009 | — | | conserved hypothetical membrane protein | 807 |
| 38215 ... 39993 | — | | conserved hypothetical ABC transporter ATP-binding protein | 808 |
| 40042 ... 41178 | mreB | | rod shape-determining protein MreB | 809 |
| 41258 ... 42313 | mreC | | rod shape-determining protein MreC | 810 |
| 42313 ... 42801 | mreD | | rod shape-determining protein MreD | 811 |
| C 42852 ... 43628 | — | | conserved hypothetical protein | 812 |
| C 43638 ... 44441 | xthA | | exodeoxyribonuclease III | 813 |
| C 44489 ... 45163 | rluA2 | | conserved hypothetical pseudouridine synthase | 814 |
| C 45163 ... 46227 | — | | conserved hypothetical membrane protein | 815 |
| C 46287 ... 46949 | — | | conserved hypothetical FtsH-interacting integral membrane protein | 816 |
| C 47276 ... 47830 | — | | conserved hypothetical protein | 817 |
| 47897 ... 48259 | phnA | | PhnA homolog | 818 |
| C 48312 ... 48950 | eda | | KHG/KDPG aldolase | 819 |
| C 48959 ... 50362 | uxuC | ✓ | uronate isomerase | 820 |
| C 50372 ... 51229 | — | | putative oxidoreductase | 821 |
| C 51229 ... 52172 | kdgK | | pseudogene for 2-dehydro-3-deoxygluconokinase | 822 |
| C 52192 ... 53463 | — | | putative TRAP-type C4-dicarboxylate transport system, large permease component | 823 |
| C 53473 ... 53970 | — | | putative TRAP-type C4-dicarboxylate transport system, small permease component | 824 |
| C 54009 ... 54995 | — | | putative TRAP-type C4-dicarboxylate transport system, periplasmic component | 825 |
| C 55022 ... 56050 | — | | conserved hypothetical zinc-type alcohol dehydrogenase-like protein | 826 |
| 56160 ... 56960 | uxuR | | Uxu operon regulator | 827 |
| 56988 ... 58172 | uxuA | | mannonate dehydratase | 828 |
| C 58225 ... 58938 | — | | putative membrane protein TerC | 829 |
| C 59036 ... 60865 | uvrC | | UvrABC system protein C | 830 |
| C 60867 ... 61631 | kdsB | | 3-deoxy-D-manno-octulosonic acid cytidylyltransferase | 831 |
| C 61702 ... 62700 | lpxK | | tetraacyldisaccharide 4'-kinase | 832 |
| C 62773 ... 64536 | msbA | | lipid A export ATP-binding protein MsbA | 833 |
| C 64577 ... 66943 | rec2 | | recombination protein 2 | 834 |
| 67202 ... 67639 | dksA | | DnaK suppressor protein | 835 |
| 67887 ... 69245 | pcnB | | probable poly polymerase | 836 |
| 69254 ... 69736 | folK | | 2-amino-4-hydroxy-6-hydroxymethyl-dihydropteridine pyrophosphokinase | 837 |
| 69812 ... 70288 | — | | conserved hypothetical protein | 838 |
| 70296 ... 71594 | amiB | | probable N-acetylmuramoyl-L-alanine amidase AmiB precursor | 839 |
| 71595 ... 73484 | mutL | | DNA mismatch repair protein MutL | 840 |
| 73492 ... 74427 | miaA | | tRNA delta-isopentenylpyrophosphate transferase | 841 |
| 74433 ... 77378 | glnE | | glutamate-ammonia-ligase adenylyltransferase | 842 |
| C 77463 ... 79139 | recN | | DNA repair protein RecN | 843 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 79251 . . . 80069 | ppnK | | probable inorganic polyphosphate/ATP-NAD kinase | 844 |
| 80133 . . . 80837 | grpE | | grpE | 845 |
| C 80850 . . . 81194 | — | | conserved hypothetical protein | 846 |
| C 81187 . . . 81627 | — | | conserved hypothetical protein | 847 |
| 81908 . . . 84031 | nrdD | | anaerobic ribonucleoside-triphosphate reductase | 848 |
| 84150 . . . 85010 | tesB | | Acyl-CoA thioesterase II | 849 |
| C 85171 . . . 86550 | cysS | | cysteinyl-tRNA synthetase | 850 |
| 86653 . . . 87162 | ppiB | | peptidyl-prolyl cis-trans isomerase B | 851 |
| 87166 . . . 87597 | — | | conserved hypothetical protein | 852 |
| 87739 . . . 88527 | — | | putative deoxyribonuclease | 853 |
| 88589 . . . 88846 | — | ✓ | hypothetical protein | 854 |
| 88857 . . . 89132 | — | ✓ | hypothetical protein | 855 |
| C 89182 . . . 89505 | trxA | | thioredoxin | 856 |
| C 89625 . . . 90620 | ddh | | 2-hydroxyacid dehydrogenase homolog | 857 |
| C 90633 . . . 91778 | metB | | cystathionine gamma-synthase | 858 |
| 92334 . . . 93170 | — | ✓ | predicted ATPase involved in chromosome partitioning | 859 |
| 93172 . . . 94527 | dnaB2 | ✓ | replicative DNA helicase | 860 |
| 94520 . . . 96220 | — | ✓ | conserved hypothetical protein | 861 |
| 96220 . . . 96771 | — | ✓ | conserved hypothetical protein | 862 |
| 96921 . . . 98144 | — | ✓ | conserved hypothetical protein | 863 |
| 98441 . . . 99196 | — | ✓ | conserved hypothetical protein | 864 |
| 99196 . . . 99684 | — | ✓ | conserved hypothetical protein | 865 |
| 99930 . . . 100352 | ssb2 | ✓ | Single-strand binding protein | 866 |
| 100379 . . . 100897 | — | ✓ | conserved putative lipoprotein | 867 |
| C 101113 . . . 101670 | — | ✓ | 1conserved hypothetical protein | 868 |
| 101746 . . . 103806 | topB2 | ✓ | DNA topoisomerase III | 869 |
| 104691 . . . 105119 | — | ✓ | conserved hypothetical protein | 870 |
| 105131 . . . 105223 | — | | hypothetical protein | 871 |
| 105234 . . . 105875 | — | ✓ | conserved hypothetical protein | 872 |
| 105910 . . . 106317 | — | ✓ | hypothetical protein | 873 |
| 106418 . . . 106888 | radC2 | ✓ | putative DNA repair radC-like protein | 874 |
| 106981 . . . 107577 | — | ✓ | conserved hypothetical protein | 875 |
| 107635 . . . 108399 | — | ✓ | conserved hypothetical protein | 876 |
| 108498 . . . 109127 | pilL | ✓ | conserved putative lipoprotein | 877 |
| 109131 . . . 109871 | — | ✓ | conserved putative exported protein | 878 |
| 109850 . . . 110608 | — | ✓ | conserved putative exported protein | 879 |
| 110624 . . . 111130 | — | ✓ | conserved putative exported protein | 880 |
| 111127 . . . 113376 | — | ✓ | conserved hypothetical protein | 881 |
| 113695 . . . 114381 | — | ✓ | conserved putative membrane protein | 882 |
| 114512 . . . 114862 | — | ✓ | conserved putative membrane protein | 883 |
| 115131 . . . 115532 | — | ✓ | conserved putative membrane protein | 884 |
| 115552 . . . 115923 | — | ✓ | conserved putative membrane protein | 885 |
| 115935 . . . 116579 | — | ✓ | conserved putative exported protein | 886 |
| 116579 . . . 117448 | — | ✓ | conserved hypothetical protein | 887 |
| 117459 . . . 118859 | — | ✓ | conserved putative exported protein | 888 |
| 118869 . . . 119276 | — | ✓ | conserved putative lipoprotein | 889 |
| 119292 . . . 122162 | — | ✓ | conserved hypothetical protein | 890 |
| 122170 . . . 122577 | — | ✓ | conserved hypothetical protein | 891 |
| 122587 . . . 122910 | — | ✓ | conserved hypothetical membrane protein | 892 |
| 122919 . . . 124412 | — | ✓ | conserved putative membrane protein | 893 |
| C 124468 . . . 124797 | — | ✓ | conserved hypothetical membrane protein | 894 |
| C 124955 . . . 127960 | tnpA | ✓ | transposon Tn3 transposase | 895 |
| 126925 . . . 127041 | — | ✓ | hypothetical protein | 896 |
| 128088 . . . 128726 | tnpR | ✓ | transposon Tn3 resolvase | 897 |
| 128751 . . . 128930 | — | ✓ | hypothetical protein | 898 |
| C 128975 . . . 129382 | — | ✓ | hypothetical exported protein | 899 |
| C 129398 . . . 131398 | — | ✓ | conserved putative exported protein | 900 |
| C 131413 . . . 132354 | — | ✓ | conserved putative exported protein | 901 |
| C 132351 . . . 132794 | — | ✓ | conserved hypothetical protein | 902 |
| 133106 . . . 133525 | — | ✓ | conserved hypothetical membrane protein | 903 |
| 133610 . . . 133843 | — | ✓ | conserved hypothetical protein | 904 |
| 133846 . . . 134094 | — | ✓ | hypothetical protein | 905 |
| 134098 . . . 134256 | — | ✓ | hypothetical protein | 906 |
| 134387 . . . 135340 | traC | ✓ | conserved putative antirestriction protein | 907 |
| 135444 . . . 136205 | — | ✓ | possible type I restriction enzyme M subunit | 908 |
| 136431 . . . 136997 | — | ✓ | hypothetical protein | 909 |
| 137037 . . . 137411 | — | ✓ | conserved hypothetical protein | 910 |
| 137401 . . . 138078 | — | ✓ | conserved hypothetical protein | 911 |
| 138056 . . . 138673 | — | ✓ | conserved hypothetical protein | 912 |
| C 138937 . . . 139536 | — | ✓ | resolvase/integrase-like protein | 913 |
| C 139551 . . . 139742 | — | ✓ | hypothetical protein | 914 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 140211 ... 140465 | — | ✓ | hypothetical protein | 915 |
| 141656 ... 142369 | — | ✓ | conserved hypothetical protein | 916 |
| 143089 ... 144342 | — | ✓ | hypothetical protein | 917 |
| 144485 ... 146401 | — | ✓ | conserved hypothetical protein | 918 |
| 146462 ... 147304 | — | ✓ | putative site-specific recombinase | 919 |
| C 147954 ... 149231 | thrC | | threonine synthase | 920 |
| C 149274 ... 150218 | thrB | | homoserine kinase | 921 |
| C 150231 ... 152678 | thrA | | aspartokinase/homoserine dehydrogenase | 922 |
| 153002 ... 153715 | — | | conserved hypothetical protein | 923 |
| 153755 ... 154891 | grk | | glycerate kinase | 924 |
| C 154900 ... 156159 | — | | conserved hypothetical protein | 925 |
| C 156281 ... 157387 | — | | conserved hypothetical protein | 926 |
| C 157589 ... 157909 | — | | conserved hypothetical protein | 927 |
| 157962 ... 158171 | — | | pseudogene for glycerol-3-phosphate regulon repressor | 928 |
| C 158260 ... 159015 | — | | conserved hypothetical protein | 929 |
| 159216 ... 159497 | — | | conserved hypothetical protein | 930 |
| 159649 ... 160647 | hitA | | iron-utilization periplasmic protein hFbpA | 931 |
| 160765 ... 162285 | hitB | | iron(III)-transport system permease protein hFbpB | 932 |
| 162287 ... 163342 | hitC | | iron-utilization ATP-binding protein hFbpC | 933 |
| C 163377 ... 164057 | — | | putative D-alanyl-D-alanine carboxypeptidase | 934 |
| C 164059 ... 165192 | dapE | | succinyl-diaminopimelate desuccinylase | 935 |
| C 165220 ... 165564 | — | | conserved hypothetical protein | 936 |
| C 165643 ... 167538 | — | | chaperone protein HtpG | 937 |
| 167750 ... 168589 | — | | conserved hypothetical NIF3-like protein | 938 |
| 168763 ... 171135 | hsdM1 | ✓ | putative type I restriction-modification system, methyltransferase subunit | 939 |
| 171318 ... 172727 | — | ✓ | predicted transcriptional regulator containing an HTH domain | 940 |
| 172899 ... 174149 | hsdS1 | ✓ | putative type I site-specific restriction-modification system, S subunit | 941 |
| 174249 ... 177275 | hsdR1 | ✓ | putative type I site-specific restriction-modification system, R subunit | 942 |
| C 177500 ... 178879 | ffh | | Signal recognition particle protein | 943 |
| 179130 ... 180422 | corB | | putative Mg2+ and Co2+ transporter | 944 |
| 180443 ... 181321 | — | | conserved hypothetical protein | 945 |
| 181323 ... 181802 | — | ✓ | conserved hypothetical protein | 946 |
| 181892 ... 182233 | — | | conserved hypothetical protein | 947 |
| 182400 ... 183689 | serS | | Seryl-tRNA synthetase | 948 |
| 184024 ... 184653 | gst | | glutathione S-transferase | 949 |
| C 184665 ... 184961 | — | | conserved hypothetical protein | 950 |
| 185014 ... 187251 | hemR | | hemin receptor | 951 |
| C 194299 ... 196434 | — | | possible SAM-dependent methyltransferase | 952 |
| 196827 ... 197936 | mltA | | membrane-bound lytic murein transglycosylase A precursor | 953 |
| 197936 ... 198706 | — | | conserved hypothetical protein | 954 |
| 198884 ... 199885 | znuA | | high-affinity zinc uptake system protein ZnuA | 955 |
| 199935 ... 200441 | — | | conserved hypothetical protein | 956 |
| C 200554 ... 201912 | mpl | | UDP-N-acetylmuramate:L-alanyl-gamma-D-glutamyl-meso-diaminopimelate ligase | 957 |
| C 202297 ... 203484 | metC | | cystathionine beta-lyase | 958 |
| 203615 ... 204223 | tsaA | ✓ | probable peroxiredoxin | 959 |
| 204324 ... 204881 | pgsA | | CDP-diacylglycerol--glycerol-3-phosphate 3-phosphatidyltransferase | 960 |
| C 205445 ... 205975 | ppa | | inorganic pyrophosphatase | 961 |
| 206209 ... 207525 | — | | conserved hypothetical protein | 962 |
| 207748 ... 208389 | udk | | uridine kinase | 963 |
| 208398 ... 208985 | dcd | | deoxycytidine triphosphate deaminase | 964 |
| 208989 ... 210164 | — | | conserved hypothetical protein | 965 |
| 210164 ... 211372 | — | | probable sugar efflux transporter | 966 |
| C 211433 ... 212947 | engA | | GTP-binding protein EngA | 967 |
| C 213629 ... 214396 | dnaQ | | DNA polymerase III, epsilon chain | 968 |
| 214457 ... 214921 | rnhA | | ribonuclease HI | 969 |
| 215187 ... 216284 | omP2 | | Outer membrane protein P2 precursor | 970 |
| C 216481 ... 217626 | nagA | | N-acetylglucosamine-6-phosphate deacetylase | 971 |
| C 217763 ... 218575 | nagB | | glucosamine-6-phosphate deaminase | 972 |
| 218911 ... 219792 | nanA | | N-acetylneuraminate lyase | 973 |
| C 219803 ... 220669 | — | | putative HTH-type transcriptional regulator | 974 |
| C 220662 ... 221564 | nanK | | putative N-acetylmannosamine kinase | 975 |
| C 221609 ... 222295 | nanE | | putative N-acetylmannosamine-6-phosphate 2-epimerase | 976 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 222645 . . . 223634 | — | | putative sialic acid transporter, TRAP-type C4-dicarboxylate transport system, periplasmic component | 977 |
| 223699 . . . 225549 | siaT | | putative sialic acid transporter, TRAP-type C4-dicarboxylate transport system, large permease component | 978 |
| 225713 . . . 226852 | — | | conserved hypothetical protein | 979 |
| 227014 . . . 227448 | — | | putative protein-S-isoprenylcysteine methyltransferase | 980 |
| C 227490 . . . 228377 | hflC | | HflC | 981 |
| C 228377 . . . 229609 | hflK | | HhflK | 982 |
| C 229719 . . . 230426 | — | | putative 4'-phosphopantetheinyl transferase | 983 |
| C 230486 . . . 231817 | dcuB2 | | anaerobic C4-dicarboxylate transporter DcuB | 984 |
| C 232021 . . . 232251 | acpP | | acyl carrier protein | 985 |
| C 232511 . . . 233239 | fabG | | 3-oxoacyl-[acyl-carrier protein] reductase | 986 |
| C 233256 . . . 234194 | fabD | | malonyl CoA-acyl carrier protein transacylase | 987 |
| C 234694 . . . 235644 | fabH | | 3-oxoacyl-[acyl-carrier-protein] synthase III | 988 |
| C 235830 . . . 236000 | rpmF | | 50S ribosomal protein L32 | 989 |
| C 236023 . . . 236547 | — | | conserved hypothetical protein | 990 |
| 236704 . . . 237576 | psd | | phosphatidylserine decarboxylase proenzyme | 991 |
| C 237685 . . . 239055 | gor | | glutathione reductase | 992 |
| C 239271 . . . 239870 | — | | conserved hypothetical lipoprotein | 993 |
| 239964 . . . 240275 | bolA | | Pseudogene for BolA homolog | 994 |
| 240566 . . . 241909 | nqrA | | Na(+)-translocating NADH-quinone reductase subunit A | 995 |
| 241912 . . . 243147 | nqrB | | Na(+)-translocating NADH-quinone reductase subunit B | 996 |
| 243140 . . . 243874 | nqrC | | Na(+)-translocating NADH-quinone reductase subunit C | 997 |
| 243874 . . . 244500 | nqrD | | Na(+)-translocating NADH-quinone reductase subunit D | 998 |
| 244504 . . . 245100 | nqrE | | Na(+)-translocating NADH-quinone reductase subunit E | 999 |
| 245113 . . . 246348 | nqrF | | Na(+)-translocating NADH-quinone reductase subunit F | 1000 |
| 246492 . . . 247532 | apbE | | thiamine biosynthesis lipoprotein ApbE | 1001 |
| 247535 . . . 247795 | — | | conserved hypothetical protein | 1002 |
| 247870 . . . 249063 | trmU | | probable tRNA (5-methylaminomethyl-2-thiouridylate)-methyltransferase | 1003 |
| C 249107 . . . 249841 | — | | conserved hypothetical protein | 1004 |
| C 249843 . . . 250817 | rluD | | ribosomal large subunit pseudouridine synthase D | 1005 |
| 250925 . . . 251713 | — | | conserved hypothetical lipoprotein | 1006 |
| C 251792 . . . 252274 | — | | conserved hypothetical protein | 1007 |
| C 252306 . . . 253046 | pflA | | pyruvate formate-lyase 1 activating enzyme | 1008 |
| 253171 . . . 255489 | pflB | | formate acetyltransferase | 1009 |
| C 255521 . . . 256375 | focA | | probable formate transporter | 1010 |
| 256880 . . . 257794 | — | | conserved hypothetical protein | 1011 |
| 257973 . . . 259418 | — | | putative Na+/alanine symporter | 1012 |
| C 259603 . . . 260430 | — | | conserved hypothetical protein | 1013 |
| C 260439 . . . 261575 | adhC | | pseudogene for putative alcohol dehydrogenase class III | 1014 |
| 261698 . . . 262105 | — | | putative HTH-type transcriptional regulator | 1015 |
| 262263 . . . 262550 | tatA | | Sec-independent protein translocase protein TatA/E | 1016 |
| 262554 . . . 263114 | tatB | | Sec-independent protein translocase protein TatB | 1017 |
| 263124 . . . 263894 | tatC | | Sec-independent protein translocase protein TatC | 1018 |
| 264255 . . . 265604 | gdhA | | NADP-specific glutamate dehydrogenase | 1019 |
| C 265712 . . . 266152 | fur | | Ferric uptake regulation protein | 1020 |
| C 266181 . . . 266705 | fldA | | flavodoxin | 1021 |
| C 267655 . . . 268260 | seqA | | seqA | 1022 |
| 266802 . . . 267665 | — | | putative esterase/lipase | 1023 |
| 268263 . . . 269621 | menE | | O-succinylbenzoate--CoA ligase | 1024 |
| 269649 . . . 272987 | — | | putative small-conductance mechanosensitive channel | 1025 |
| 272997 . . . 274070 | aroC | | chorismate synthase | 1026 |
| 274243 . . . 275103 | mepA | | penicillin-insensitive murein endopeptidase | 1027 |
| 275121 . . . 275888 | — | | conserved hypothetical protein | 1028 |
| 275935 . . . 276891 | msbB | | lipid A biosynthesis (KDO)2-(lauroyl)-lipid IVA acyltransferase | 1029 |
| 277018 . . . 277989 | selD | | selenide, water dikinase | 1030 |
| C 278098 . . . 278448 | rplsS | | 50S ribosomal protein L19 | 1031 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 278485 ... 279225 | trmD | | tRNA (guanine-N(1)-)-methyltransferase | 1032 |
| C 279263 ... 279790 | rimM | | 16S rRNA processing protein RimM | 1033 |
| C 279835 ... 280083 | rspP | | 30S ribosomal protein S16 | 1034 |
| 280363 ... 281148 | — | | conserved hypothetical protein | 1035 |
| 281171 ... 282982 | nadN | | NAD nucleotidase | 1036 |
| 283267 ... 283809 | aroK | | shikimate kinase | 1037 |
| 283829 ... 284917 | aroB | | 3-dehydroquinate synthase | 1038 |
| 284919 ... 285779 | dam | | DNA adenine methylase | 1039 |
| 286744 ... 286851 | — | | conserved hypothetical protein | 1040 |
| C 286870 ... 287595 | pgpB | | phosphatidylglycerophosphatase B | 1041 |
| 287641 ... 288315 | ribA | | GTP cyclohydrolase II | 1042 |
| C 288631 ... 290175 | — | | putative ABC-type oligopeptide transport system, periplasmic component | 1043 |
| C 290168 ... 290530 | — | | conserved hypothetical protein | 1044 |
| 290649 ... 292694 | prlc | | oligopeptidase A | 1045 |
| 292926 ... 294470 | Hsdm2 | | putative type I restriction-modification system methyltransferase subunit | 1046 |
| 294555 ... 295727 | Hsds2 | | putative type I restriction-modification system specificity protein | 1047 |
| 295729 ... 296883 | prrC | ✓ | putative anticodon nuclease | 1048 |
| 296886 ... 297884 | — | ✓ | conserved hypothetical DNA binding protein | 1049 |
| 297895 ... 300978 | Hsdr2 | | putative type I restriction-modification system | 1050 |
| C 301125 ... 301754 | — | | conserved hypothetical protein | 1051 |
| C 301968 ... 303809 | arcb | | aerobic respiration control sensor protein ArcB | 1052 |
| C 303878 ... 304522 | — | | predicted uracil-DNA glycosylase | 1053 |
| C 310574 ... 311482 | bira | | BirA bifunctional protein | 1054 |
| 311609 ... 313075 | guab | | inosine-5'-monophosphate dehydrogenase | 1055 |
| 313185 ... 314756 | guaa | | glutamine-hydrolyzing GMP synthase | 1056 |
| C 314818 ... 315720 | — | | conserved hypothetical protein | 1057 |
| 315783 ... 316289 | — | | putative transcriptional regulator | 1058 |
| 316328 ... 317530 | nhaa | | Na(+)/H(+) antiporter 1 | 1059 |
| 317718 ... 319028 | brnq | | branched-chain amino acid transport system carrier protein | 1060 |
| C 319136 ... 319603 | — | | conserved hypothetical protein | 1061 |
| C 319630 ... 320076 | — | | conserved hypothetical protein | 1062 |
| 320349 ... 322478 | pnp | | polyribonucleotide nucleotidyltransferase | 1063 |
| 322560 ... 323504 | nlpL | | lipoprotein NlpI | 1064 |
| 323624 ... 325465 | deaD | | Cold-shock DEAD-box protein A homolog | 1065 |
| 325643 ... 327031 | — | | predicted soluble lytic transglycosylase fused to an ABC-type amino acid-binding protein | 1066 |
| 327036 ... 327188 | — | | conserved hypothetical protein | 1067 |
| C 327322 ... 327618 | — | | conserved hypothetical protein | 1068 |
| C 327675 ... 327884 | — | | conserved hypothetical protein | 1069 |
| C 327952 ... 328302 | arsC | | putative arsenate reductase | 1070 |
| 328381 ... 329430 | perM | | putative permease PerM homolog | 1071 |
| C 329544 ... 330521 | secF | | protein-export membrane protein SecF | 1072 |
| C 330529 ... 332379 | secD | | protein-export membrane protein SecD | 1073 |
| C 332449 ... 332742 | — | | conserved hypothetical preprotein translocase subunit YajC | 1074 |
| C 332850 ... 333071 | — | | predicted redox protein, regulator of disulfide bond formation | 1075 |
| C 333068 ... 333586 | — | | conserved hypothetical protein | 1076 |
| C 333651 ... 334799 | tgt | | queuine tRNA-ribosyltransferase | 1077 |
| C 335144 ... 336235 | quea | | S-adenosylmethionine:tRNA ribosyltransferase-isomerase | 1078 |
| C 336359 ... 336805 | — | | conserved hypothetical protein | 1079 |
| C 336948 ... 341126 | hap | ✓ | adhesion and penetration protein Hap | 1080 |
| C 341444 ... 344275 | uvra | | UvrABC system protein A | 1081 |
| 344428 ... 344934 | ssb | | Single-strand binding protein | 1082 |
| C 345112 ... 345906 | tonb | | TonB | 1083 |
| 345916 ... 346359 | exbD | | transport protein ExbD | 1084 |
| 346363 ... 346815 | exbB | | transport protein ExbB | 1085 |
| 346984 ... 347451 | bcp | | bacterioferritin comigratory protein | 1086 |
| 347552 ... 348448 | dapA | | dihydrodipicolinate synthase | 1087 |
| 348559 ... 349188 | — | | conserved hypothetical lipoprotein | 1088 |
| 349378 ... 349701 | — | | conserved hypothetical protein | 1089 |
| C 350415 ... 351353 | lgtC | | UDP-galactose--lipooligosaccharide galactosyltransferase | 1090 |
| C 351421 ... 352008 | orfM | | predicted xanthosine triphosphate pyrophosphatase | 1091 |
| C 352020 ... 352745 | kdkA | | 3-deoxy-D-manno-octulosonic acid kinase | 1092 |
| 352822 ... 353865 | opsX | | ADP-heptose--lipooligosaccharide heptosyltransferase I | 1093 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 354187...356316 | hxuC | | heme/hemopexin-binding protein C | 1094 |
| 356392...358089 | hxuB | | heme/hemopexin-binding protein B | 1095 |
| 358101...360866 | hxuA | | heme/hemopexin-binding protein A | 1096 |
| C 360962...361318 | folB | | dihydroneopterin aldolase | 1097 |
| 361401...362000 | — | | conserved hypothetical protein | 1098 |
| 362042...363745 | narQ | | sensor protein NarQ | 1099 |
| 363755...364780 | murB | | UDP-N-acetylenolpyruvoylglucosamine reductase | 1100 |
| 364906...365751 | rpoH | | RNA polymerase sigma-32 factor | 1101 |
| C 365791...366218 | dusC | ✓ | pseudogene for tRNA-dihydrouridine synthase C - | 1102 |
| C 366218...367084 | djlA | | DnaJ-like protein DjlA | 1103 |
| C 367163...367804 | pyrE | | orotate phosphoribosyltransferase | 1104 |
| C 367828...368544 | rph | | ribonuclease PH | 1105 |
| C 368845...370287 | gltX | | glutamyl-tRNA synthetase | 1106 |
| 371037...372692 | Lpt6 | | PE-tn-6--lipooligosaccharide phosphorylethanolamine transferase | 1107 |
| C 372710...373519 | rbn | | tRNA processing ribonuclease BN | 1108 |
| C 373516...374001 | — | | conserved hypothetical protein | 1109 |
| C 374004...374666 | — | | conserved hypothetical protein | 1110 |
| 374881...375660 | udp | | uridine phosphorylase | 1111 |
| C 375886...377202 | — | | conserved hypothetical metabolite transport protein | 1112 |
| C 377258...378001 | — | | conserved hypothetical protein | 1113 |
| C 378062...379768 | mend | | menaquinone biosynthesis protein MenD | 1114 |
| C 379784...381055 | menf | | menaquinone-specific isochorismate synthase | 1115 |
| 381212...382426 | Aspc3 | | probable aspartate aminotransferase | 1116 |
| 382543...383799 | mtr | | tryptophan-specific transport protein | 1117 |
| 383908...385275 | sdaa | | L-serine dehydratase | 1118 |
| C 385310...386548 | sdac | | Serine transporter | 1119 |
| C 386771...388939 | — | | probable cation-transporting ATPase | 1120 |
| C 388914...389702 | merP | | pseudogene for probable inorganic ion transport protein | 1121 |
| 389779...390165 | — | ✓ | probable heavy metal dependent transcriptional regulator | 1122 |
| C 390179...390496 | metJ | | Met repressor | 1123 |
| 390740...392002 | rho | | transcription termination factor rho | 1124 |
| C 392056...392748 | pilD | | putative type 4 prepilin-like protein specific leader peptidase | 1125 |
| C 392745...393965 | pilC | | putative type IV pilin secretion protein | 1126 |
| C 393962...395356 | pilB | | putative type IV pilin secretion protein | 1127 |
| C 395353...395802 | pilA | | Type IV pilin subunit protein | 1128 |
| 395917...396477 | ampD | | ampD | 1129 |
| 397099...397998 | corC | | magnesium and cobalt efflux protein CorC | 1130 |
| 397982...399550 | cutE | | apolipoprotein N-acyltransferase | 1131 |
| 399600...400337 | — | | conserved hypothetical RNA methyltransferase | 1132 |
| 400334...400894 | — | | conserved hypothetical protein | 1133 |
| 400894...401313 | ruvX | | putative holliday junction resolvase | 1134 |
| C 401363...402288 | — | | pseudogene for recombination associated protein RdgC, | 1135 |
| 402483...403694 | — | ✓ | prophage CP4-57-like integrase | 1136 |
| 403731...404165 | — | ✓ | hypothetical protein | 1137 |
| 404278...404700 | — | ✓ | hypothetical protein | 1138 |
| 404709...405482 | — | ✓ | hypothetical protein | 1139 |
| 406017...406208 | — | ✓ | hypothetical protein | 1140 |
| 406257...406409 | — | ✓ | hypothetical protein | 1141 |
| C 406576...407466 | — | ✓ | hypothetical protein | 1142 |
| 408127...408942 | proC | | pyrroline-5-carboxylate reductase | 1143 |
| 408942...410108 | hcaT | | probable 3-phenylpropionic acid transporter | 1144 |
| 410139...411032 | xerD | | Site-specific recombinase XerD | 1145 |
| 411205...411492 | — | | conserved hypothetical protein | 1146 |
| C 411544...412551 | ruvB | | holliday junction DNA helicase RuvB | 1147 |
| C 412559-413173 | ruvA | | holliday junction DNA helicase RuvA | 1148 |
| C 413236-413808 | ruvC | | holliday junction DNA helicase RuvC | 1149 |
| C 413885-414595 | — | | conserved hypothetical protein | 1150 |
| C 414607-415080 | ntpA | | dATP pyrophosphohydrolase | 1151 |
| C 415102-416868 | aspS | | Aspartyl-tRNA synthetase | 1152 |
| 417087-417605 | — | | conserved hypothetical protein | 1153 |
| 417658-418383 | — | | conserved hypothetical protein | 1154 |
| 418476-418712 | — | | conserved hypothetical protein | 1155 |
| 418709-419113 | — | | Predicted nucleic acid-binding domain, containsPIN domain | 1156 |
| 419180-419587 | gloA | | Lactoylglutathione lyase | 1157 |
| 419661-420350 | Rnt | | Ribonuclease T | 1158 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 420664-422016 | — | | conserved hypothetical protein | 1159 |
| 422049-422636 | — | | Predicted primosomal replication protein N | 1160 |
| C 422987-423553 | Efp | | Elongation factor P | 1161 |
| 423591-424607 | — | | Predicted lysine 2,3-aminomutase | 1162 |
| 424706-426001 | oapA | | Opacity associated protein OapA | 1163 |
| 426060-426464 | oapB | | Opacity associated protein OapB | 1164 |
| 426467-427177 | recO | | DNA repair protein RecO | 1165 |
| 427177-428493 | rumA | | 23S rRNA (uracil-5--)methyltransferase RumA | 1166 |
| 428571-430802 | relA | | GTP pyrophosphokinase | 1167 |
| 430817-431173 | dgkA | | Diacylglycerol kinase | 1168 |
| 431256-431849 | Mog | | Molybdopterin biosynthesis mog protein | 1169 |
| 431851-432189 | glnB | | Nitrogen regulatory protein P-II | 1170 |
| 432189-433235 | — | | conserved hypothetical protein | 1171 |
| C 433277-435469 | priA | | Prismosomal protein N | 1172 |
| 435554-436294 | trmB | | tRNA (guanine-N(7)-)-methyltransferase | 1173 |
| 436379-436723 | — | | conserved hypothetical protein | 1174 |
| 436929-437459 | napF | | Ferredoxin-type protein NapF | 1175 |
| 437452-437733 | napD | | NapD | 1176 |
| 437755-440253 | napA | | Periplasmic nitrate reductase | 1177 |
| 440307-441146 | napG | | Ferredoxin-type protein NapG | 1178 |
| 441146-442009 | napH | | Ferredoxin-type protein NapH | 1179 |
| 442006-442458 | napB | | Diheme cytochrome C NapB | 1180 |
| 442473-443075 | napC | | Cytochrome C-type protein NapC | 1181 |
| C 443235-443879 | Adk | | Adenylate kinase | 1182 |
| C 443964-445241 | Lic3c | | Putative integral membrane signal transducer protein | 1183 |
| C 445383-446399 | galE | | UDP-glucose 4-epimerase | 1184 |
| C 446572-447534 | Lic3A | | CMP-Neu5Ac--lipooligosaccharide alpha 2-3 sialytransferase | 1185 |
| 447933-448655 | — | | Putative ABC-type nitrate/sulfonate/bicarbonate transport system, ATPase component | 1186 |
| 448652-449389 | — | | Putative ABC-type nitrate/sulfonate/bicarbonate transport system, permease component | 1187 |
| 449411-450355 | — | | Putative ABC-type nitrate/sulfonate/bicarbonate transport system, periplasmic component | 1188 |
| 450365-451012 | — | | Putative transcription activator | 1189 |
| C 451107-451922 | hfeD | | Putative ABC-type chelated iron transport system, permease component | 1190 |
| C 451915-452763 | hfeC | | Putative ABC-type chelated iron transport system, permease component | 1191 |
| C 452767-453687 | hfeB | | Putative ABC-type chelated iron transport system, ATPase component | 1192 |
| C 453687-454568 | hfeA | | Putative periplasmic chelated iron binding protein | 1193 |
| 454874-455338 | — | ✓ | Hypothetical protein | 1194 |
| C 455430-456308 | pbpG | | Penicillin-binding protein 7 homolog precursos | 1195 |
| 456533-457705 | — | | Predicted Fe—S-cluster redox enzyme | 1196 |
| 457805-458344 | — | | Conserved hypothetical protein | 1197 |
| 458416-459327 | — | | Conserved hypothetical transcriptional regulator with an N-terminal xre-type HTH domain | 1198 |
| 459336-460442 | gcpE | | 4-hydroxy-2-methyl-2-(E)-butenyl 4-diphosphate synthase | 1199 |
| 460452-461723 | hisS | | Histidyl-tRNA synthetase | 1200 |
| 461741-462355 | — | | Conserved hypothetical protein | 1201 |
| C 462406...462600 | — | | conserved hypothetical protein | 1202 |
| C 462600-462941 | Fdx | | Feerdoxin, 2Fe—S | 1203 |
| C 462981-464840 | hscA | | Chaperone protein HscA | 1204 |
| C 464859-465545 | — | | Conserved hypothetical protein | 1205 |
| C 465596-466120 | hscB | | Co-chaperone protein HscB | 1206 |
| C 466133-466456 | — | | Conserved hypothetical protein | 1207 |
| C 466514-466894 | nifU | | NifU-like protein | 1208 |
| C 466954-468174 | nifS2 | | Cysteine sedulferase | 1209 |
| C 468235-468687 | — | | Predicted transcriptional regulator | 1210 |
| C 468740-469465 | — | | Hypothetical tRNA/rRNA methyltransferase | 1211 |
| C 469905-470366 | Pal | | Outer membrane protein P6 precursor | 1212 |
| C 470390-471673 | tolB | | TolB | 1213 |
| C 471715-472941 | tolA | | TolA | 1214 |
| C 472957-473376 | tolR | | TolR | 1215 |
| C 473447-474133 | tolQ | | TolQ | 1216 |
| C 474150-474560 | — | | Predicted thioestererase | 1217 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 474885-476807 | dinG | | Probable ATP-dependent helicase | 1218 |
| 476820-477530 | — | | Possible inactive homolog of metal-dependent proteases, putative molecular chaperone | 1219 |
| 477555 . . . 478106 | — | | possible starvation-inducible outer membrane lipoprotein | 1220 |
| 478148-479836 | lcfA | | Long chain fatty acid CoA ligase | 1221 |
| 479892-481034 | rnD | | Ribonuclease D | 1222 |
| C 481077-482945 | — | ✓ | Conserved hypothetical acyltransferase | 1223 |
| C 483019-484110 | — | | Predicted GTPase, probable translation factor | 1224 |
| C 484158-484742 | Pth | | Peptidyl-tRNA hydrolase | 1225 |
| 484925-485233 | — | | Conserved hypothetical protein | 1226 |
| 485236-486450 | — | | Conserved hypothetical cupin superfamily metalloenzyme | 1227 |
| 486452-487771 | xseA | | Exodeoxyribonuclease VII large subunit | 1228 |
| 487948-488601 | adpP | | ADP-ribose pyrophoaphatase | 1229 |
| 488611-489435 | Icc | | Predicted phosphohydrolase | 1230 |
| C 489533-489820 | — | | Conserved hypothetical protein | 1231 |
| 490017-491393 | ompP1 | | Outer membrane protein P1 precursor | 1232 |
| 491439-492008 | Ogt | | Methylated-DNA-protein-cysteine | 1233 |
| 492005-492676 | mutH | | DNA mismatch repair protein MutH | 1234 |
| C 492684-493976 | mesJ | | Putative cell cycle protein MesJ | 1235 |
| C 493976-494080 | — | | Pseudogene for pyridoxamine kinase | 1236 |
| C 494153-495100 | accA | | Acetyl-coenzyme A carboxylase carboxyl transferase subunit alpha | 1237 |
| C 495189-495974 | znuB | | High affinity zinc uptake system membrane protein ZnuB | 1238 |
| C 495974-496780 | znuC | | High-affinity zinc uptake system ATP binding protein AnuC | 1239 |
| 495652-498379 | — | | Conserved hypothetical metalloprotease | 1240 |
| 498494-499450 | tyrR | | Transcriptional regulatory protein TyrR | 1241 |
| C 499546-499821 | hfq | | host factor-I protein Hfq | 1242 |
| C 499912-500907 | rluC | | ribosomal large subunit pseudouridine synthase C | 1243 |
| 501253-504108 | rne | | ribonuclease E | 1244 |
| 504340-504552 | — | | Conserved hypothetical protein | 1245 |
| 504876-505673 | thiM | | hydroxyethylthiazole kinase | 1246 |
| 505666-506475 | thiD | | phosphomethylpyrimidine kinase | 1247 |
| 506486-507166 | thiE | | thiamine-phosphate pyrophosphorylase | 1248 |
| 507150-508454 | — | | Conserved hypothetical metabolite transport | 1249 |
| C 508466-508567 | — | | hypothetical protein | 1250 |
| 508623-510002 | — | | putative protease | 1251 |
| C 510036-511355 | srmB | | ATP-dependent RNA helicase SrmB | 1252 |
| 511401-512123 | — | | predicted O-methyltransferase | 1253 |
| C 512154-512759 | — | | pseudogene for conserved hypothetical tRNA/rRNA methyltransferase | 1254 |
| 512906-514273 | pssA | | CDP-diacylglycerol--serine O-phosphatidyltransferase | 1255 |
| C 514319-515044 | fadR | | fatty acid metabolism regulator protein | 1256 |
| 515145-516713 | nhaB | | Na(+)/H(+) antiporter 2 | 1257 |
| 516723-517256 | dsbB | | disulfide bond formation protein B | 1258 |
| C 517311-519143 | glmS | | glucosamine--fructose-6-phosphate aminotransferase | 1259 |
| C 519256-519666 | hupA | | DNA-binding protein HU | 1260 |
| C 519668-520258 | — | | conserved hypothetical protein | 1261 |
| C 520294-521088 | nudC | | NADH pyrophosphatase | 1262 |
| C 521155-521751 | orfG | | conserved hypothetical 21.9 KD protein in locus involved in transformation | 1263 |
| C 521827-522513 | comF | | competence protein F | 1264 |
| C 522526-523863 | comE | | competence protein E | 1265 |
| C 523873-524283 | comD | | competence protein D | 1266 |
| C 524283-524804 | comC | | competence protein C | 1267 |
| C 524801-525307 | comB | | competence protein B | 1268 |
| C 525308-526105 | comA | | competence protein A | 1269 |
| 526204-528798 | mrcA | | penicillin-binding protein 1A | 1270 |
| 528871-529716 | — | | conserved hypothetical protein | 1271 |
| 529849-530214 | — | | conserved hypothetical protein | 1272 |
| 530345-530947 | recR | | recombination protein RecR | 1273 |
| 530963-532918 | topB | | DNa topoisomerase III | 1274 |
| 533027-533368 | secG | | protein-export membrane protein SecG | 1275 |
| C 533913-535583 | fruA | | PTS system, fructose-specific IIBC component | 1276 |
| C 535585-536526 | fruK | | 1-phosphofructokinase | 1277 |
| C 536528-538027 | fruB | | PTS system, fructose-specific IIA/FPr component | 1278 |
| C 538099-538635 | — | | conserved hypothetical protein | 1279 |
| C 538722-539000 | vapD | | virulence-associated protein D | 1280 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 539009-539200 | vapX | | VapX | 1281 |
| C 539272-540570 | — | | conserved hypothetical protein | 1282 |
| C 540621-541145 | — | | conserved hypothetical protein | 1283 |
| C 541172-541954 | — | | putative deoxyribonuclease | 1284 |
| C 542009-542992 | holB | | DNA polymerase III, delta subunit | 1285 |
| C 542989-543117 | — | ✓ | hypothetical protein | 1286 |
| 543192-545315 | lav | ✓ | autotransported protein Lav | 1287 |
| C 546221-546880 | tmk | | thymidylate kinase | 1288 |
| C 546870-547913 | — | | predicted periplasmic solute-binding protein | 1289 |
| C 547983-548924 | surA | | survival protein SurA homolog | 1290 |
| C 548994-549533 | pyrR | | PyrR bifunctional protein | 1291 |
| 549665-550456 | mazG | | predicted pyrophosphatase MazG | 1292 |
| C 550506-551381 | — | | conserved hypothetical protein | 1293 |
| 551574-553985 | lon | | ATP-dependent protease La | 1294 |
| 554102-555253 | — | | predicted Fe—S oxidoreductase | 1295 |
| 555387-556046 | rpiA | | ribose 5-phosphate isomerase A | 1296 |
| 556076-557308 | serA | | D-3-phosphoglycerate dehydrogenase | 1297 |
| C 557351-558193 | — | | predicted aminomethyltransferase related to GcvT | 1298 |
| C 558203-559066 | — | | conserved hypothetical stress-induced protein | 1299 |
| 559515-560426 | hisG | | ATP phosphoribosyltransferase | 1300 |
| 560519-561802 | hisD | | histidinol dehydrogenase | 1301 |
| 561871-562974 | hisC | | hisitidinol-phosphate aminotransferase 1 | 1302 |
| 563086-564174 | hisB | | histidine biosynthesis bifunctional protein HisB | 1303 |
| 564240-564839 | hisH | | imidazole glycerol phosphate synthase subunit HisH | 1304 |
| 564875-565624 | hisA | | 1-5-[methylideneamino] imidazole-4-carboxamine isomerase | 1305 |
| 565606-566382 | hisF | | imidazole glycerol phosphate synthase subunit HisF | 1306 |
| 566382-567047 | hisI | | histidine biosynthesis bifunctional protein hisIE | 1307 |
| 567129-567281 | — | | conserved hypothetical protein | 1308 |
| 567311-568513 | tyrP | | tyrosine-specific transportprotein 1 | 1309 |
| C 568699-569127 | atpC | | ATP synthase epsilon chain | 1310 |
| C 569157-570530 | atpD | | ATP gathase beta chain | 1311 |
| C 570547-571416 | atpG | | ATP synthase gamma chain | 1312 |
| C 571432-572973 | atpA | | ATP synthase alpha chain | 1313 |
| C 572986-573519 | atpH | | ATP synthase delta chain | 1314 |
| C 573532-574002 | atpF | | ATP synthase B chain | 1315 |
| C 574052-574306 | atpE | | ATP cynthase C chain | 1316 |
| C 574362-575150 | atpB | | ATP synthase A chain | 1317 |
| C 575187-575561 | — | | predicted F0F1-type ATP synthase subunit I | 1318 |
| C 575687-576298 | gidB | | methyltransferase GidB | 1319 |
| C 576438-576815 | — | | conserved hypothetical protein | 1320 |
| 576931-577533 | — | | predicted phosphatase/phosphohexomutase | 1321 |
| 577533-578006 | — | | predicted membrane protein | 1322 |
| 578191-578694 | luxS | | S-ribosylhomocysteinase | 1323 |
| C 579638-580345 | aphA | | Class B acid phosphatase | 1324 |
| 580565-581092 | hslV | | ATP-dependent protease HslV | 1325 |
| 581103-582437 | hslU | | HslU, ATP-dependent chaperone of the HslUV protease | 1326 |
| C 582507-583559 | ptoD2 | | spermidine/putrescine-binding periplasmic protein 2 precursor | 1327 |
| 583699-584664 | ordL | | probable oxidoreductase OrdL | 1328 |
| 585158-586600 | rmuC | | DNA recombination protein RmuC | 1329 |
| 586764-587183 | rbsD | | ribose transport permease protein | 1330 |
| 587197-588678 | rbsA | | ribose transport ATP-binding protein | 1331 |
| 588691-589662 | rbsC | | ribose transport permease protein | 1332 |
| 589682-590560 | rbsB | | ribose-binding periplasmic protein | 1333 |
| 590658-591578 | rbsK | | ribokinase | 1334 |
| 591606-592604 | rbsR | | ribose operon repressor | 1335 |
| 592710-893261 | — | | predicted membrane protein | 1336 |
| C 593401-593889 | menG | | S-adenosylmethionine:2-demtyhylmenaquinone methyltransferase | 1337 |
| C 593491-594873 | menA | | 1,4-dihydroxy-2-naphthoate octaprenyltransferase | 1338 |
| 594920-595639 | — | | conserved hypothetical protein | 1339 |
| C 595692-596678 | tehA | | tellurite resistance protein | 1340 |
| C 596830-601080 | rpoC | | DNA-directed RNA polymerase beta' chain | 1341 |
| C 601287-605318 | rpoB | | DNA-directed RNA polymerase beta chain | 1342 |
| C 605702-606391 | rplA | | 50S ribosomal protein L1 | 1343 |
| C 606396-606824 | rplK | | 50S ribosomal protein L11 | 1344 |
| C 606997-607713 | deoD | | purine nucleoside phosphorylase | 1345 |
| C 607797-609050 | — | | predicted nucleoside permease | 1346 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 609149-609937 | — | | predicted pyruvate-formate lyase-activating enzyme | 1347 |
| C 609946-611490 | — | | conserved hypothetical glycyl radical protein | 1348 |
| 611703-612359 | — | | predicted membrane protein | 1349 |
| C 612315-613385 | waaQ | | ADP-heptose--lipooligosaccharide heptosyltransferase III | 1350 |
| C 613423-614502 | fba | | frustose-biphosphate aldolase | 1351 |
| C 614613-615773 | pgk | | phosphoglycerate kinase | 1352 |
| C 615869-616663 | — | | probable rubonuclease I | 1353 |
| 616741-617001 | — | | putative ferredoxin-like protein | 1354 |
| C 617135-618355 | tyrQ | | tyrosine-specific transport protein 2 | 1355 |
| C 618392-618973 | tdk | | thymidine kinase | 1356 |
| C 618982-620010 | gcp | | probable O-sialoglycoprotein endopeptidase | 1357 |
| 620242-620457 | rpsU | | 30S ribosomal protein S21 | 1358 |
| 620591-622372 | — | | DNA primase | 1359 |
| 622443-624314 | rpoD | | DNA polymerase sigma factor RpoD | 1360 |
| C 624624-626051 | aspA | | aspartate ammonia-lyase | 1361 |
| C 626198-627013 | ureH | | urease accessory protein UreH | 1362 |
| C 627088-627765 | ureG | | urease accessory protein UreG | 1363 |
| C 627868-628575 | ureF | | urease accessory protein UreF | 1364 |
| C 628560-629117 | ureE | | urease accessory protein UreE | 1365 |
| C 629245-630963 | ureC | | urease alpha subunit | 1366 |
| C 630975-631280 | ureB | | urease beta subunit | 1367 |
| C 631357-631659 | ureA | | urease gamma subunit | 1368 |
| 631822-632112 | groES | | 10 kDa chaperonin | 1369 |
| 632135-633772 | groEL | | 60 kDa chaperonin | 1370 |
| C 633946-634395 | rplI | | 50S ribosomal protein L9 | 1371 |
| C 634412-634639 | rpsR | | 30S ribosomal protein S18 | 1372 |
| C 634652-634798 | priB | | primsomal replication protein N | 1373 |
| C 634965-635342 | rpsF | | 30S ribosomal protein S6 | 1374 |
| C 635534-635788 | infA | | translation initiation factor IF-1 | 1375 |
| 635963-637037 | lic2C | ✓ | pseudogene for UDP-glucose--lipooligosaccharide glucosyltransferase | 1376 |
| 637121-637987 | ksgA | | dimethyladenosine transferase | 1377 |
| C 638024-638962 | lic2A | | UDP-Gal--lipooligosaccharide galactosyltransferase | 1378 |
| 639015-639842 | apaH | | bis-tetraphosphatase, symmetrical | 1379 |
| 639852-640475 | — | | conserved hypothetical protein | 1380 |
| C 640601-642055 | gnd | | 6-phosphogluconate dehydrogenase decarboxylating | 1381 |
| C 642171-642713 | — | | conserved hypothetical protein | 1382 |
| C 642796-642984 | — | | conserved hypothetical protein | 1383 |
| C 643054-643791 | devB | | 6-phosphgluconolactonase | 1384 |
| C 643895-645379 | zwf | | glucose-6-phosphate 1-dehydrogenase | 1385 |
| C 645455-646264 | cysQ | | cysQ | 1386 |
| C 646269-646685 | — | | conserved hypothetical protein | 1387 |
| C 646742-648724 | — | | predicted membrane protein | 1388 |
| 648953-649348 | hslR | | heat shock protein 15 homolog | 1389 |
| C 649374-649826 | asnC | | regulatory protein AsnC | 1390 |
| 649980-650972 | asnA | | aspartate--ammonia ligase | 1391 |
| 651035-651388 | — | ✓ | conserved hypothetical transposase-like protein | 1392 |
| 652001-652858 | — | ✓ | hypothetical protein | 1393 |
| C 653015-653131 | — | ✓ | hypothetical protein | 1394 |
| 653423-653563 | — | ✓ | hypothetical protein | 1395 |
| C 653743-654417 | gph | | phosphoglycolate phosphatase | 1396 |
| C 654463-655167 | rpe | | ribulose-phosphate 3-epimerase | 1397 |
| C 655289-657709 | gyrB | | DNA gyrase subunit B | 1398 |
| C 657835-660147 | — | | predicted transcriptional accessory protein | 1399 |
| 660243-660719 | greB | | transcription elongation factor GreB | 1400 |
| C 660789-661406 | — | | conserved hypothetical transcriptional regulator | 1401 |
| C 661406-662311 | oxyR | | hydrogen peroxide-inducible genes activator | 1402 |
| 662434-663159 | pdgC | | peroxiredoxin•glutaredoxin | 1403 |
| C 663251-663472 | slyX | | slyX | 1404 |
| 663570-664295 | fkby | | probably FKBP-type peptidyl-proyl cis-trans isomerase | 1405 |
| 664385-665050 | — | | conserved hypothetical protein | 1406 |
| 665050-665430 | — | | uncharacterized conserved protein involved in intracellular sulfur reduction | 1407 |
| 665427-665786 | — | | uncharacterized conserved protein involved in oxidation of intracellular sulfur | 1408 |
| 665795-666082 | — | | uncharacterized conserved protein involved in oxidation of intracellular sulfur | 1409 |
| C 666213-667397 | tufB | | elongation factor Tu | 1410 |
| 668103-669026 | coaA | | pantothenate kinase | 1411 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 669117-670064 | rseB | | sigma-E factor regulatory protein RseB | 1412 |
| C 670144-670719 | rseA | | sigma-E factor negative regulator protein homolog | 1413 |
| C 670744-671313 | rpoE | | RNA polymerase sigma-E factor | 1414 |
| C 671422-671679 | — | | conserved hypothetical protein | 1415 |
| C 671769-672155 | mscL | | large-conductance mechanosensitive channel | 1416 |
| C 672228-673604 | trkA | | Trk system potassium uptake protein TrkA | 1417 |
| C 673617-674969 | sun | | SUN protein | 1418 |
| C 674969-675925 | fmt | | methionyl-tRNA formyltransferase | 1419 |
| C 676026-676535 | def | | peptide deformylase | 1420 |
| 676725-677162 | — | ✓ | hypothetical protein | 1421 |
| 677140 . . . 677325 | — | ✓ | hypothetical protein | 1422 |
| C 683606-684259 | sxy | | DNA transformation protein TfoX | 1423 |
| 684631-685695 | recA | | RecA | 1424 |
| 685774-686232 | recX | | regulatory protein RecX | 1425 |
| C 686229-686615 | crcB | | CrcB | 1426 |
| C 686615-687433 | — | | predicted hydrolase of the HAD superfamily | 1427 |
| 687836-688840 | argF | | ornithine carbamoyltransferase, catabolic | 1428 |
| 688850-689782 | arcC | | carbamate kinase | 1429 |
| 689887-691416 | — | | predicted membrane protein | 1430 |
| C 691826-694980 | hgpD | ✓ | pseudogene for hemoglobin-haptoglobin binding protein D | 1431 |
| 696052-696756 | pepE | | peptidase E | 1432 |
| 696774-698069 | — | | predicted C4-dicarboxylate transporter | 1433 |
| 698141-699412 | abgA | | aminobenzoyl-glutamate utilization protein A | 1434 |
| 699505-701478 | cpdB | | 2',3'-cyclic-nucleotide 2'-phosphodiesterase | 1435 |
| C 701587-701994 | — | ✓ | HTH-type transcriptional regulator | 1436 |
| C 702004-702681 | — | ✓ | zinc transported ZitB | 1437 |
| 703189-705078 | gidA | | glucose inhibited division protein A | 1438 |
| 705260-705634 | rpsL | | 30S ribosoomal protein S12 | 1439 |
| 705791-706261 | rpsG | | 30S ribosomal protein S7 | 1440 |
| 706345-708447 | fusA | | elongation factor G | 1441 |
| 708512-709696 | tufB2 | | elongation factor Tu | 1442 |
| 710156-710500 | — | ✓ | predicted chloride channel protein | 1443 |
| 710491-710673 | — | | predicted chloride channel protein | 1444 |
| 710676-711659 | dusA | | tRNA-dihydrouridine synthase A | 1445 |
| C 711707-711997 | — | | conserved hypothetical protein | 1446 |
| C 712020-713030 | trpS | | tryptophanyl-tRNA synthetase | 1447 |
| 713153-713770 | — | | predicted protein involved in purine metabolism | 1448 |
| 713793-715163 | purB | | adenylosuccinate lyase | 1449 |
| 715435-715926 | rplJ | | 50S ribosomal protein L10 | 1450 |
| 715981-716532 | rplL | | 50S ribosomal protein L7/L12 | 1451 |
| 716511-717881 | glmU | | bifunctional GlmU protein | 1452 |
| C 717916-718227 | — | | hypothetical protein | 1453 |
| C 718766-719701 | pldB | | probable lysophospholipase L2 | 1454 |
| C 719755-720820 | asd | | aspartate-semialdehyde dehydrogenase | 1455 |
| C 721036-721752 | — | | conserved hypothetical protein | 1456 |
| 721944-722600 | — | ✓ | predicted 2-methylthioadenine synthetase | 1457 |
| C 722664-723242 | mdaB | | putative NADPH-quinone reductase, modulator of drug activity B | 1458 |
| 723521-725533 | rep | | ATP-dependent DNA helicase rep | 1459 |
| C 725539-725751 | — | | predicted periplasmic lipoprotein | 1460 |
| C 725748-726218 | kdtB | | phosphopantetheine adenylyltransferase | 1461 |
| C 726215-727498 | kdtA | | 3-deoxy-D-manno-octulosonic acid transferase | 1462 |
| 727561-728325 | lgtF | | UDP-glucose--lipooligosaccharide glucosyltransferase | 1463 |
| C 728322-728885 | tag | | DNA-3-methyladenine glycolase | 1464 |
| C 729000-729752 | — | ✓ | hypothetical protein | 1465 |
| C 729764-730570 | aroE | | shikimate 5-dehydrogenase | 1466 |
| C 730574-731125 | | | predicted translation factor SUA5 | 1467 |
| C 731141-731677 | — | | Zn-finger domain associated with topoisomerase typr I | 1468 |
| C 731687-733603 | — | | probable ABC transporter, ATP binding protein | 1469 |
| C 733788-734084 | — | | putative HTH-type transcriptional regulator | 1470 |
| C 734077-734259 | — | ✓ | conserved hypothetical protein | 1471 |
| C 734529-737507 | hgpB | ✓ | hemoglobin-haptoglobin binding protein B | 1472 |
| 738238-739983 | — | | hypothetical ABC transporter, ATP-binding protein | 1473 |
| 739976-741634 | — | | probable ABC transporter, ATP binding protein | 1474 |
| C 741718-742749 | — | | conserved hypothetical protein | 1475 |
| C 742746-743066 | — | | conserved hypothetical protein | 1476 |
| C 743054-743362 | — | | putative HTH-type transcriptional regulator | 1477 |
| C 743567-744568 | glpX | | fructose-1,6-bisphosphatase class II GlpX | 1478 |
| 744730-744948 | — | | conserved hypothetical protein | 1479 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 745047-745487 | mioC | | MioC | 1480 |
| 745484-745918 | dtd | | D-tyrosyl-tRNA (Tyr) deacylase | 1481 |
| C 746225-746701 | ispF | | 3-C-methyl-D-erythritol 2,4-cyclodiphosphate synthase | 1482 |
| C 746698-747375 | ispD | | 2-C-methyl-D-erythritol 4-phosphate cytidylyltransferase | 1483 |
| C 747375-747653 | ftsB | | cell division protein FtcB | 1484 |
| C 747776-748243 | gpt | | xanthine-guanine phosphoribosyltransferase | 1485 |
| 748354-749808 | pepD | | aminoacyl-histidine dipeptidase | 1486 |
| C 749861-750748 | xerC | | site-specific recombinase XerC | 1487 |
| C 750742-751182 | — | | conserved hypothetical protein | 1488 |
| 751348-752138 | tpiA | | triosephosphate isomerase | 1489 |
| C 752221-752538 | glpE | | thiosulfate sulfurtransferase GlpE | 1490 |
| C 752539-753417 | — | | conserved hypothetical protein | 1491 |
| C 753449-754327 | ilvY | | HTH-type transcriptional activator IlvY | 1492 |
| 755011-756489 | ilvC | | ketol-acid reductoisomerase | 1493 |
| C 756600-757880 | glpC | | anaerobic glycerol-3-phosphate dehydrogenase subunit C | 1494 |
| C 757891-759189 | glpB | | anaerobic glycerol-3-phosphate dehydrogenase subunit B | 1495 |
| C 759179-760870 | glpA | | anaerobic glycerol-3-phosphate dehydrogenase subunit A | 1496 |
| 761163-762605 | glpT | | glycerol-3-phosphate transporter | 1497 |
| 762709-763803 | glpQ | | glycerophosphoryl diester phosphodiesterase precursor | 1498 |
| 764033-764827 | glpF | | glycerol uptake facilitator protein | 1499 |
| 764848-766359 | glpK | | glycerol kinase | 1500 |
| C 766443-766910 | gpt2 | | xanthine-guanine phosphoribosyltransferase | 1501 |
| 766932-767069 | — | | pseudogene for glycerophosphoryl diester phosphodiesterase precursor | 1502 |
| 767195-768019 | hel | | outer membrane protein P4, NADP phosphatase | 1503 |
| 768186-768869 | rluE | | ribosomal large subunit pseudouridine synthase E | 1504 |
| C 768998-770002 | ppx | | pseudogene for putative exopolyphosphatase | 1505 |
| C 769974-773858 | — | | conserved hypothetical protein | 1506 |
| C 773868-775604 | — | | conserved hypothetical protein | 1507 |
| C 775755-776327 | slyD | | FKBP-type peptidyl-prolyl cis-trans isomerase SlyD | 1508 |
| C 776405-776827 | — | | conserved hypothetical protein | 1509 |
| 776936-777955 | truD | | tRNA pseudouridine synthase D | 1510 |
| 777965-778714 | surE | | acid phosphatase surE | 1511 |
| 778723-779301 | — | | conserved hypothetical protein | 1512 |
| 779310-779495 | — | | conserved hypothetical protein | 1513 |
| 779530-780747 | lppB | | outer membrane antigenic lipoprotein B | 1514 |
| 781115-782533 | tnaA | ✓ | tryptophanase | 1515 |
| 782617-783849 | tnaB | ✓ | tryptophan-specific transport protein | 1516 |
| 783990-786575 | mutS | | DNA mismatch repair protein MutS | 1517 |
| 786781-788166 | selA | | L-seryl-tRNA selenium transferase | 1518 |
| 788163-790022 | selB | | selenocysteine-specific elongation factor | 1519 |
| 790041-790895 | — | ✓ | hypothetical protein | 1520 |
| 791015-791311 | — | | conserved hypothetical protein | 1521 |
| 791311 . . . 791619 | — | | conserved hypothetical protein | 1522 |
| C 791676-794868 | hgpC | ✓ | pseudogene for hemoglobin-haptoglobin utilization protein C | 1523 |
| 795165-796463 | tig | | trigger factor | 1524 |
| 796586-797167 | clpP | | ATP-dependent clp protease proteolytic subunit | 1525 |
| 797177-798412 | clpX | | ATP-dependent Clp protease ATP-binding subunit ClpX | 1526 |
| 798557-798973 | secE | | preprotein translocase SecE | 1527 |
| 798975-799532 | nusG | | transcription antitermination protein NusG | 1528 |
| 799683-800435 | vacJ | | VacJ lipoprotein | 1529 |
| 800489-800881 | — | | putative translation initiation inhibitor YjgF family | 1530 |
| 801049-801900 | htpX | | probable protease HtpX | 1531 |
| C 801942-802223 | sirA | | SirA | 1532 |
| 802297-802917 | — | | conserved hypothetical protein | 1533 |
| 802290-804383 | trkH | | Trk system potassium uptake protein TrkH | 1534 |
| 810818-811237 | psiE | | PsiE | 1535 |
| C 811301-812587 | hemY | | HemY | 1536 |
| C 812598-813809 | hemX | | putative uroporphyrin-III C-methyltransferase | 1537 |
| 814115-816646 | cya | | adenylate cyclase | 1538 |
| 816720-717727 | gpsA | | glycerol-3-phosphate dehydrogenase | 1539 |
| 817744-818547 | cysE | | serine acetyltransferase | 1540 |
| 818557-819372 | — | | conserved hypothetical shikimate 5-dehydrogenase-like protein | 1541 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 819510-820895 | — | | possible di- and tricarboxylate transporter | 1542 |
| C 821033-821881 | folD | | FolD bifunctional protein | 1543 |
| C 822409-823695 | fucP | | L-fucose permease | 1544 |
| C 823734-824384 | fucA | | L-fuculose phosphate aldolase | 1545 |
| C 824404-824838 | fucU | | fucose operon protein FucU | 1546 |
| C 824852-826264 | fucK | | L-fuculokinase | 1547 |
| C 826337-828151 | fucI | | L-fucose isomerase | 1548 |
| C 828336-829085 | fucR | | L-fucose operon activator | 1549 |
| 829284-832055 | hepA | | RNA polymerase associated protein homolog | 1550 |
| 832058-832717 | rluA | | ribosomal large subunit pseudouridine synthase A | 1551 |
| 832744-833322 | glpG | | GlpG | 1552 |
| 833352-834119 | glpR | | glycerol-3-phosphate regulon repressor | 1553 |
| C 834421-835242 | metQ | | probable D-methionine-binding lipoprotein MetQ | 1554 |
| C 835281-835970 | metI | | probable D-methionine transport system permease protein | 1555 |
| C 835960-836997 | metN | | probable D-methionine transport ATP-binding protein | 1556 |
| 837173-837727 | — | | conserved hypothetical protein | 1557 |
| 843979-844539 | — | | conserved hypothetical protein | 1558 |
| 844543-844983 | — | | conserved hypothetical protein | 1559 |
| C 845045-845671 | narP | | nitrate/nitrite response regulator protein | 1560 |
| C 845877-847124 | lysA | | diaminopimelate decarboxylase | 1561 |
| C 847172-847303 | — | | hypothetical protein | 1562 |
| 847386-847691 | cyaY | | CyaY | 1563 |
| 847693-849552 | recQ | | ATP-dependent DNA helicase RecQ | 1564 |
| 849637-851355 | proS | | prolyl-tRNA synthetase | 1565 |
| C 851443-853791 | ostA | | organic solvent tolerance protein | 1566 |
| C 853914-855323 | sufI | | SufI | 1567 |
| C 855325-856047 | plsC | | 1-acyl-sn-glycerol-3-phosphate acyltransferase | 1568 |
| 856133-856846 | lpxH | | UDP-2,3-diacylglucosamine hydrolase | 1569 |
| C 857076-858602 | — | | conserved hypothetical sodium dependent transporter | 1570 |
| 858849-859475 | ilvG | | acetolactate synthase isozyme II large subunit | 1571 |
| 859517-861355 | ilvD | | dihydroxy-acid dehydratase | 1572 |
| 861435-862976 | thd1 | | threonine dehydratase biosynthetic | 1573 |
| 863014-866493 | dnaE | | DNA polymerase III alpha subunit | 1574 |
| 866732-868375 | pgmB | | phosphoglucomutase | 1575 |
| C 868542-869051 | secB | | protein-export protein SecB | 1576 |
| C 869065-869511 | — | | predicted rhodanese-related sulfurtransferase | 1577 |
| 869759-871081 | dcuB | | anaerobic C4-dicarboxylate transporter DcuB | 1578 |
| 871285-872619 | ndhA | | NADH dehydrogenase | 1579 |
| C 872699-875131 | plsB | | glycerol-3-phosphate acyltransferase | 1580 |
| 875380-876006 | lexA | | LexA repressor | 1581 |
| 876152-876976 | dapF | | diaminopimelate epimerase | 1582 |
| 877196-877693 | tpx | | probable thiol peroxidase | 1583 |
| 878256-882218 | purL | | phosphoribosylformylglycinamidine synthase | 1584 |
| 882414-882652 | lex2A | ✓ | pseudogene for Lex2A homolog | 1585 |
| 882724-883467 | lex2B | ✓ | UDP-glucose--lipooligosaccharide glucosyltransferase | 1586 |
| C 883528-884370 | — | | conserved hypothetical protein | 1587 |
| C 884370-885602 | — | | predicted membrane-bound metallopeptidase | 1588 |
| 885778-886461 | gpmA | | 2,3-bisphosphoglycerate-dependent phsphoglycerate mutase | 1589 |
| C 886539-886751 | rpL31 | | 50S ribosomal protein L31 | 1590 |
| 886928-888064 | mutY | | A/G-specific adenine glycosylase | 1591 |
| 888042-888314 | — | | conserved hypothetical protein | 1592 |
| 888329-889402 | mltC | | membrane-bound lytic murein transglycolase C precursor | 1593 |
| C 890013-890693 | — | | predicted diadenosine tetraphosphatase and related serine/threonine protein phosphatase | 1594 |
| C 890690-891955 | nadR | | bifunctional protein NadR | 1595 |
| 892174-892821 | ribB | | 3,4-dihydroxy-2-butanone 4-phosphate synthase | 1596 |
| 892836-892684 | lpsA | | lipooligosaccharide glycosyl transferase | 1597 |
| C 893733-894215 | — | | conserved hypothetical tRNA/rRNA methyltransferase | 1598 |
| C 894225-894806 | — | | predicted N6-adenine-specific methylase | 1599 |
| 894861-896105 | FtsY | | cell division protein FtsY | 1600 |
| 896124-896780 | ftsE | | cell division ATP-binding protein EtsE | 1601 |
| 896790-897722 | ftsx | | cell division protein ftsx | 1602 |
| C 897817-898998 | atoB | | acetyl-CoA acetyltransferase | 1603 |
| C 899013-900356 | atoE | | short chain fatty acids transporter | 1604 |
| C 900359-901024 | atoA | | acetate CoA-transferase beta subunit | 1605 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 901035-901688 | atoD | | acetate CoA-transferase alpha subunit | 1606 |
| 901894-902841 | — | | putative HTH-type transcriptional regulator | 1607 |
| 903078-903389 | rpsJ | | 30S ribosomal protein S10 | 1608 |
| 903406-904032 | rplC | | 50S ribosomal protein L3 | 1609 |
| 904048-904650 | rplD | | 50S ribosomal protein L4 | 1610 |
| 904647-904946 | rplW | | 50S ribosomal protein L23 | 1611 |
| 904964-905785 | rplB | | 50 S ribosomal protein L2 | 1612 |
| 905811-906086 | rpsS | | 30S ribosomal protein S19 | 1613 |
| 906098-906430 | rplV | | 50S ribosomal protein L22 | 1614 |
| 906448-907155 | rpsC | | 30S ribosomal protein S3 | 1615 |
| 607169-907579 | rplP | | 50S ribosomal protein L16 | 1616 |
| 907579-907770 | rpmC | | 50S ribosomal protein L29 | 1617 |
| 907770-908027 | rpsQ | | 30S ribosomal protein S17 | 1618 |
| 908417-909040 | — | | conserved hypothetical protein | 1619 |
| 909321-909692 | rplN | | 50S ribosomal protein L14 | 1620 |
| 909703-910014 | rplX | | 50S ribosomal protein L24 | 1621 |
| 910032-910571 | rplE | | 50S ribosomal protein L5 | 1622 |
| 910583-910888 | rpsN | | 30S ribosomal protein S14 | 1623 |
| 910925-911317 | rpsH | | 30S ribosomal protein S8 | 1624 |
| 911333-911866 | rplF | | 50S ribosomal protein L6 | 1625 |
| 911880-912233 | rplR | | 50S ribosomal protein L18 | 1626 |
| 912248-912748 | rpsE | | 30S ribosomal protein S5 | 1627 |
| 912755-912934 | rpmD | | 50S ribosomal protein L30 | 1628 |
| 912938-913372 | rplO | | 50S ribosomal protein L15 | 1629 |
| 913380-914705 | secY | | preprotein translocase SecY subunit | 1630 |
| 914987-915343 | rpsM | | 30S ribosomal protein S13 | 1631 |
| 915359-915748 | rpsK | | 30S ribosomal protein S11 | 1632 |
| 915776-916396 | rpsD | | 30S ribosomal protein S4 | 1633 |
| 916428-917414 | rpoA | | DNA-directed RNA polymerase alpha chain | 1634 |
| 917455-917841 | rplQ | | 50S ribosomal protein L17 | 1635 |
| C 917968-918564 | — | | predicted cAMP-binding protein - catabolite gene activator and regulatory subunit of cAMP-dependent protein kinase | 1636 |
| C 918683-919383 | — | | pseudogene for conserved hypothetical protein, predicted arylsulfatase regulator, Fe—S oxidoreductase | 1637 |
| 919587-920326 | — | | predicted permease | 1638 |
| C 920358-921551 | dxr | | 1-deoxy-D-xylulose 5'phosphate reductoisomerase | 1639 |
| C 921661-922218 | frr | | ribosome recycling factor | 1640 |
| C 922370-923986 | pckA | | phosphoenolpyruvate carboxykinase | 1641 |
| C 924159-925040 | hslO | | 33 kDa chaperonin | 1642 |
| C 925185-926558 | argH | | argininosuccinate lyase | 1643 |
| C 926693-927580 | galU | | UTP-glucose-1-phosphate uridylyltransferase | 1644 |
| C 927602-927793 | csrA | | carbon storage regulator homolog | 1645 |
| C 927871-930495 | alaS | | alanyl-tRNA synthetase | 1646 |
| C 930682-931107 | uspA | | universal stress protein A | 1647 |
| C 931209-932501 | pepP | | Xaa-Pro aminopeptidase | 1648 |
| C 932513-933061 | — | | conserved hypothetical protein | 1649 |
| C 933232-934257 | galM | | aldose 1-epimerase | 1650 |
| C 934264-935460 | galK | | glactokinase | 1651 |
| C 935495-936544 | galT | | galactose-1-phosphate uridylyltransferase | 1652 |
| 936752-937750 | galR | | HTH-type transcriptional regulator GalR | 1653 |
| 937841-938890 | mglB | | D-galactose-binding periplasmic protein precursos | 1654 |
| 938956-940476 | mglA | | galactoside transport ATP-binding protein MglA | 1655 |
| 940493-941503 | mglC | | galactoside transport system permease protein MglC | 1656 |
| 941649-942383 | — | | conserved hypothetical protein | 1657 |
| 942389-942946 | ispZ | | probable intracellular septation protein A | 1658 |
| 942946-943410 | — | | putative acyl-CoA thioester hydrolase | 1659 |
| 943427-943723 | — | | conserved hypothetical protein | 1660 |
| 943739-945520 | slt | | putative soluble lytic murein transglycosylase | 1661 |
| 945558-945863 | trpR | | Trp operon repressor | 1662 |
| 946006-946590 | mtgA | | monofuctional biosynthetic peptidoglycan transglycolase | 1663 |
| C 946696-947040 | frdD | | fumarate reductase subunit D | 1664 |
| C 947053-947463 | frdC | | fumarate reductase subunit C | 1665 |
| C 947474-948244 | frdB | | fumarate reductase iron-sulfur protein | 1666 |
| C 948327-950036 | frdA | | fumarate reductase flavoprotein subunit | 1667 |
| 950217-951218 | genX | | putative lysyl-tRNA synthetase | 1668 |
| C 951484-952167 | cpxR | | transcriptional regulatory protein CpxR | 1669 |
| C 952221-952634 | smpA | | small protein A | 1670 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 952700-953725 | ndpA | | nucleosid-associated protein NdpA | 1671 |
| 953842-954060 | — | | conserved hypothetical protein | 1672 |
| 954062-955819 | — | | predicted hydrolase of alkaline phosphatase superfamily | 1673 |
| 956017-957009 | — | | conserved hypothetical protein | 1674 |
| C 957148-957726 | mobA | | probable molybdopterin-guanine dinucleotide biosyntheses protein A | 1675 |
| 957791-958057 | — | | conserved hypothetical protein | 1676 |
| 958068-958685 | dsbA | | thiol:disulfide interchange protein DsbA | 1677 |
| 958747-959085 | — | | conserved hypothetical protein | 1678 |
| 959226-960317 | trmA | | tRNA (Uracil-5)-methyltransferase | 1679 |
| 960506-961072 | — | | conserved hypothetical protein | 1680 |
| 961066-961500 | — | | predicted positive regulator of Sigma E | 1681 |
| 961901-962437 | mobB | | molybdopterin-guanine dinucleotide biosynthesis protein B | 1682 |
| 962434-963825 | — | | conserved hypothetical protein | 1683 |
| 963966-965615 | hbpA | | heme-binding protein A | 1684 |
| 965791-966552 | — | | putative heme iron utilization protein | 1685 |
| C 966689-967036 | — | | conserved hypothetical protein | 1686 |
| C 967051-969843 | polA | | DNA polymerase I | 1687 |
| 969992-970294 | — | | conserved hypothetical protein | 1688 |
| 970617-971180 | — | | predicted 5-formyltetrahydrofolate cyclo-ligase | 1689 |
| 971308-973878 | clpB | | ClpB | 1690 |
| C 973916-974656 | — | | probable tRNA/rRNA methyltransferase | 1691 |
| C 974712-977060 | vacB | | ribonuclease R | 1692 |
| C 977252-977959 | — | | conserved hypothetical protein | 1693 |
| 978095-978784 | pdxH | | pyridoxamine 5'-phosphate oxidase | 1694 |
| C 978871-980721 | typA | | GTP-binding protein TypA/BipA | 1695 |
| C 980848-981828 | lic3A2 | | CMP-neu5Ac--lipooligosaccharide alpha 2-3 sialyltransferase | 1696 |
| 981985-983397 | glnA | | glutamine synthetase | 1697 |
| 983484-984527 | rmlB | ✓ | dTDP-glucose 4,6-dehydratase | 1698 |
| 984604-985908 | pepB | | peptidase B | 1699 |
| 985915-986340 | ndk | | nucleoside diphosphate kinase | 1700 |
| C 986410-987582 | — | | conserved hypothetical GTP-binding protein | 1701 |
| C 987610-988530 | — | | conserved hypothetical transport protein | 1702 |
| C 988610-988867 | rpmA | | 50S ribosomal protein L27 | 1703 |
| C 988888-989199 | rplU | | 50S ribosomal protein L21 | 1704 |
| 989412-990401 | ispB | | octaprenyl-diphosphate synthase | 1705 |
| 990452-991189 | — | | conserved hypothetical protein | 1706 |
| C 991249-992619 | — | | predicted Na+/alanine symporter | 1707 |
| C 993019-993729 | arcA | | aerobic respiration control protein ArcA | 1708 |
| 993921-995660 | dsbD | | thiol:disulfide interchange protein DsbD | 1709 |
| 995777-996181 | — | | predicted membrane protein | 1710 |
| 996370-997968 | purH | | bifunctional purine biosynthesis protein PurH | 1711 |
| 998064-999353 | purD | | phosphoribosylamine--glycine ligase | 1712 |
| 999509-1001076 | — | ✓ | pseudogene for predicted membrane-associated, metal-dependent hydrolase | 1713 |
| 1001199-1002464 | glyA | | serine hydroxymethyltransferase | 1714 |
| 1002523-1003155 | coaE | | dephospho-CoA kinase | 1715 |
| 1003148-1003354 | — | | conserved hypothetical zinc-binding protein | 1716 |
| 1003463-1004719 | rh1B | | ATP-dependent RNA helicase Rh1B | 1717 |
| 1004961-1005524 | — | | hypothetical transcriptional regulator | 1718 |
| 1005556-1006752 | — | | predicted membrane-fusion protein | 1719 |
| 1006752-1009850 | — | | predicted cation/multidrug efflux pump | 1720 |
| 1010385-1010855 | — | | predicted cell division protein | 1721 |
| C 1010868-1012400 | emrB | | multidrug resistance protein | 1722 |
| C 1012410-1013582 | emrA | | multidrug resistance protein A | 1723 |
| C 1013755-1014237 | folA | | dihydrofolate reductase | 1724 |
| 1014339-1015445 | proB | | glutamate 5-kinase | 1725 |
| 1015526-1016116 | nudH | | probable nucleoside polyphosphate hydrolase | 1726 |
| 1016116-1016910 | — | | predicted permease | 1727 |
| 1016919-1017725 | lgt | | prolipoprotein diacylglyceryl transferase | 1728 |
| 1017735-1018586 | thyA | | thymidylate synthase | 1729 |
| 1018586-1019107 | — | | conserved hypothetical protein | 1730 |
| C 1019135-1019449 | — | | conserved hypothetical protein | 1731 |
| 1019520-1019831 | — | | conserved hypothetical protein | 1732 |
| 1019956-1022661 | secA | | preprotein translocase SecA subunit | 1733 |
| 1022726-1023136 | mutT | | mutator protein MutT | 1734 |
| 1023245-1025101 | kefB | | glutathione-regulated potassium-efflux system protein | 1735 |
| 1025202-1025966 | — | | conserved hypothetical SAM-dependent methtransferase | 1736 |
| 1026111-1026866 | rpsB | | 30S ribosomal protein S2 | 1737 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1027000-1027851 | tsf | | elongation factor Ts | 1738 |
| C 1028031-1029056 | lpxD | | UDP-3-O-[3-hydroxymyristoyl] glucosamine N-acyltransferase | 1739 |
| C 1029069-1029662 | omp26 | | outer membrane protein 26 | 1740 |
| C 1029770-1032172 | — | | protective surface antigen D15 | 1741 |
| C 1032192-1033523 | — | | predicted membrane bound zinc matalloprotease with PDZ domain | 1742 |
| C 1033533-1034399 | cdsA | | phosphaatidate cytidylyltransferase | 1743 |
| C 1034417-1035136 | uppS | | undecaprenyl pyrophosphate synthetase | 1744 |
| 1035385-1037970 | leuS | | leucyl-tRNA synthetase | 1745 |
| 1038020-1038568 | — | | conserved predicted lipoprotein | 1746 |
| 1038568-1039602 | holA | | DNA polymerase III, delta subunit | 1747 |
| C 1039836-1042004 | glyS | | glycyl-tRNA synthetase beta chain | 1748 |
| C 1042050-1042466 | — | ✓ | hypothetical protein | 1749 |
| C 1042606-1042971 | — | | conserved hypothetical protein | 1750 |
| C 1043001-1043261 | — | | glutaredoxin-related protein | 1751 |
| C 1043320-1044228 | glyQ | | glycyl-tRNA synthetase alpha chain | 1752 |
| 1044491-1046017 | hktE | | catalase | 1753 |
| C 1046249-1047430 | — | | predicted glutathionylspermidine synthase | 1754 |
| C 1047431-1048012 | — | | conserved hypothetical protein | 1755 |
| C 1048025-1048477 | — | | conserved hypothetical protein | 1756 |
| C 1048528-1049838 | eno | | enolase | 1757 |
| C 1049959-1051164 | — | | conserved hypothetical protein | 1758 |
| C 1051161-1052303 | nrfF | | formate-dependent nitrite reductase complex nrfFG subunit | 1759 |
| C 1052300-1052830 | dsbE2 | | probable thiol:disulfide interchange protein DsbE | 1760 |
| C 1052830-1054737 | nrfE | | cytochrome c-type biogenesis protein NrfE | 1761 |
| C 1054846-1055658 | suhB | | inositol-1-monophosphatase | 1762 |
| 1055858-1056370 | — | | conserved hypothetical protein | 1763 |
| 1056370-1057089 | — | | predicted Type II secretory pathway, PulJ-like protein | 1764 |
| 1057086-1057769 | — | | conserved hypothetical protein | 1765 |
| 1057774-1058049 | — | | conserved hypothetical protein | 1766 |
| 1058095-1061460 | — | | exodeoxyribonuclease V gamma chain | 1767 |
| 1061515-1061964 | — | | predicted transcriptional regulator | 1768 |
| 1061967-1063085 | ribD | | riboflavin biosynthesis protein RibD | 1769 |
| 11063086-1064108 | degS | | protease DegS | 1770 |
| C 1064182-1064997 | mutM | | formamidopyrimidine-DNA glycosylase | 1771 |
| C 1065229-1066764 | ddc | | L-2,4-diaminobutyrate decarboxylase | 1772 |
| C 1066784-1067182 | — | | predicted nucleic acid-binding protein, contains PIN domain | 1773 |
| C 1067182-1067415 | — | | conserved hypothetical protein | 1774 |
| C 1067562-1068926 | dat | | diaminobutyrate--2-oxoglutarate aminotransferase | 1775 |
| C 1069273-1069443 | rpmG | | 50S ribosomal protein L33 | 1776 |
| C 1069455-1069691 | rpmB | | 50S ribosomal protein L28 | 1777 |
| C 1069905-1070609 | radC | | DNA repair protein Radc homolog | 1778 |
| 1070733-1071935 | dfp | | phosphopantothenoylcysteine synthetase/decarboxylase | 1779 |
| 1071983-1072438 | dut | | deoxyuridine 5'triphosphate nucleotidohydrolase | 1780 |
| 1072442-1073098 | ttk | | ttk | 1781 |
| 1073120-1073371 | — | | hypothetical protein | 1782 |
| 1073356-1074030 | crp | | catabolite gene activator | 1783 |
| C 1074395-1075573 | — | | hypothetical RNA methyltransferase | 1784 |
| C 1075566-1076621 | nagZ | | beta-hexosaminidase | 1785 |
| C 1076625-1076975 | — | | predicted periplasmic lipoprotein | 1786 |
| C 1076975-1077367 | — | | HIT-like protein | 1787 |
| C 1077442-1080267 | ileS | | isoleucyl-tRNA synthetase | 1788 |
| C 1080296-1081234 | ribF | | riboflavin biosynthesis protein RibF | 1789 |
| C 1081269-1082801 | mviN | | putative virulence factor MviN | 1790 |
| 1083104-1083373 | rpsT | | 30S ribosomal protein S20 | 1791 |
| C 1083445-1084011 | — | | conserved hypothetical protein | 1792 |
| 1084157-1085014 | menB | | naphthoate synthase | 1793 |
| 1085184-1086173 | menC | | O-succinylbenzoate synthase | 1794 |
| 1086230-1086679 | aroQ | | 3-dehydroquinate dehydratase | 1795 |
| 1086833-1087300 | accB | | biotin carboxyl carrier protein of acetyl-CoA carboxylase | 1796 |
| 1087477-1088823 | accC | | biotin carboxylase | 1797 |
| 1089028-1089285 | — | | conserved hypothetical membrane protein | 1798 |
| 1089282-1090736 | panF | | sodium/pantothenase symporter | 1799 |
| 1090857-1091729 | — | | conserved hypothetical protein | 1800 |
| 1091764-1092651 | prmA | | ribosomal protein L11 methyltransferase | 1801 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1092798-1093778 | dusB | | tRNA-dihydrouridine synthase B | 1802 |
| 1093772-1094071 | fis | | DNA-binding protein fis | 1803 |
| C 1094172-1094657 | smpB | | SsrA-binding protein | 1804 |
| C 1094896-1095861 | pfkA | | 6-phosphfructokinase | 1805 |
| C 1095957-1096538 | — | | conserved hypothetical protein | 1806 |
| C 1096531-1097382 | — | | conserved hypothetical protein | 1807 |
| C 1097360-1098481 | smf | | smf | 1808 |
| 1099025-1100572 | leuA | | 2-isopropylmalate synthase | 1809 |
| 1100735-1101811 | leuB | | 3-isopropylmalate dehydrogenase | 1810 |
| 1101988-1103397 | leuC | | 3-isopropylmalate dehydratase large subunit | 1811 |
| 1103422-1104024 | leuD | | 3-isopropylmalate dehydratase small subunit | 1812 |
| C 1104138-1109522 | Iga1 | ✓ | IgA-specific serine endopeptidase | 1813 |
| C 1109749-1110828 | recF | | DNA replication and repair protein RecF | 1814 |
| C 1110830-1111930 | dnaN | | DNA polymerase III, beta chain | 1815 |
| C 1112123-1113487 | dnaA | | chromosomal replication initiator protein DnaA | 1816 |
| C 1113674-1116412 | tbp1 | | transferrin-binding protein 1 | 1817 |
| C 1116457-1118349 | tbp2 | | transferrin-binding protein 2 | 1818 |
| 1118446-1119906 | — | | conserved hypothetical protein | 1819 |
| 1120082-1120216 | rpmH | | 50S ribosomal protain L34 | 1820 |
| 1120229-1120588 | rnpA | | ribonuclease P protein component | 1821 |
| 1120552-1120812 | — | | conserved hypothetical protein | 1822 |
| 1120812-1122437 | yidC | | proprotein translocase subunit YidC | 1823 |
| 1123308-1124666 | trmE | | probable tRNA moficiation GTPase TrmE | 1824 |
| 1124855-1126723 | ppiD | | peptidyl-prolyl cis-trans isomerase D | 1825 |
| 1126811-1128370 | — | | predicted PR--lipooligosaccharide phosphorylethanolamine transferase | 1826 |
| 1128440-1128955 | lspA | | lipoprotein signal peptidase | 1827 |
| 1128952-1129896 | ispH | | 4-hydroxy-3-methylbut-2-enyl diphosphate reductase | 1828 |
| 1130065-1130412 | — | | conserved hypothetical protein | 1829 |
| 1130659-1131657 | tbpA | | thiamine-binding periplasmic protein | 1830 |
| 1131662-1133278 | thiP | | thiamine transport system permease protein | 1831 |
| 1133256-1133909 | thiQ | | thiamine transport ATP-binding protein | 1832 |
| 1134022-1135023 | bioB | | biotin synthase | 1833 |
| C 1135148-1137145 | tktA | | transketolase | 1834 |
| 1137526-1138470 | serB | | phosphoserine phosphatase | 1835 |
| 1138488-1138979 | — | | conserved hypothetical protein | 1836 |
| 1139275-1140222 | corA | | magnesium and cobalt transport protein CorA | 1837 |
| 1140213-1140767 | — | | predicted integral membrane protein | 1838 |
| C 1140947-1141831 | — | | predicted glutamine amidotransferase | 1839 |
| C 1141988-1142515 | — | ✓ | hypothetical protein | 1840 |
| 1142645-1143847 | — | | predicted ATPase | 1841 |
| C 1144037-1145386 | — | ✓ | hypothetical protein | 1842 |
| C 1145854-1146354 | — | | predicted ferredoxin | 1843 |
| C 1146354-1146964 | — | | conserved hypothetical protein | 1844 |
| C 1147077-1147916 | dmsC | | anaerobic dimethyl sulfoxide reductase chain C | 1845 |
| C 1147918-1148535 | dmsB | | anaerobic dimenthyl sulfoxide reductase chain B | 1846 |
| C 1148546-1150966 | dmaA | | anaerobic dimethyl sulfoxide reductase chain A | 1847 |
| 1151219-1152328 | — | | conserved hypothetical protein | 1848 |
| 1152372-1152665 | — | | putative mercuric transport MerT homolog | 1849 |
| 1152674-1152952 | — | | predicted copper chaperone MerP homolog | 1850 |
| C 1153077-1154921 | — | | conserved hypothetical ABC transporter | 1851 |
| C 1155000-1155896 | — | | conserved hypothetical transcriptional regulator | 1852 |
| 1156008-1156349 | — | | conserved putative gamma-carboxymuconolactone decarboxylase subunit | 1853 |
| C 1156460-1157056 | — | | conserved hypothetical protein | 1854 |
| C 1157062-1159227 | res | | putative type III restriction-modification sustem HindVIP enzyme res | 1855 |
| C 1159217-1161318 | mod | ✓ | pseudogene for putative type III restriction-modification system HibdVIP enzyme mod | 1856 |
| C 1161534-1162127 | rnhB | | ribonuclease HII | 1857 |
| C 1162120-1163292 | lpxB | | lipid-A-disaccharide synthase | 1858 |
| C 1163359-1164147 | lpxA | | acyl0[acyl-carrier-protein]--UDP-N-acetylglucosamine O-Acyltransferase | 1859 |
| C 1164161-1164607 | fabZ | | (3R)-hydroxymyristoyl-[acyl carrier protein]dehydratase | 1860 |
| C 1164683-1166290 | — | | predicted PR--lipooligosaccharide phosphorylethanolamine transferase | 1861 |
| 1166383-1167096 | pyrH | | uridylate kinase | 1862 |
| C 1167335-1168300 | nrfD | | NrfD, formate-dependent nitrite reductase, membrane component | 1863 |
| C 1168297-1168974 | nrfC | | NrfC, Fe—S-cluster-containing hydrogenase component 1 | 1864 |
| 1168971-1169654 | nrfB | | NrfB, cytochrome C-type protein | 1865 |
| C 1169698-1171314 | nrfA | | cytochrome c552 | 1866 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1171476-1175384 | hrpA | | ATP-dependent helicase HrpA homolog | 1867 |
| C 1175381-1175755 | — | | conserved putative small membrane protein | 1868 |
| C 1175756-1176208 | — | | conserved putative membrane protein | 1869 |
| C 1176474-1177610 | cyoB | | probable cyrochrome oxidase subunit II | 1870 |
| C 1177625-1179190 | cyoA | | probable cytochrome oxidase dubunit I | 1871 |
| 1179843-1181480 | pyrG | | CTP synthase | 1872 |
| C 1181625-1182305 | pnuC | | nictinamide riboside transporter | 1873 |
| C 1182487-1183260 | — | | probable amino-acid ABC transporter ATP-binding protein | 1874 |
| C 1183264-1183941 | — | | probable amino-acid ABC transporter permease protein | 1875 |
| C 1183964-1184737 | — | | probable amino-acid ABC transporter binding protein | 1876 |
| C 1185038-1186312 | murA | | UDP-N-acetylglucosamine a-carboxyvinyltransferase | 1877 |
| C 1186323-1186580 | — | | predicted transcriptional regulator, BolA superfamily | 1878 |
| C 1186601-1186918 | — | | predicted NTP binding protein, contains STAS domain | 1879 |
| C 1186929-1187573 | — | | conserved ABC-type transport system protein | 1880 |
| C 1187606-1188106 | — | | conserved ABC-type transport system protein, periplasmic component | 1881 |
| C 1188116-1188901 | — | | conserved ABC-type transport system protein, permease component | 1882 |
| C 1188898-1189692 | — | | conserved ABC-type transport system protein, ATPase component | 1883 |
| C 1190098-1190745 | sodA | | superoxide dismutase [Mn] | 1884 |
| 1190994-1191632 | ccmA | | heme exporter protein A | 1885 |
| 1191637-1192302 | ccmB | | heme exporter protein B | 1886 |
| 1192363-1193103 | ccmC | | heme exporter protein C | 1887 |
| 1193146-1193349 | ccmD | | heme exporter protein D | 1888 |
| 1193346-1193867 | ccmE | | cytochrome c-type biogenesis protein CcmE | 1889 |
| 1193864-1195813 | ccmF | | cytochrome c-type biogenesis protein CcmF | 1890 |
| 1195953-1196498 | dsbE | | thiol:disulfide interchange protein DsbE | 1891 |
| 1196498-1197877 | ccmH | | pseudogene for cytochrome c-type biogenesis protein CcmH precursor | 1892 |
| 1197998-1198489 | — | | hypothetical protein | 1893 |
| 1198491-1198799 | — | | conserved hypothetical protein | 1894 |
| C 1198804-1200843 | ligN | | DNA ligase | 1895 |
| C 1200928-1201914 | zipA | | cell division protein ZipA | 1896 |
| 1202067-1202885 | cysZ | | CysZ | 1897 |
| 1202894-1203934 | cysK | | cysteine synthase | 1898 |
| 1204182-1205406 | — | | pseudogene for conserved hypothetical metabolite transport protein | 1899 |
| C 1205515-1206555 | rfaF | | ADP-heptose--lipooligosaccharide heptosyltransferase II | 1900 |
| C 1206631-1207794 | xylR | | xylose operon refulatory protein | 1901 |
| C 1207906-1209312 | — | | conserved hypothetical Na(+)/H(+) antiporter | 1902 |
| C 1209314-1210486 | aspC2 | | putative aspartate aminotransferase | 1903 |
| 1210699-1212018 | xylA | | xylose isomerase | 1904 |
| 1212021-1213556 | xylB | | xylulose kinase | 1905 |
| C 1213607-1214533 | rfaD | | ADP-L-glycero-D-manno-heptose-6-epimerase | 1906 |
| C 1214586-1215089 | — | | thioredoxin-like protein | 1907 |
| 1215200-1215871 | deoC | | deoxyribose-phosphate aldolase | 1908 |
| C 1215905-1217434 | comM | | competence protein ComM | 1909 |
| C 1217549-1218166 | engB | | Probable GTP-binding protein EngB | 1910 |
| 1218259-1219137 | — | | D-xylose transport permease protein | 1911 |
| C 1219177-1220175 | oppF | | oligopeptide transport ATP-binsing protein | 1912 |
| C 1220172-1221143 | oppD | | oligopeptide transport ATP-binding protein | 1913 |
| C 1221153-1222088 | oppC | | oligopeptide transport system permease protein | 1914 |
| C 1222098-1223018 | oppB | | oligopeptide transport system permease protein | 1915 |
| C 1223099-1224724 | oppA | | periplasmic oligopeptide-binding protein | 1916 |
| 1225019-1225972 | talB | | Transaldolase | 1917 |
| 1227033-1228634 | — | | carbon starvation protein, predicted membrane protein | 1918 |
| 1228836-1229291 | mraZ | | MraZ | 1919 |
| 1229322-1230287 | mraW | | predicted S-adenosylmethionine-dependent methyltransferase involved in cell envelope biogenesis | 1920 |
| 1230290-1230613 | ftsL | | cell division protein FtsL | 1921 |
| 1230626-1232458 | ftsI | | peptidoglycan synthetase FtsI | 1922 |
| 1232468-1233934 | murE | | UDP-N-acetylmuramoylalanyl-D-glutamate--2,6-diaminopimelate ligase | 1923 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1233948-1235321 | murF | | UDP-N-acetylmuramoyl-tripeptide--D-alanyl-D-alanine ligase | 1924 |
| 1235315-1236397 | mraY | | phospho-N-acetylmuramoyl-pentapeptide-transferase | 1925 |
| 1236509-1237822 | murD | | UDP-N-acetylmuramoylalanine--D-glutamate ligase | 1926 |
| 1237845-1239029 | ftsW | | cell division protein FtsW | 1927 |
| 1239041-1240096 | murG | | UDP-N-acetylglucosamine--N-acetylmuramylpyrophosphoryl-undecaprenol N-acetylglucosamine transferase | 1928 |
| 1240234-1241661 | murC | | UDP-N-acetylmuramate--L-alanine ligase | 1929 |
| 1241730-1242650 | ddlB | | D-alanine--D-alanine ligase | 1930 |
| 1242650-1243414 | ftsQ | | cell division protein FtsQ | 1931 |
| 1243433-1244710 | ftsA | | cell division protein FtsA | 1932 |
| 1244794-1246059 | ftsZ | | cell division protein FtsZ | 1933 |
| 1246098-1247015 | lpxC | | UDP-3-O-[3-hydroxymyristoyl] N-acetylglucosamine deacetylase | 1934 |
| 1247142-1248299 | pheA | | P-protein | 1935 |
| C 1248344-1249201 | — | | predicted P-loop-containing kinase | 1936 |
| C 1249219-1249713 | ptsN | | nitrogen regulatory IIA protein | 1937 |
| C 1249716-1250441 | — | | probable ABC transporter ATP-binding protein | 1938 |
| C 1250445-1250963 | — | | conserved hypothetical protein | 1939 |
| C 1250944-1251552 | — | | conserved hypothetical protein | 1940 |
| C 1251602-1252138 | — | | conserved hypothetical protein | 1941 |
| 1252227-1253582 | pmbA | | pmbA | 1942 |
| 1253957-1254496 | hpt | | hypoxanthine phosphoribosyltransferase | 1943 |
| 1254802-1256124 | — | | predicted Na+/dicarboxylate symporter | 1944 |
| C 1256224-1256691 | nrdG | | anaerobic ribonucleoside-triphosphate reductase activating protein | 1945 |
| C 1256939-1258669 | cydC | | transport ATP-binding protein CydC | 1946 |
| C 1258669-1260429 | cydD | | transport ATP binding protein CydD | 1947 |
| C 1260501-1261457 | trxB | | thioredoxin reductase | 1948 |
| C 1261531-1262388 | — | | thioredoxin domain-containing protein | 1949 |
| C 1262467-1263438 | hemH | | ferrochelatase | 1950 |
| C 1263435-1263851 | — | | conserved hypothetical protein | 1951 |
| C 1263865-1266948 | — | | conserved FAD/FMN-containing dehydrogenase | 1952 |
| 1267323-1268402 | ompP5 | | outer membrane protein P5 | 1953 |
| 1268514-1268876 | — | | conserved glutaredoxin-related protein | 1954 |
| C 1268953-1270053 | — | | histidinol-phosphate aminotransferase 2 | 1955 |
| C 1270141-1271229 | serC | | phosphoserine aminotransferase | 1956 |
| 1271420-1271764 | — | | conserved hypothetical protein | 1957 |
| C 1271804-1272370 | — | | conserved hypothetical protein | 1958 |
| C 1272370-1273356 | — | | conserved hypothetical protein | 1959 |
| 1273398-1273979 | trpG2 | | putative anthranilate synthase component II | 1960 |
| 1274064-1275218 | metK | | S-adenosylmethionine synthetase | 1961 |
| 1275513-1276028 | sprT | | SprT | 1962 |
| 1276079-1276591 | opa | | opacity protein | 1963 |
| C 1276627-1276932 | — | | conserved hypothetical protein | 1964 |
| C 1277139-1277822 | artM | | arginine transport system permease protein | 1965 |
| C 1277822-1278487 | artQ | | arginine transport system permease protein | 1966 |
| C 1278491-1279210 | artI | | arginine-binding periplasmic protein | 1967 |
| C 1279228-1279959 | artP | | arginine transport ATP-binding protein | 1968 |
| C 1280085-1280069 | gmhA | | phosphoheptose isomerase | 1969 |
| 1280769-1281683 | ligA | | DNA ligase | 1970 |
| C 1281712-1282695 | dppF | | dipeptide transport ATP binding protein | 1971 |
| C 1282698-1283690 | dppD | | dipeptide transport ATP binding protein | 1972 |
| C 1283700-1284587 | dppC | | dipeptide transport system permease protein | 1973 |
| C 1284602-1285603 | dppB | | dipeptide transport system permease protein | 1974 |
| C 1285693-1287876 | uvrD | | DNA helicase II | 1975 |
| C 1288483-1289118 | — | | predicted organic radical activating enzyme | 1976 |
| C 1289119-1289544 | — | | predicted 6-pyruval-tetrahydropterin synthase | 1977 |
| C 1289537-1290220 | — | | predicted PP-loop superfamily ATPase | 1978 |
| 1290376-1290519 | — | | conserved hypothetical protein | 1979 |
| C 1290570-1291601 | ilvE | | branched chain amino acid amino transferase | 1980 |
| 1292076-1292969 | gcvA | | glycine cleavage system transcriptional activator | 1981 |
| 1292962-1294053 | — | | predicted SAM-dependent methyltransferase | 1982 |
| 1294089-1295258 | sucC | | succinyl-CoA synthetase beta chain | 1983 |
| 1295258-1296139 | sucD | | succinyl-CoA synthetase alpha chain | 1984 |
| 1296260-1296883 | — | | putative translation factor, Sua5 | 1985 |
| 1296931-1289004 | rluB | | ribosomal large subunit pseudouridine synthase B | 1986 |
| 1298015-1298986 | cysB | | HTH-type transcriptional regulator CysB | 1987 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1299045-1299989 | — | | conserved hypothetical adenine-specific methylase | 1988 |
| 1300120-1300623 | — | | conserved hypothetical protein | 1989 |
| C 1300701-1302836 | pta | | phosphate acetyltransferase | 1990 |
| C 1302904-1304109 | ackA | | acetate kinase | 1991 |
| 1304326-1304769 | — | | conserved hypothetical protein | 1992 |
| 1304856-1305347 | cvpA | | colicin C production protein | 1993 |
| 1305358-1306875 | — | | amidophosphoribosyltransferase | 1994 |
| C 1306940-1307830 | sulA | | cell division inhibitor SulA | 1995 |
| C 1307830-1308285 | argR | | argininr repressor | 1996 |
| 1308492-1309427 | mdh | | malate dehydrogenase | 1997 |
| C 1309514-1311022 | lysS | | lysyl-tRNA synthetase | 1998 |
| C 1311134-1311985 | prfB | | peptide chain release factor 2 | 1999 |
| 1312365-1313054 | dsbC | | thiol:disulfide interchange protein DsbC | 2000 |
| 1313342-1315069 | recJ | | single stranded DNA specific exonuclease RecJ | 2001 |
| 1315062-1315769 | — | | conserved hypothetical protein | 2002 |
| 1315766-1316458 | mtnA | | MTA/SAH nucleosidase | 2003 |
| C 1316532-1319279 | hup | | heme utilization protein | 2004 |
| C 1319579-1321177 | — | | putative L-Lactate permease | 2005 |
| 1321367-1321546 | — | | pseudogene for ctidylate kinase | 2006 |
| C 1321581-1322585 | fbp | | frustose-1,6-bisphosphatase | 2007 |
| 1322820-1323629 | truA | | tRNA pseudouridine synthase A | 2008 |
| C 1323722-1324738 | sapZ | | Predicted membrane protein | 2009 |
| C 1324750-1325559 | sapF | | ABC-type transport system, ATPase component involved in antimicrobial peptide resistance | 2010 |
| C 1325559-1326608 | sapD | | ABC-type transport system, ATP binding component, involved in antimicrobial peptide resistance | 2011 |
| C 1326612-1327499 | sapC | | ABC-type transport system, permease protein, involved in antimicrobial peptide resistance | 2012 |
| C 1327489-1328454 | sapB | | ABC-type transport system, permease protein, involved in antimicrobial peptide resistance | 2013 |
| C 1328454-1330148 | sapA | | ABC-type transport system, periplasmic component, involved in antimicrobial peptide resistance | 2014 |
| 1330218-1331630 | — | | Predicted ATPase | 2015 |
| C 1331667-1334306 | Ppc | | Phosphoenolpyruvate carboxylase | 2016 |
| C 1334489-1335499 | purR | | HTH-type transcriptional repressor PurR | 2017 |
| 1335796-1336689 | dapD | | 2,3,4,5-tetrahydropyridine-2,6-dicarboxylate N-succinyltransferase | 2018 |
| C 1336746-1338044 | PurA | | adenylosuccinate synthetase | 2019 |
| C 1338173-1338538 | — | | predicted aspartokinase | 2020 |
| C 1339386-1339673 | rplY | | 50S ribosomal protein L25 | 2021 |
| 1339841-1340497 | — | | uncharacterized membrane-associate protein | 2022 |
| C 1340544-1340960 | — | | conserved hypothetical protein | 2023 |
| C 1340991-1341341 | — | | putative translation initiation inhibitor, YjgF family | 2024 |
| 1341453-1342169 | — | | conserved hypothetical protein | 2025 |
| 1342170-1342712 | — | | conserved hypothetical protein | 2026 |
| C 1342727-1343185 | — | | HTH-type trancriptional regulator | 2027 |
| 1343224-1343907 | — | | putative ABC-type Co2+ transport system, periplasmic component | 2028 |
| 1343920-1344408 | — | | conserved hypothetical protein | 2029 |
| 1344408-1345028 | cbiM | | predicted ABC-type cobalt transport system, permease component | 2030 |
| 1345028-1345660 | — | | predicted cobalt transport protein | 2031 |
| 1345662-1346288 | cbiO | | predicted ABC-type cobalt transport system, ATPase component | 2032 |
| C 1346395-1347585 | aspC | | aspartate aminotransferase | 2033 |
| 1347725-1348813 | purK | | phosphoribosylaminoimidazole carboxylase ATPase subunit | 2034 |
| C 1348883-1349377 | purE | | phosphoribosylaminoimidazole carboxylase catalytic subunit | 2035 |
| 1349548-1349796 | hicA | ✓ | HicA | 2036 |
| 1349793-1350137 | hicB | ✓ | HicB | 2037 |
| 1350181-1352790 | pepN | | aminopeptidase N | 2038 |
| C 1352862-1353476 | ribE | | riboflavin synthase alpha chain | 2039 |
| 1353520-1354914 | norM | | probable multidrug resistance protein NorM | 2040 |
| 1354923-1355639 | sfsA | | sugar fermentation stimulation protein | 2041 |
| 1355839-1357026 | tyrS | | tyrosyl-tRNA synthase | 2042 |
| C 1357090-1358037 | prsA | | ribose phosphate pyrophosphokinase | 2043 |
| C 1358039-1358992 | ispE | | 4-diphosphocytidyl-2-C-methyl-D-erythritol kinase | 2044 |
| C 1358992-1359621 | lolB | | outer-membrane lipoprotein LolB | 2045 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1359684-1360934 | cca | | tRNA nucleotidyltransferase | 2046 |
| C 1360941-1361552 | — | | conserved hypothetical protein | 2047 |
| C 1361618-1362880 | — | | putative phosphate permease | 2048 |
| C 1362905-1363585 | — | | conserved hypothetical phosphate transport regulator | 2049 |
| 1363793-1364248 | — | | predicted membrane protein | 2050 |
| 1364287-1364574 | — | | conserved hypothetical protein | 2051 |
| 1364604-1365557 | — | | conserved hypothetical protein | 2052 |
| 1365547-1366263 | — | | conserved hypothetical protein | 2053 |
| 1367371-1367538 | — | ✓ | hypothetical protein | 2054 |
| 1367936-1368052 | — | ✓ | hypothetical protein | 2055 |
| 1368502 . . . 1368666 | — | ✓ | hypothetical protein | 2056 |
| C 1368856-1370808 | hmw2C | ✓ | HMW2C, putative glycosyltransferase involved in glycosylation of HMW1A and HMW2A | 2057 |
| C 1371200-1372837 | hmw2B | ✓ | HMW2B, OMP-85-like protein required for HMW1A and HMW2A secretion | 2058 |
| C 1372988-1377616 | — hmw2A | ✓ | HMW2A, high molecular weight adhesin 2 | 2059 |
| 1378041-1379087 | — | | conserved hypothetical protein | 2060 |
| 1379320-1380696 | radA | | DNA epair protein RadA homolog | 2061 |
| 1380755-1381255 | lrp | | leucine-responsive regulatory protein | 2062 |
| 1381257-1384013 | ftsK | | DNa translocase FtsK | 2063 |
| 1384031-1384648 | lolA | | outer-membrane lipoproteins carrier protein precursor | 2064 |
| 1384709-1386049 | — | | predicted ATPase related to the helicase subunit of the holliday junction resolvase | 2065 |
| C 1386137 . . . 1387279 | — | ✓ | hypothetical protein | 2066 |
| C 1387289-1388512 | — | ✓ | modification methylase BepI-like | 2067 |
| C 1388767-1390065 | aroA | | 3-phosphoshikimate 1-carboxyvinyltransferase | 2068 |
| C 1390065-1390901 | purU | | formyltetrahydrofolate deformylase | 2069 |
| C 1390971-1391375 | hns | | DNA-binding protein H—NS homolog | 2070 |
| 1391779-1393338 | — | | predicted Na+/H+ antiporter | 2071 |
| 1393406-1393555 | — | | hypothetical protein | 2072 |
| 1393605-1395326 | ilvI | | acetolactate synthase large subunit | 2073 |
| 1395326-1395817 | ilvH | | acetolactate synthase small subunit | 2074 |
| C 1396111-1397844 | argS | | arginyl-tRNA synthetase | 2075 |
| 1397924-1398493 | — | | conserved hypothetical protein | 2076 |
| 1398572-1398793 | — | | hypothetical lipoprotein | 2077 |
| 1399816-1399280 | pcp | | outer-membrane lipoprotein PCP precursor | 2078 |
| C 1399464-1400435 | lgtD | | UDP-0glcNAc-lipooligosaccharide N-acetylglucosamine glycosyltransferase | 2079 |
| 1400502 . . . 1400999 | — | | pseudogene for IS1016-V6 protein homolog, degenerate | 2080 |
| C 1401073-1402764 | pgi | | glucose-6-phosphate isomerase | 2081 |
| C 1402819-1403901 | alr | | alanine racemase | 2082 |
| C 1403911-1405425 | dnaB | | replicative DNA helicase | 2083 |
| C 1405459-1406895 | pykA | | pyruvate kinase | 2084 |
| 1407432-1408691 | — | ✓ | prophage CP4-57-like integrase | 2085 |
| C 1409305-1409574 | — | ✓ | hypothetical protein | 2086 |
| C 1409679-1409849 | — | ✓ | hypothetical protein | 2087 |
| C 1409839-1410372 | — | ✓ | hypothetical protein | 2088 |
| C 1410444-1410860 | — | ✓ | hypothetical protein | 2089 |
| C 1410864-1411541 | — | ✓ | hypothetical protein | 2090 |
| C 1411560-1412723 | — | ✓ | modification methylase Bsp6I-like | 2091 |
| C 1413329-1414225 | rdgC | ✓ | recombination associated protein | 2092 |
| C 1414350-1415696 | — | ✓ | hypothetical protein | 2093 |
| C 1415758-1416192 | ssb3 | ✓ | single strand binding protein | 2094 |
| C 1416192-1416836 | — | ✓ | hypothetical protein | 2095 |
| C 1416817-1417737 | — | ✓ | predicted recombinational DNA repair protein, RecE pathway | 2096 |
| C 1417750-1418043 | — | ✓ | hypothetical protein | 2097 |
| C 1418040-1418384 | — | ✓ | hypothetical protein | 2098 |
| C 1418398-1419135 | — | ✓ | modification methylase DpnIIB-like | 2099 |
| C 1419226-1420257 | — | ✓ | hypothetical protein | 2100 |
| C 1420247-1420498 | — | ✓ | hypothetical protein | 2101 |
| C 1420617-1420928 | — | ✓ | hypothetical protein | 2102 |
| C 1421314-1421499 | — | ✓ | hypothetical protein | 2103 |
| C 1421660-1422808 | — | ✓ | hypothetical protein | 2104 |
| C 1422819-1423679 | — | ✓ | hypothetical protein | 2105 |
| C 1423742-1424107 | — | ✓ | hypothetical protein | 2106 |
| C 1424109-1424696 | — | ✓ | hypothetical protein | 2107 |
| 1424852-1425037 | — | ✓ | hypothetical protein | 2108 |
| 1425068-1425496 | — | ✓ | hypothetical protein | 2109 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1425497-1426006 | — | ✓ | hypothetical protein | 2110 |
| C 1426011-1426601 | — | ✓ | hypothetical protein | 2111 |
| C 1426598-1427233 | — | ✓ | hypothetical protein | 2112 |
| C 1427218-1428000 | — | ✓ | hypothetical protein | 2113 |
| C 1428002-1428235 | — | ✓ | hypothetical protein | 2114 |
| C 1428281-1428733 | — | ✓ | hypothetical protein | 2115 |
| C 1428777-1428983 | — | ✓ | hypothetical protein | 2116 |
| 1429117-1430085 | — | ✓ | hypothetical protein | 2117 |
| 1430279-1430605 | — | ✓ | hypothetical protein | 2118 |
| 1430592-1430996 | — | ✓ | hypothetical protein | 2119 |
| 1430993-1431382 | — | ✓ | hypothetical protein | 2120 |
| 1431357-1431587 | — | ✓ | hypothetical protein | 2121 |
| 1431596-1432555 | — | ✓ | hypothetical protein | 2122 |
| 1432534-1432953 | — | ✓ | predicted DNA modification methylase | 2123 |
| C 1432950-1433171 | — | ✓ | hypothetical protein | 2124 |
| 1433229-1433597 | — | ✓ | hypothetical protein | 2125 |
| 1433611-1434927 | — | ✓ | predicted phage terminase large subunit | 2126 |
| 1434929-1436245 | — | ✓ | hypothetical protein | 2127 |
| 1436175-1436987 | — | | uncharacterized protein, homolog of phage Mu protein gp30 | 2128 |
| 1436993-1438066 | — | ✓ | hypothetical protein | 2129 |
| 1438080-1438499 | — | ✓ | hypothetical protein | 2130 |
| 1438507-1439508 | — | ✓ | hypothetical protein | 2131 |
| 1439511-1439699 | — | ✓ | hypothetical protein | 2132 |
| 1439703-1440053 | — | ✓ | hypothetical protein | 2133 |
| 1440046-1440504 | — | ✓ | hypothetical protein | 2134 |
| 1440504-1440863 | — | ✓ | hypothetical protein | 2135 |
| 1440865-1441374 | — | ✓ | hypothetical protein | 2136 |
| 1441361-1442434 | — | ✓ | hypothetical protein | 2137 |
| 1442480-1442905 | — | ✓ | hypothetical protein | 2138 |
| 1442905-1443387 | — | ✓ | hypothetical protein | 2139 |
| 1443423-1443575 | — | ✓ | hypothetical protein | 2140 |
| 1443572-1445989 | — | ✓ | predicted phage-related minor tail protein | 2141 |
| C 1446064-1446636 | — | ✓ | hypothetical protein | 2142 |
| 1446944-1447525 | — | ✓ | hypothetical protein | 2143 |
| 1447522-1447836 | — | ✓ | hypothetical protein | 2144 |
| 1447833-1448789 | — | ✓ | hypothetical protein | 2145 |
| 1448792-1449463 | — | ✓ | hypothetical protein | 2146 |
| 1449460-1449825 | — | ✓ | hypothetical protein | 2147 |
| 1449818-1451254 | — | ✓ | hypothetical protein | 2148 |
| 1451263-1451877 | — | ✓ | hypothetical protein | 2149 |
| 1451887-1454235 | — | ✓ | probable tail fiber protein | 2150 |
| 1454247-1454849 | — | ✓ | hypothetical protein | 2151 |
| 1454846-1455346 | — | ✓ | hypothetical protein | 2152 |
| 1455412-1455861 | — | ✓ | conserved hypothetical protein | 2153 |
| C 1455900-1456163 | — | ✓ | hypothetical protein | 2154 |
| 1456754-1457884 | — | | pseudogene for putative integrase/recombinase, degenerate | 2155 |
| C 1457947-1458228 | — | | hypothetical protein | 2156 |
| 1458276-1458461 | — | | mu-like prophage protein gp29 | 2157 |
| 1458521-1459189 | — | | conserved hypothetical protein | 2158 |
| 1459291-1459437 | — | | hypothetical protein | 2159 |
| 1459470-1460006 | — | | conserved hypothetical protein | 2160 |
| 1460207-1460653 | — | ✓ | hypothetical protein | 2161 |
| 1460653-1460829 | — | ✓ | hypothetical protein | 2162 |
| 1430841-1461500 | — | ✓ | hypothetical protein | 2163 |
| 1461500-1461676 | — | ✓ | hypothetical protein | 2164 |
| 1461689-1462246 | — | ✓ | hypothetical protein | 2165 |
| 1462243-1462419 | — | ✓ | hypothetical protein | 2166 |
| 1462432-1462983 | — | ✓ | hypothetical protein | 2167 |
| 1463259-1464344 | prfA | | peptide chain release factor 1 | 2168 |
| 1464367-1464837 | — | | conserved hypothetical protein | 2169 |
| 1464837-1465715 | hemK | | HemK | 2170 |
| 1465715-1466518 | — | | conserved hypothetical protein | 2171 |
| 1466533-1467387 | kdsA | | 2-dehyrdro-3-deoxyphosphooctonate aldolase | 2172 |
| 1467447-1468394 | — | | putative 2-hydroxyacid dehydrogenase | 2173 |
| 1468394-1469575 | lolC | | lipoprotein releasing system transmembrane protein | 2174 |
| 1469587-1470879 | bioA | | adenosylmethionine-8-amino-7-oxononanoate aminotransferase | 2175 |
| 1470888-1472027 | bioF | | 8-amino-7-oxononanoate synthase | 2176 |
| 1472037-1472684 | — | | conserved hypothetical protein | 2177 |
| 1472672-1473454 | bioC | | putative biotin synthesis protein BioC | 2178 |
| 1473464-1474105 | bioD-B | | probable dethiobiotin synthetase 2 | 2179 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1474187-1474870 | lolD | | lipoprotein releasing system ATP-binding protein LolD | 2180 |
| 1474870-1476120 | lolE | | ABC-type transport system, involved in lipoprotein release, permease component | 2181 |
| 1476339-1477427 | aroG | | phospho-2-dehydro-3-deoxyheptonate aldolase | 2182 |
| C 1477497-1477937 | impA | | impA | 2183 |
| 1478222-1479466 | — | | predicted Na+/serine symporter | 2184 |
| 1479588-1480196 | — | | putative NAD(P)H oxidoreductase | 2185 |
| 1480196-1480750 | — | | predicted component of anaerobic dehydrogenases | 2186 |
| C 1480797-1481351 | — | | predicted nitroreductase | 2187 |
| 1481449-1483296 | sppA | | protease IV | 2188 |
| C 1483334-1484131 | licD | | phosphorylcholine transferase | 2189 |
| C 1484131-1484832 | licC | | LicC | 2190 |
| C 1484829-1485707 | licB | | LicB | 2191 |
| C 1485707-1486666 | licA | | LicA | 2192 |
| C 1486754-1488766 | — | | predicted glycine/D-amino acid oxidases, deaminating | 2193 |
| 1488913-1490133 | fabB | | 3-oxoacyl-[acyl-carrier-protein] synthase I | 2194 |
| C 1490196-1490459 | rrxA | | glutaredoxin | 2195 |
| 1490576-1491484 | rimK | | probable ribosomal protein S6 modification protein | 2196 |
| C 1495122-1492736 | gltS | | sodium/glutamate symport carrier protein | 2197 |
| C 1492778-1495021 | parC | | topoisomerase IV subunit A | 2198 |
| C 1495088-1496986 | parE | | topoisomerase IV subunit B | 2199 |
| C 1497060-1497995 | htrB | | lipid A biosynthesis lauroyl acyltransferase | 2200 |
| 1498092-1499522 | rfaE | | ADP-heptose synthase | 2201 |
| C 1499886-1499981 | — | | pseudogene for Type I restriction enzyme R protein | 2202 |
| C 1500193-1500549 | — | ✓ | hypothetical protein | 2203 |
| 1500660-1501064 | uupA2 | | ABC transporter ATP-binding protein | 2204 |
| 1501061-1501621 | uppB | | ABC transporter ATP-binding protein | 2205 |
| C 1501649-1502338 | — | | putative carbonic anhydrase | 2206 |
| C 1502414-1503922 | asnS | | asparaginyl-tRNA synthetase | 2207 |
| 1504044-1504517 | ribH | | 6,7-dimethyl-8-ribityllumazine synthase | 2208 |
| 1504521-1504955 | nusB | | N utilization substance protein B | 2209 |
| 1505022-1506008 | thiL | | thiamine-monophosphate kinase | 2210 |
| 1506005-1506496 | pgpA | | phosphatidylglycerophosphatase A | 2211 |
| 1506496-1507125 | — | | predicted threonine efflux protein | 2212 |
| 1507142-1507954 | dapB | | dihydrodipicolinate reductase | 2213 |
| C 1507949-1508197 | — | | conserved hypothetical ferredoxin-like protein | 2214 |
| 1508243-1508983 | — | | conserved hypothetical protein | 2215 |
| 1509132-1510121 | pheS | | ohenylalanyl-tRNA synthetase alpha chain | 2216 |
| 1510155-1512542 | pheT | | ohenylalanyl-tRNA synthetase beta chain | 2217 |
| 1512544-1512834 | himA | | integration host factor alpha-subunit | 2218 |
| 1512887-1513372 | — | | conserved hypothetical lipoprotein | 2219 |
| 1513381-1514391 | — | ✓ | hypothetical protein | 2220 |
| 1514450-1514905 | — | ✓ | putative 5'(3')-deoxyribonucleotidase | 2221 |
| 1514889-1515599 | — | ✓ | NAD-dependent deacetylase | 2222 |
| C 1515648-1516670 | — | ✓ | hypothetical protein | 2223 |
| 1516865-1517065 | ftsK2 | ✓ | DNA translocase ftsK | 2224 |
| 1517062-1517907 | — | ✓ | NAD-dependent deacetylase sirtuin 5 | 2225 |
| 1517907-1518668 | — | ✓ | hypothetical protein | 2226 |
| 1518746-1519720 | — | ✓ | hypothetical protein | 2227 |
| 1519797-1519964 | — | ✓ | hypothetical protein | 2228 |
| 1520134-1521849 | — | ✓ | predicted serine/threonine protein phosphatase family protein | 2229 |
| 1521869-1522306 | — | | predicted arylsulfatase A-like enzyme | 2230 |
| 1522388-1523200 | — | | predicted enzyme related to aldose 1-epimerase | 2231 |
| 1523468-1523875 | infC | | translation initiation factor IF-3 | 2232 |
| 1524014-1524283 | rpmI | | 50S ribosomal protein L35 | 2233 |
| 1524349-1524702 | rplT | | 50S ribosomal protein L20 | 2234 |
| 1524815-1528450 | recB | | exodeoxyribonuclease V beta chain | 2235 |
| 1528450-1530372 | recD | | exodeoxyribonuclease V alpha chain | 2236 |
| C 1530441-1530887 | — | | conserved hypothetical protein | 2237 |
| 1530984-1532789 | lonB | | putative protease Lahomolog, predicted ATP-dependent protease | 2238 |
| 1532958-1533491 | fabA | | 3-hydroxydecanoyl-[acyl-carrier-protein] dehydratase | 2239 |
| 1533727-1534455 | — | | conserved hypothetical protein | 2240 |
| 1534452-1534589 | — | | conserved hypothetical protein | 2241 |
| 1534725-1534994 | rpsO | | 30S ribosomal protein S15 | 2242 |
| C 1535066-1535437 | — | | conserved hypothetical transposase-like protein | 2243 |
| C 1535434-1535550 | — | | conserved hypothetical protein | 2244 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1535766-1537205 | dacB | | penicillin-binding protein 4 precursor | 2245 |
| 1537369-1537845 | greA | | transcription elongation factor GreA | 2246 |
| C 1537884-1538183 | — | | predicted RNA-binding protein containing KH domain, possible ribosomal protein | 2247 |
| 1538310-1538939 | ftsJ | | ribosomal RNA large subunit methyltransferase J | 2248 |
| 1539030-1540937 | FTSh | | cell division protein FtsH homolog 1 | 2249 |
| 1541049-1541879 | folP | | dihydropteroate synthase | 2250 |
| 1541912-1543249 | mrsA | | predicted phosphomannomutase | 2251 |
| 1543308-1543802 | sixA | | phosphohistidine phosphatase SixA homolog | 2252 |
| 1544004-1544579 | — | ✓ | conserved hypothetical protein | 2253 |
| C 1544657-1546021 | — | | conserved hypothetical protein | 2254 |
| 1546248-1546388 | — | | hypothetical protein | 2255 |
| 1546382-1546534 | — | | hypothetical protein | 2256 |
| 1546609-1546767 | — | | pseudogene for surface protein autotransporter domain | 2257 |
| 1546843-1547439 | — | | possible RNA polymerase sigma factor 24 | 2258 |
| 1547449-1547622 | — | | hypothetical protein | 2259 |
| C 1547717-1548619 | — | ✓ | hypothetical protein | 2260 |
| 1548755-1549816 | msaB | | peptide methionine sulfoxide reductase MsrA/MsrB | 2261 |
| 1549828-1550469 | — | | conserved hypothetical cytochrome c-type biogenesis protein | 2262 |
| 1550514-1550984 | — | | conserved hypothetical protein | 2263 |
| C 1551166-1551489 | — | | conserved hypothetical protein | 2264 |
| C 1551556-1552287 | moeB | | molybdopterin biosynthesis protein MoeB | 2265 |
| C 1552291-1553505 | moeA | | molybdopterin biosynthesis protein MoeA | 2266 |
| 1553643-1554299 | folE | | GTP cyclohydrolase I | 2267 |
| 1554303-1554626 | — | | conserved hypothetical protein | 2268 |
| 1554729-1555457 | bioD-A | | probable dethiobiotin synthetase 1 | 2269 |
| C 1555546-1556424 | metF | | 5,10-methylenetetrahydrofolate reductase | 2270 |
| 1556887-1557315 | rplM | | 50S ribosomal protein L13 | 2271 |
| 1557332-1557724 | rpsI | | 30S ribosomal protein S9 | 2272 |
| 1557905-1558543 | sspA | | stringent starvation protein A | 2273 |
| 1558543-1558995 | sspB | | stringent starvation protein B | 2274 |
| C 1559031-1560908 | dxs | | 1-deoxy-D-xylulose 5-phosphate synthase | 2275 |
| C 1560950-1561840 | ispA | | geranyltranstransferase | 2276 |
| C 1561840-1562094 | xseB | | exodeoxyribonuclease VII small subunit | 2277 |
| 1562253-1563710 | thiI | | predicted thiamine biosynthesis ATP pyrophosphatase | 2278 |
| 1563725-1564045 | — | | conserved hypothetical protein | 2279 |
| 1564039-1454758 | truC | | tRNA pseudouridine synthase C | 2280 |
| 1564751-1564909 | — | | conserved hypothetical protein | 2281 |
| 1565058-1565276 | cspD | | cold shock-like protein CspD | 2282 |
| C 1565415-1565891 | — | | conserved hypothetical protein | 2283 |
| 1565950-1566903 | usg | | predicted aspartate-semialdehyde dehydrogenase | 2284 |
| C 1567047-1567853 | trpA | | tryptophan synthase alpha chain | 2285 |
| C 1567853-1569046 | trpB | | tryptophan synthase beta chain | 2286 |
| C 1569063-1569821 | — | | conserved hypothetical oxidoreductase | 2287 |
| 1570001-1571035 | purM | | phosphoribosylformylglycinamidine cyclo-ligase | 2288 |
| 1571090-1571728 | purN | | phosphoribosylglycinamide formyltransferase | 2289 |
| C 1571812-1572648 | — | | predicted ABC-type transport system protein, periplasmic component | 2290 |
| C 1572846-1573868 | uspE | | universal stress protein E | 2291 |
| C 1573897...1574670 | fnr | | fumarate and nitrate reduction regulatory protein | 2292 |
| 1575288-1575644 | — | | putative integrase/recombinase | 2293 |
| C 1575529-1575918 | — | | conserved hypothetical protein | 2294 |
| C 1576223-1576474 | — | | predicted phage anti-repressor protein | 2295 |
| C 1576812-1578083 | — | ✓ | hypothetical protein | 2296 |
| 1578684-1578887 | — | ✓ | hypothetical protein | 2297 |
| C 1578865-1579023 | — | ✓ | hypothetical protein | 2298 |
| C 1579351-1579572 | — | ✓ | hypothetical protein | 2299 |
| C 1580499-1580834 | — | ✓ | hypothetical protein | 2300 |
| C 1580837-1581916 | — | ✓ | hypothetical protein | 2301 |
| C 1581968-1582666 | — | ✓ | predicted transcriptional regulator | 2302 |
| 1582777-1582965 | — | ✓ | hypothetical protein | 2303 |
| 1583014-1583454 | — | ✓ | hypothetical protein | 2304 |
| 1583503-1584177 | — | ✓ | hypothetical protein | 2305 |
| 1584174-1584932 | — | ✓ | hypothetical protein | 2306 |
| 1584917-1585558 | — | ✓ | hypothetical protein | 2307 |
| 1585555-1585779 | — | ✓ | hypothetical protein | 2308 |
| 1585816-1586232 | ninB | ✓ | putative recombination protein NinB | 2309 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1586500-1586889 | ninG | | putative recombination protein NinG homolog | 2310 |
| 1586909-1587538 | — | ✓ | hypothetical protein | 2311 |
| 1587662-1587940 | — | | conserved hypothetical protein | 2312 |
| C 1587990-1588967 | — | ✓ | hypothetical protein | 2313 |
| 1589196-1589981 | — | | conserved hypothetical protein | 2314 |
| 1590012-1590194 | — | | hypothetical protein | 2315 |
| 1590318-1590674 | — | | conserved hypothetical protein | 2316 |
| 1590754-1591245 | — | | conserved hypothetical protein | 2317 |
| 1591238-1591561 | — | | hypothetical protein | 2318 |
| 1591473-1591754 | — | | conserved hypothetical protein | 2319 |
| C 1591756-1592034 | — | ✓ | hypothetical protein | 2320 |
| 1592079-1592591 | — | | conserved hypothetical protein | 2321 |
| 1592578-1593921 | — | | predicted phage terminase large subunit | 2322 |
| 1593923-1595257 | — | | conserved hypothetical protein | 2323 |
| 1595286-1596467 | — | ✓ | uncharacterized protein, homolog of phage Mu protein gp30 | 2324 |
| 1596613-1596789 | — | | conserved hypothetical protein | 2325 |
| 1596953-1597972 | pyrD | | dihyrdoorotate dehydrogenase | 2326 |
| 1597972-1598796 | trpH | | TrpH | 2327 |
| C 1598895-1599503 | — | | conserved hypothetical protein | 2328 |
| C 1599631-1601025 | fumC | | fumarate hydratase class II | 2329 |
| C 1601175-1602113 | — | ✓ | putative glycosyl transferase, glycosyl transferase family 8 protein | 2330 |
| 1602322-1602666 | — | | pseudogene for usg protein homolog | 2331 |
| 1602769-1603203 | holC | | DNA polymerase III, chi subunit | 2332 |
| 1603288-1603458 | — | | conserved hypothetical protein | 2333 |
| 1603471-1603845 | — | | conserved hypothetical protein | 2334 |
| 1603873-1604040 | — | | hypothetical protein | 2335 |
| 1604067-1604381 | — | | conserved hypothetical protein | 2336 |
| 1604425-1604826 | — | ✓ | hypothetical protein | 2337 |
| 1604878-1607742 | valS | | valyl-tRNA synthetase | 2338 |
| C 1607777-1607884 | — | | hypothetical protein | 2339 |
| C 1608172-1609605 | trpC | | tryptophan biosynthesis protein trpCF | 2340 |
| C 1609643-1610644 | trpD | | anthranilate phosphoribosyltransferase | 2341 |
| C 1610697-1611083 | — | | conserved hypothetical protein | 2342 |
| C 1611132-1611719 | trpG | | anthranilate synthase component II | 2343 |
| C 1611732-1613288 | trpE | | anthranilate synthase component I | 2344 |
| C 1613390-1614300 | — | ✓ | pseudogene for conserved hypothetical glycosyltransferase | 2345 |
| C 1614423-1614920 | ftnB | | ferritin-like protein 2 | 2346 |
| C 1614936-1615484 | ftnA | | ferritin-like protein 1 | 2347 |
| 1615927-1616946 | pstS | | phosphate-binding periplasmic protein precursor PstS | 2348 |
| 1617038-1617985 | pstC | | phosphate transport system permease protein PstC | 2349 |
| 1617987-1618835 | pstA | | phoaphate transport system permease proteain PstA | 2350 |
| 1618845-1619612 | pstB | | phosphate import ATP-binding protein PstB | 2351 |
| 1619709-1620404 | phoB | | phosphate regulon transcriptional regulatory protein PhoB | 2352 |
| 1620401-1621678 | phoR | | phosphate regulon sensor protein PhoR | 2353 |
| C 1622370-1623791 | sbcB | | exodeoxyribonuclease I | 2354 |
| C 1623804-1624679 | — | | conserved hypothetical protein | 2355 |
| C 1624683-1625591 | — | | conserved hypothetical protein | 2356 |
| C 1625661-1630193 | — | | cell division protein MukB | 2357 |
| C 1630193-1630927 | — | | cell division protein MukE | 2358 |
| C 1630931-1631989 | haeIIR | ✓ | type II restriction exzyme HaeII | 2359 |
| C 1631992-1632948 | haeIIM | ✓ | modification methylase HaeII | 2360 |
| C 1632961-1634388 | mukF | | MukF homolog | 2361 |
| 1634445-1635377 | — | | predicted ATPase of the PP-loop superfamily implicated in cell cycle control | 2362 |
| 1635379-1635708 | — | | predicted dissimilatory sulfite reductase, desulfoviridin, gamma subunit | 2363 |
| 1635816-1636025 | mop | | probable molybdenum-pterin binding protein | 2364 |
| 1636209-1638621 | — | | pseudogene for conserved hypothetical protein, denegerate | 2365 |
| 1638725-1641505 | pqqL | | probable zinc protease | 2366 |
| C 1641628-1643559 | thrS | | threonyl-tRNA synthetase | 2367 |
| 1643843-1644427 | acpD | | probable acyl carrier protein phosphodiesterase | 2368 |
| C 1644504-1647110 | topA | | DNA topoisomerase I | 2369 |
| 1647206-1648123 | — | | putative HTH-type transcriptional regulator | 2370 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1648187-1649611 | pntB | | NAD(P) transhydrogenase subunit beta | 2371 |
| C 1649622 . . . 1651160 | pntA | | NAD(P) transhydrogenase subunit alpha | 2372 |
| C 1651421-1653886 | glgP | | glycogen phosphorylase | 2373 |
| C 1654133-1655563 | glgA | | glycogen synthase | 2374 |
| C 1655671-1657005 | glgC | | glucose-1-phosphate adenylyltransferase | 2375 |
| C 1656955-1658971 | glgX | | glycogen operon protein GlgX | 2376 |
| C 1659070-1661262 | glgB | | 1,4-alpha-glucan branching enzyme | 2377 |
| C 1661272-1663371 | malQ | | 4-alpha-glucanotransferase | 2378 |
| C 1663433-1663897 | — | | conserved hypothetical protein | 2379 |
| C 1663963-1665636 | glnS | | glutaminyl-tRNA synthetase | 2380 |
| C 1666056-1667531 | cafA | | ribonuclease G | 2381 |
| 1667647-1669161 | putP | | sodium/proline symporter | 2382 |
| 1669158-1670123 | — | | conserved hypothetical protein | 2383 |
| C 1670166-1671044 | cdd | | cytiding deaminase | 2384 |
| 1671318-1671800 | — | | conserved hypothetical DNA-binding ferritin-like protein | 2385 |
| C 1672372-1673610 | pepT | | peptidase T | 2386 |
| 1673880-1675025 | potA | | spermidine/putrescine transport ATP-binding protein | 2387 |
| 1675009-1675869 | potB | | spermidine/putrescine transport permease protein | 2388 |
| 1675869-1676639 | potC | | spermidine/putrescine transport system permease protein | 2389 |
| 1676686-1677852 | potD1 | | spermidine/putrescine-binding periplasmic protein 1 precursor | 2390 |
| C 1677933-1679876 | uupA | | ABC transporter ATP-binding protein | 2391 |
| C 1679970-1681355 | — | | deoxyguanosinetriphosphate triphosphohydrolase-like protein | 2392 |
| C 1681448-1682143 | — | | putative effector of murein hydrolase | 2393 |
| C 1682162-1682584 | — | | putative effector of murein hydrolase | 2394 |
| 1682699-1683181 | — | | predicted micrococcal nuclease-like protein | 2395 |
| 1683183-1684382 | nifS | | predicted selenocysteine lyase | 2396 |
| 1684379-1684759 | — | | predicted SufE protein probably involved in Fe—S center assembly | 2397 |
| 1684750-1685547 | — | | Zn-ribbon-containing, possible nucleic-acid binding protein | 2398 |
| 1685591-1686430 | — | | predicted enzyme related to GTP cyclohydrolase I | 2399 |
| C 1686463-1687587 | tyrA | | T-protein | 2400 |
| C 1687677-1688597 | truB | | tRNA pseudouridine synthase B | 2401 |
| C 1688597-1688983 | rbfA | | ribosome-binding factor A | 2402 |
| 1689148-1690818 | hsdM3 | | putative type I restriction enzyme HindVIIP M protein | 2403 |
| 1690811-1692076 | hsdS3 | ✓ | putative type I restriction enzyme HindVIIP specificity protein | 2404 |
| 1692069-1693115 | — | ✓ | hypothetical protein | 2405 |
| 1693117-1696284 | hsdR3 | | putative type I restriction enzyme HindVIIP R protein | 2406 |
| C 1696363-1698897 | infB | | translation initiation factor IF-2 | 2407 |
| C 1698909-1700396 | nusA | | transcriptional elongation protein NusA | 2408 |
| C 1700413-1700868 | — | | conserved hypothetical protein | 2409 |
| C 1702529-1703293 | — | ✓ | hypothetical protein | 2410 |
| C 1703297-1703824 | — | ✓ | hypothetical protein | 2411 |
| C 1703834-1704973 | — | ✓ | hypothetical protein | 2412 |
| C 1704990-1705358 | — | ✓ | hypothetical protein | 2413 |
| C 1705372-1706193 | — | ✓ | hypothetical protein | 2414 |
| C 1706250-1706753 | — | ✓ | hypothetical protein | 2415 |
| C 1706750-1707352 | — | ✓ | hypothetical protein | 2416 |
| C 1707364-1709886 | — | ✓ | probable tail fiber protein | 2417 |
| C 1709895-1710431 | — | ✓ | predicted bacteriophage P2-related tail formation protein gpI | 2418 |
| C 1710421-1711335 | — | ✓ | predicted phage-related baseplate assembly protein | 2419 |
| C 1711332-1711670 | — | ✓ | predicted baseplate assembly protein W | 2420 |
| C 1711672-1712271 | — | ✓ | predicted phage P2-like baseplate assembly protein | 2421 |
| C 1712375-1712803 | — | ✓ | hypothetical protein | 2422 |
| C 1712812-1713369 | — | ✓ | hypothetical protein | 2423 |
| C 1713467-1713919 | — | ✓ | hypothetical protein | 2424 |
| C 1713897-1714097 | — | ✓ | hypothetical protein | 2425 |
| C 1714141-1716105 | — | ✓ | predicted phage-related tail protein | 2426 |
| C 1716148-1716915 | — | ✓ | hypothetical protein | 2427 |
| 1716960-1717298 | — | ✓ | hypothetical protein | 2428 |

TABLE 6-continued

NTHi Open Reading Frames and Gene Poducts

| CDS | Gene Name | Unique to NTHi 86-0268 | Product Name | SEQ ID NO: |
|---|---|---|---|---|
| C 1717309-1717491 | — | ✓ | hypothetical protein | 2429 |
| 1717595-1717942 | — | ✓ | hypothetical protein | 2430 |
| C 1717943-1718404 | — | ✓ | probable bacteriophage tail completion protein gpS homolog | 2431 |
| C 1718404-1718790 | — | ✓ | probable bacteriophage tail completion protein gpR homolog | 2432 |
| C 1718840-1718947 | — | ✓ | hypothetical protein | 2433 |
| C 1718980-1719102 | — | ✓ | hypothetical protein | 2434 |
| C 1719099-1719314 | — | ✓ | DnaK suppressor protein, bacteriophage PSP3 gp34 homolog | 2435 |
| C 1719489-1719839 | — | ✓ | hypothetical protein | 2436 |
| C 1719824-1720342 | — | ✓ | predicted phage-related lysozyme | 2437 |
| 1720335 . . . 1720556 | — | ✓ | hypothetical protein | 2438 |
| C 1720558-1720767 | — | ✓ | hypothetical protein | 2439 |
| C 1720767-1721273 | — | ✓ | hypothetical protein | 2440 |
| C 1721567-1722217 | — | ✓ | predicted terminase, endonuclease subunit | 2441 |
| C 1722229-1723278 | — | ✓ | predicted major capsid protein | 2442 |
| C 1723299-1724114 | — | ✓ | predicted capsid scaffolding protein | 2443 |
| 1724279-1726060 | — | ✓ | terminase, ATPase subunit | 2444 |
| 1726070-1727080 | — | ✓ | predicted portal vertex protein | 2445 |
| C 1727788-1728462 | siaB | | acylneuraminate cytidylyltransferase | 2446 |
| 1728576-1729238 | — | | putative NAD(P)H nitroreductase | 2447 |
| C 1729285-1730445 | mrp | | Mrp | 2448 |
| 1730548-1732596 | metG | | methionyl-tRNA synthetase | 2449 |
| 1732707-1733567 | tehB | | tellurite resistance protein | 2450 |
| C 1733611-1734312 | gloB | | probable hydroxyacylglutathione hydrolase | 2451 |
| C 1734364-1735170 | — | | conserved hypothetical protein | 2452 |
| 1735406-1735882 | — | | conserved hypothetical protein | 2453 |
| 1736019-1737782 | — | | conserved hypothetical protein | 2454 |
| 1738382-1741024 | gyrA | | DNA gyrase subunit A | 2455 |
| C 1741079-1742155 | metX | | homoserine O-acetyltransferase | 2456 |
| 1742259-1742993 | sanA | | SanA | 2457 |
| C 1743281-1744594 | folC | | folypolyglutamate synthase | 2458 |
| C 1744587-1745477 | accD | | acethy-coenzyme A carboxylase carboxyl transferase subunit beta | 2459 |
| 1745671-1747062 | htoA | | probable periplasmic serine protease do/HhoA-like precursor | 2460 |
| C 1747115-1750555 | mfd | | transcription-repair coupling factor | 2461 |
| C 1750657-1750830 | — | | conserved hypothetical protein | 2462 |
| C 1750827-1752797 | — | | predicted P-loop ATPase fused to an acetyltransferase | 2463 |
| C 1752802-1753143 | — | | conserved hypothetical protein | 2464 |
| C 1753205-1754875 | — | | ABC transported ATP-binding protein | 2465 |
| C 1755038-1755361 | — | | predicted plasmid maintenance system antidote protein | 2466 |
| C 1755372-1755677 | — | | predicted plasmid maintenance system killer protein | 2467 |
| 1756002-1756622 | — | | predicted ABC-type transport system, periplasmic component | 2468 |
| 1756625-1757593 | — | | predicted ABC-type transport system, permease component | 2469 |
| C 1758207-1760246 | uvrB | | UvrABC system protein B | 2470 |
| C 1760276-1762201 | — | | predicted phosphoglycerol transferase-like protein | 2471 |
| C 1762442-1764712 | mao2 | | NADP-dependent malic enzyme | 2472 |
| 1764910-1765530 | — | | possible polysaccharide biosynthesis protein | 2473 |
| 1765621-1766319 | rsuA | | ribosomal small subunit pseudouridine synthase A | 2474 |
| 1766321-1767517 | bcr | | bicyclomycin resistance protein | 2475 |
| C 1767549-1768349 | — | | conserved hypothetical protein | 2476 |
| 1768447-1769109 | — | | predicted membrane protein | 2477 |
| 1769130-1770383 | proA | | gamma-glutamyl phosphate reductase | 2478 |
| C 1770462-1771607 | dnaJ | | chaperone protein DnaJ | 2479 |
| C 1771694-1773601 | dnaK | | chaperone protein DnaK | 2480 |
| 1773868-1775310 | — | | conserved hypothetical protein | 2481 |
| C 1775467-1775925 | mgsA | | methylglyoxal synthase | 2482 |
| 1776225-1778885 | aceE | | pyruvate dehydrogenase E1 component | 2483 |
| 1778948-1780645 | aceF | | dihydrolipoamide acetyltransferase component of pyruvate dehydrogenase complex | 2484 |
| 1780759-1782183 | lpdA | | dihydrolipoamide dehydrogenase | 2485 |
| C 1782230-1782337 | — | | hypothetical protein | 2486 |
| 1782343-1782885 | apt | | adenine phosphoribosyltransferase | 2487 |
| 1782897-1784963 | dnzX | | DNA polymerase III subunit gamma/tau | 2488 |
| 1785103-1785729 | upp | | uracil phosphoribosyltransferase | 2489 |
| 1785833-1787077 | uraA | | probable uracil permease | 2490 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1787143-1787838 | — | | predicted ATPase involved in DNA replication initiation | 2491 |
| C 1787905-1788186 | — | | predicted translation initiation factor 1-like proterin | 2492 |
| C 1788193-1788885 | pyrF | | orotidine 5'-phosphate decarboxylase | 2493 |
| C 1788909-1790099 | — | | predicted N-acetylglucosaminyl transferase | 2494 |
| C 1790099-1790392 | — | | predicted membrane protein | 2495 |
| C 1790467-1790751 | ihfB | | integration host factor beta subunit | 2496 |
| C 1790874-1792523 | rpsA | | 30S ribosomal protein S1 | 2497 |
| C 1792626-1793420 | cmk | | ctidylate kinase | 2498 |
| 1793766-1794641 | — | | conserved hypothetical pyridoxine biosynthesis enzyme | 2499 |
| 1794642-1795220 | — | | predicted glutamine amidotransferase involved in pyridoxine biosynthesis | 2500 |
| C 1795769-1797463 | dld | | D-lactate dehydrogenase | 2501 |
| 1797723-1797833 | — | | conserved hypothetical protein | 2502 |
| C 1798368-1798919 | nlpC | | probable lipoprotein NlpC | 2503 |
| C 1799032-1800480 | tldD | | TldD | 2504 |
| C 1800582-1801433 | — | | predicted methyltransferase | 2505 |
| 1801505-1803232 | — | | putative lipoprotein | 2506 |
| 1803232-1803591 | — | | predicted endonuclease distantly related to archael holliday junction resolvase | 2507 |
| 1803604-1804188 | — | | predicted phosphoheptose isomerase | 2508 |
| 1804245-1804826 | — | | predicted periplasmic or secreted lipoprotein | 2509 |
| 1805081-1807351 | nrdA | | ribonucleoside-diphosphate reductase alpha chain | 2510 |
| 1807493-1808623 | nrdB | | ribonucleoside-diphosphate reductase beta chain | 2511 |
| C 1808739-1809968 | sucB | | dihydrolipoamide succinyltransferase component of 2-oxoglutarate dehydrogenase complex | 2512 |
| C 1810071-1812923 | sucA | | 2-oxoglutarate dehydrogenase E1 component | 2513 |
| C 1813081-1813719 | — | | predicted Zn-dependent hydrolase-like protein, including glyoxylases | 2514 |
| C 1813729-1814484 | — | | conserved putative deoxyribonuclease | 2515 |
| C 1814536-1815096 | — | | conserved hypothetical protein | 2516 |
| C 1815112-1816581 | — | | conserved hypothetical protein | 2517 |
| C 1816655-1818742 | prc | | tail-specific protease precursor | 2518 |
| C 1818764-1819402 | proQ | | predicted activator of osmoprotectant transporter PropP | 2519 |
| 1819587-1820837 | — | | paraquat-inducible protein A-like protein | 2520 |
| 1820821-1823466 | — | | paraquat-inducible protein B-like protein | 2521 |
| C 1823521-1823973 | moaE | | molybdopterin converting factor subunit 2 | 2522 |
| C 1823974-1824219 | moaD | | molybdopterin converting factor subunit 1 | 2523 |
| C 1824221-1824703 | moaC | | molybdenum cofactor biosynthesis protein C | 2524 |
| C 1824795-1825808 | moaA | | molybdenum cofactor biosynthesis protein A | 2525 |
| 1826253-1826726 | — | | predicted regulator of cell morphogenesis and NO signaling | 2526 |
| 1826726-1826923 | | | predicted regulator of cell morphogenesis and NO signaling | 2527 |
| 1827460-1728473 | — | | probable phosphosugar isomerase Hi1678 | 2528 |
| 1828483-1829025 | yrbI | | 3-deoxy-D-manno-octulosonate 8-phosphate phosphatase | 2529 |
| 1829456-1833934 | hmw1A | ✓ | HMW1A, high molecular weight adhesin 1 | 2530 |
| 1834085-1835722 | hmw1B | ✓ | HMW1B, OMP-85-like protein required for secretion of HMW1A and HMW2A | 2531 |
| 1835916-1837868 | hmw1C | ✓ | HMW1C, putative glycosyltransferase involved in glycosylation of HMW1A and HWM2A | 2532 |
| C 1837945-1840101 | — | | predicted membrane protein | 2533 |
| C 1840169-1840834 | — | | conserved hypothetical protein | 2534 |
| 1841032-1842093 | sohB | | possible protease SohB | 2535 |
| 1842377-1842955 | rnfA | | predicted NADH:ubiquinone oxidoreductase, subunit RnfA | 2536 |
| 1843043-1843624 | rnfB | | predicted NADH:ubiquinone oxidoreductase, subunit RnfB | 2537 |
| 1843625-1845622 | rnfC | | predicted NADH:ubiquinone oxidoreductase, subunit RnfC | 2538 |
| 1845752-1846828 | rnfD | | predicted NADH:ubiquinone oxidoreductase, subunit RnfD | 2539 |
| 1846828-1847451 | rnfG | | predicted NADH:ubiquinone oxidoreductase, subunit RnfG | 2540 |
| 1847453-1848160 | — | | predicted NADH:ubiquinone oxidoreductase, subunit RnfE | 2541 |
| 1848282-1848917 | nth | | endonuclease III | 2542 |

TABLE 6-continued

NTHi Open Reading Frames and Gene Poducts

| CDS | Gene Name | Unique to NTHi 86-0268 | Product Name | SEQ ID NO: |
|---|---|---|---|---|
| 1848976-1850349 | — | | predicted Na+-dependent transporters of the SNF family | 2543 |
| C 1850373-1851428 | modC | | molybdenum import ATP-binding protein | 2544 |
| C 1851415-1852104 | modB | | molybdenum transport system permease protein | 2545 |
| C 1852278-1853042 | modA | | molybdate-binding periplasmic protein | 2546 |
| 1853180-1853947 | mode | | Transcriptional regulator ModE | 2547 |
| 1854057-1854860 | lsgF | | Putative UDP-galactose-lipooligosaccharide galactosyltransferase | 2548 |
| C 1854862-1855746 | lsgE | | Putative UDP-galactose-lipooligosaccharide galactosyltransferase | 2549 |
| C 1855758-1856531 | lsgD | | Putative UDP-glcNAc-lipooligosaccharide N-acetylglucosaminyl glycosyltransferase | 2550 |
| C 1856543-1857604 | lsgC | | Putative UDP-galactose--lipooligosaccharide galactosyltransferase | 2551 |
| C 1857606-1858520 | lsgB | | CMP-N-acetylneuraminate-beta-galactosamide-alpha-2,3-sialytransferase | 2552 |
| C 1858517-1859722 | lsgA | | putative lipooligosaccharide flippase | 2553 |
| 1859857-1860600 | — | | conserved hypothetical protein | 2554 |
| C 1860823-1863092 | metE | | pseudogene for 5-nethyltetrahydropteroytrigultamate - homocysteine methyltransferase | 2555 |
| C 1863286-1864362 | — | | predicted permease | 2556 |
| C 1864359-1865462 | — | | predicted permease | 2557 |
| 1865570-1867045 | pepA | | cytosol aminopeptidase | 2558 |
| C 1867081-1869090 | — | | predicted choline-glycine betaine transporter | 2559 |
| C 1869385-1870740 | qseC | | sensor protein QseC | 2560 |
| C 1870737-1871402 | qseB | | transcriptional regulatory protein QseB | 2561 |
| C 1871466-1871831 | — | | conserved hypothetical protein | 2562 |
| C 1871946-1872966 | Pmi | ✓ | pseudogene for mannose-6-phosphate isomerase | 2563 |
| C 1873336-1873836 | crr | | PTS system, glucose-specific IIA component | 2564 |
| C 1873896-1875623 | ptsI | | Phosphoenolpyruvate-protein phosphotransferase | 2565 |
| C 1875703-1875960 | ptsH | | Phosphocarrier protein HPr | 2566 |
| C 1876119-1877159 | — | | probable GTPase | 2567 |
| 1877230-1877778 | orn | | oligoribonuclease | 2568 |
| C 1878178-1879245 | wecA | | undecaprenyl phosphate | 2569 |
| C 1879320-1881911 | glnD | | [protein-PII] uridylyltransferase | 2570 |
| C 1882005-1882811 | map | | methionine aminopeptidase | 2571 |
| 1882947-1883291 | — | | conserved hypothetical protein | 2572 |
| 1883293-1883646 | — | | conserved hypothetical protein | 2573 |
| 1883653-1885998 | mrcB | | penicillin-binding protein 1B | 2574 |
| 1886123-1887043 | purC | | phosphoribosylaminoimidazole-succinocarboxamine synthase | 2575 |
| 1887199-1888533 | argG | | argininosuccinate synthase | 2576 |
| C 1888604-1889797 | — | | Mn2+ and Fe2+ transporter of the NRAMP family | 2577 |
| C 1889841-1890578 | — | | conserved hypothetical protein | 2578 |
| C 1890565-1891494 | — | | predicted allophanate hydrolase subunit 2 | 2579 |
| C 1891491-1892132 | — | | predicted allophanate hydrolase subunit 1 | 2580 |
| C 1892394-1894373 | rnb | | exoribonuclease II | 2581 |
| C 1894471-1895358 | fabI | | enoyl-[acyl-carrier-protein] reductase [NADH] | 2582 |
| 1895438-1897021 | prfC | | peptide chain release factor 3 | 2583 |
| C 1897097-1897330 | — | | conserved hypothetical protein | 2584 |
| C 1897433-1897762 | — | | predicted branched chain amino acid permease | 2585 |
| C 1897759-1898493 | — | | predicted branched chain amino acid permease | 2586 |
| C 1898503-1899432 | metR | | HTH-type transcriptional regulator MetR | 2587 |
| C 1905763-1906908 | lldD | | L-lactate dehydrogenase | 2588 |
| C 1907120-1907929 | murI | | glutamate racemase | 2589 |
| C 1907959-1910040 | recG | | ATP-dependent DNA helicase | 2590 |
| C 1910037-1912151 | spoT | | guanosine-3',5'-bis 3'pyrophosphohydrolase | 2591 |
| C 1912224-1912490 | rpoZ | | DNA directed RNA polymerase omega chain | 2592 |
| C 1912553-1913179 | gmk | | guanylate kinase | 2593 |

TABLE 7

Gene Products of the NTHi Genome

| Gene Name | Product Name | SEQ ID NO: |
|---|---|---|
| gapA | glyceraldehyde 3-phosphate dehydrogenase | 2594 |
| — | putative long-chain-fatty-acid--CoA ligase | 2595 |
| — | conserved hypothetical protein | 2596 |
| — | conserved hypothetical protein | 2597 |
| fdhD | FdhD protein homolog | 2598 |
| fdxG | formate dehydrogenase major subunit | 2599 |
| fdxH | formate dehydrogenase, iron-sulfur subunit | 2600 |
| fdxI | formate dehydrogenase, cytochrome B556 subunit | 2601 |
| fdhE | FdhE homolog | 2602 |
| rimI | ribosomal-protein-alanine acetyltransferase | 2603 |
| holD | DNA polymerase III, psi subunit | 2604 |
| rsmC | ribosomal RNA small subunit methyltransferase C | 2605 |
| era | GTP-binding protein era homolog | 2606 |
| rnc | ribonuclease III | 2607 |
| lepB | Signal peptidase I | 2608 |
| lepA | GTP-binding protein LepA | 2609 |
| — | conserved hypothetical acid-induced glycyl radical enzyme | 2610 |
| ung | uracil-DNA glycosylase | 2611 |
| — | conserved hypothetical protein | 2612 |
| — | conserved hypothetical protein | 2613 |
| citG | CitXG | 2614 |
| citF | citrate lyase alpha chain | 2615 |
| citE | citrate lyase beta chain | 2616 |
| citD | citrate lyase acyl carrier protein | 2617 |
| citC | [citrate [pro-3S]-lyase] ligase | 2618 |
| lipA | Lipoic acid synthetase | 2619 |
| lipB | lipoate-protein ligase B | 2620 |
| — | conserved hypothetical protein | 2621 |
| dacA | penicillin-binding protein 5 precursor | 2622 |
| rlpA | RlpA-like protein | 2623 |
| mrdB | Rod shape-determining protein RodA | 2624 |
| mrdA | penicillin-binding protein 2 | 2625 |
| — | conserved hypothetical protein | 2626 |
| — | conserved hypothetical protein | 2627 |
| — | conserved hypothetical membrane protein | 2628 |
| — | conserved hypothetical ABC transporter ATP-binding protein | 2629 |
| mreB | rod shape-determining protein MreB | 2630 |
| mreC | rod shape-determining protein MreC | 2631 |
| mreD | rod shape-determining protein MreD | 2632 |
| — | conserved hypothetical protein | 2633 |
| xthA | exodeoxyribonuclease III | 2634 |
| rluA2 | conserved hypothetical pseudouridine synthase | 2635 |
| — | conserved hypothetical membrane protein | 2636 |
| — | conserved hypothetical FtsH-interacting integral membrane protein | 2637 |
| — | conserved hypothetical protein | 2638 |
| phnA | PhnA homolog | 2639 |
| eda | KHG/KDPG aldolase | 2640 |
| uxuC | uronate isomerase | 2641 |
| — | putative oxidoreductase | 2642 |
| — | putative TRAP-type C4-dicarboxylate transport system, large permease component | 2643 |
| — | putative TRAP-type C4-dicarboxylate transport system, small permease component | 2644 |
| — | putative TRAP-type C4-dicarboxylate transport system, periplasmic component | 2645 |
| — | conserved hypothetical zinc-type alcohol dehydrogenase-like protein | 2646 |
| uxuR | Uxu operon regulator | 2647 |
| uxuA | mannonate dehydratase | 2648 |
| — | putative membrane protein TerC | 2649 |
| uvrC | UvrABC system protein C | 2650 |
| kdsB | 3-deoxy-D-manno-octulosonic acid cytidylyltransferase | 2651 |
| lpxK | tetraacyldisaccharide 4'-kinase | 2652 |
| msbA | lipid A export ATP-binding protein MsbA | 2653 |
| rec2 | recombination protein 2 | 2654 |
| dksA | DnaK suppressor protein | 2655 |
| pcnB | probable poly polymerase | 2656 |
| folK | 2-amino-4-hydroxy-6-hydroxymethyl-dihydropteridine pyrophosphokinase | 2657 |
| — | conserved hypothetical protein | 2658 |
| amiB | probable N-acetylmuramoyl-L-alanine amidase AmiB precursor | 2659 |

TABLE 7-continued

Gene Products of the NTHi Genome

| Gene Name | Product Name | SEQ ID NO: |
|---|---|---|
| mutL | DNA mismatch repair protein MutL | 2660 |
| miaA | tRNA delta-isopentenylpyrophosphate transferase | 2661 |
| glnE | glutamate-ammonia-ligase adenylyltransferase | 2662 |
| recN | DNA repair protein RecN | 2663 |
| ppnK | probable inorganic polyphosphate/ATP-NAD kinase | 2664 |
| grpE | grpE | 2665 |
| — | conserved hypothetical protein | 2666 |
| — | conserved hypothetical protein | 2667 |
| nrdD | anaerobic ribonucleoside-triphosphate reductase | 2668 |
| tesB | Acyl-CoA thioesterase II | 2669 |
| cysS | cysteinyl-tRNA synthetase | 2670 |
| ppiB | peptidyl-prolyl cis-trans isomerase B | 2671 |
| — | conserved hypothetical protein | 2672 |
| — | putative deoxyribonuclease | 2673 |
| — | hypothetical protein | 2674 |
| — | hypothetical protein | 2675 |
| trxA | thioredoxin | 2676 |
| ddh | 2-hydroxyacid dehydrogenase homolog | 2677 |
| metB | cystathionine gamma-synthase | 2678 |
| — | predicted ATPase involved in chromosome partitioning | 2679 |
| dnaB2 | replicative DNA helicase | 2680 |
| — | conserved hypothetical protein | 2681 |
| — | conserved hypothetical protein | 2682 |
| — | conserved hypothetical protein | 2683 |
| — | conserved hypothetical protein | 2684 |
| — | conserved hypothetical protein | 2685 |
| ssb2 | Single-strand binding protein | 2686 |
| — | conserved putative lipoprotein | 2687 |
| — | 1conserved hypothetical protein | 2688 |
| topB2 | DNA topoisomerase III | 2689 |
| — | conserved hypothetical protein | 2690 |
| — | hypothetical protein | 2691 |
| — | conserved hypothetical protein | 2692 |
| — | hypothetical protein | 2693 |
| radC2 | putative DNA repair radC-like protein | 2694 |
| — | conserved hypothetical protein | 2695 |
| — | conserved hypothetical protein | 2696 |
| pilL | conserved putative lipoprotein | 2697 |
| — | conserved putative exported protein | 2698 |
| — | conserved putative exported protein | 2699 |
| — | conserved putative exported protein | 2700 |
| — | conserved hypothetical protein | 2701 |
| — | conserved putative membrane protein | 2702 |
| — | conserved putative membrane protein | 2703 |
| — | conserved putative membrane protein | 2704 |
| — | conserved putative membrane protein | 2705 |
| — | conserved putative exported protein | 2706 |
| — | conserved hypothetical protein | 2707 |
| — | conserved putative exported protein | 2708 |
| — | conserved putative lipoprotein | 2709 |
| — | conserved hypothetical protein | 2710 |
| — | conserved hypothetical protein | 2711 |
| — | conserved hypothetical membrane protein | 2712 |
| — | conserved putative membrane protein | 2713 |
| — | conserved hypothetical membrane protein | 2714 |
| tnpA | transposon Tn3 transposase | 2715 |
| — | hypothetical protein | 2716 |
| tnpR | transposon Tn3 resolvase | 2717 |
| — | hypothetical protein | 2718 |
| — | hypothetical exported protein | 2719 |
| — | conserved putative exported protein | 2720 |
| — | conserved putative exported protein | 2721 |
| — | conserved hypothetical protein | 2722 |
| — | conserved hypothetical membrane protein | 2723 |
| — | conserved hypothetical protein | 2724 |
| — | hypothetical protein | 2725 |
| — | hypothetical protein | 2726 |
| traC | conserved putative antirestriction protein | 2727 |
| — | possible type I restriction enzyme M subunit | 2728 |
| — | hypothetical protein | 2729 |
| — | conserved hypothetical protein | 2730 |
| — | conserved hypothetical protein | 2731 |
| — | conserved hypothetical protein | 2732 |
| — | resolvase/integrase-like protein | 2733 |
| — | hypothetical protein | 2734 |

TABLE 7-continued

Gene Products of the NTHi Genome

| Gene Name | Product Name | SEQ ID NO: |
|---|---|---|
| — | hypothetical protein | 2735 |
| — | conserved hypothetical protein | 2736 |
| — | hypothetical protein | 2737 |
| — | conserved hypothetical protein | 2738 |
| — | putative site-specific recombinase | 2739 |
| thrC | threonine synthase | 2740 |
| thrB | homoserine kinase | 2741 |
| thrA | aspartokinase/homoserine dehydrogenase | 2742 |
| — | conserved hypothetical protein | 2743 |
| grk | glycerate kinase | 2744 |
| — | conserved hypothetical protein | 2745 |
| — | conserved hypothetical protein | 2746 |
| — | conserved hypothetical protein | 2747 |
| — | conserved hypothetical protein | 2748 |
| — | conserved hypothetical protein | 2749 |
| hitA | iron-utilization periplasmic protein hFbpA | 2750 |
| hitB | iron(III)-transport system permease protein hFbpB | 2751 |
| hitC | iron-utilization ATP-binding protein hFbpC | 2752 |
| — | putative D-alanyl-D-alanine carboxypeptidase | 2753 |
| dapE | succinyl-diaminopimelate desuccinylase | 2754 |
| — | conserved hypothetical protein | 2755 |
| — | chaperone protein HtpG | 2756 |
| — | conserved hypothetical NIF3-like protein | 2757 |
| hsdM1 | putative type I restriction-modification system, methyltransferase subunit | 2758 |
| — | predicted transcriptional regulator containing an HTH domain | 2759 |
| hsdS1 | putative type I site-specific restriction-modification system, S subunit | 2760 |
| hsdR1 | putative type I site-specific restriction-modification system, R subunit | 2761 |
| ffh | Signal recognition particle protein | 2762 |
| corB | putative Mg2+ and Co2+ transporter | 2763 |
| — | conserved hypothetical protein | 2764 |
| — | conserved hypothetical protein | 2765 |
| — | conserved hypothetical protein | 2766 |
| serS | Seryl-tRNA synthetase | 2767 |
| gst | glutathione S-transferase | 2768 |
| — | conserved hypothetical protein | 2769 |
| hemR | hemin receptor | 2770 |
| — | possible SAM-dependent methyltransferase | 2771 |
| mltA | membrane-bound lytic murein transglycosylase A precursor | 2772 |
| — | conserved hypothetical protein | 2773 |
| znuA | high-affinity zinc uptake system protein ZnuA | 2774 |
| — | conserved hypothetical protein | 2775 |
| mpl | UDP-N-acetylmuramate:L-alanyl-gamma-D-glutamyl-meso-diaminopimelate ligase | 2776 |
| metC | cystathionine beta-lyase | 2777 |
| tsaA | probable peroxiredoxin | 2778 |
| pgsA | CDP-diacylglycerol--glycerol-3-phosphate 3-phosphatidyltransferase | 2779 |
| ppa | inorganic pyrophosphatase | 2780 |
| — | conserved hypothetical protein | 2781 |
| udk | uridine kinase | 2782 |
| dcd | deoxycytidine triphosphate deaminase | 2783 |
| — | conserved hypothetical protein | 2784 |
| — | probable sugar efflux transporter | 2785 |
| engA | GTP-binding protein EngA | 2786 |
| dnaQ | DNA polymerase III, epsilon chain | 2787 |
| rnhA | ribonuclease HI | 2788 |
| omP2 | Outer membrane protein P2 precursor | 2789 |
| nagA | N-acetylglucosamine-6-phosphate deacetylase | 2790 |
| nagB | glucosamine-6-phosphate deaminase | 2791 |
| nanA | N-acetylneuraminate lyase | 2792 |
| — | putative HTH-type transcriptional regulator | 2793 |
| nanK | putative N-acetylmannosamine kinase | 2794 |
| nanE | putative N-acetylmannosamine-6-phosphate 2-epimerase | 2795 |
| — | putative sialic acid transporter, TRAP-type C4-dicarboxylate transport system, periplasmic component | 2796 |
| siaT | putative sialic acid transporter, TRAP-type C4-dicarboxylate transport system, large permease component | 2797 |

TABLE 7-continued

Gene Products of the NTHi Genome

| Gene Name | Product Name | SEQ ID NO: |
|---|---|---|
| — | conserved hypothetical protein | 2798 |
| — | putative protein-S-isoprenylcysteine methyltransferase | 2799 |
| hflC | HflC | 2800 |
| hflK | HhflK | 2801 |
| — | putative 4'-phosphopantetheinyl transferase | 2802 |
| dcuB2 | anaerobic C4-dicarboxylate transporter DcuB | 2803 |
| acpP | acyl carrier protein | 2804 |
| fabG | 3-oxoacyl-[acyl-carrier protein] reductase | 2805 |
| fabD | malonyl CoA-acyl carrier protein transacylase | 2806 |
| fabH | 3-oxoacyl-[acyl-carrier-protein] synthase III | 2807 |
| rpmF | 50S ribosomal protein L32 | 2808 |
| — | conserved hypothetical protein | 2809 |
| psd | phosphatidylserine decarboxylase proenzyme | 2810 |
| gor | glutathione reductase | 2811 |
| — | conserved hypothetical lipoprotein | 2812 |
| nqrA | Na(+)-translocating NADH-quinone reductase subunit A | 2813 |
| nqrB | Na(+)-translocating NADH-quinone reductase subunit B | 2814 |
| nqrC | Na(+)-translocating NADH-quinone reductase subunit C | 2815 |
| nqrD | Na(+)-translocating NADH-quinone reductase subunit D | 2816 |
| nqrE | Na(+)-translocating NADH-quinone reductase subunit E | 2817 |
| nqrF | Na(+)-translocating NADH-quinone reductase subunit F | 2818 |
| apbE | thiamine biosynthesis lipoprotein ApbE | 2819 |
| — | conserved hypothetical protein | 2820 |
| trmU | probable tRNA (5-methylaminomethyl-2-thiouridylate)-methyltransferase | 2821 |
| — | conserved hypothetical protein | 2822 |
| rluD | ribosomal large subunit pseudouridine synthase D | 2823 |
| — | conserved hypothetical lipoprotein | 2824 |
| — | conserved hypothetical protein | 2825 |
| pflA | pyruvate formate-lyase 1 activating enzyme | 2826 |
| pflB | formate acetyltransferase | 2827 |
| focA | probable formate transporter | 2828 |
| — | conserved hypothetical protein | 2829 |
| — | putative Na+/alanine symporter | 2830 |
| — | conserved hypothetical protein | 2831 |
| — | putative HTH-type transcriptional regulator | 2832 |
| tatA | Sec-independent protein translocase protein TatA/E | 2833 |
| tatB | Sec-independent protein translocase protein TatB | 2834 |
| tatC | Sec-independent protein translocase protein TatC | 2835 |
| gdhA | NADP-specific glutamate dehydrogenase | 2836 |
| fur | Ferric uptake regulation protein | 2837 |
| fldA | flavodoxin | 2838 |
| seqA | seqA | 2839 |
| — | putative esterase/lipase | 2840 |
| menE | O-succinylbenzoate--CoA ligase | 2841 |
| — | putative small-conductance mechanosensitive channel | 2842 |
| aroC | chorismate synthase | 2843 |
| mepA | penicillin-insensitive murein endopeptidase | 2844 |
| — | conserved hypothetical protein | 2845 |
| msbB | lipid A biosynthesis (KDO)2-(lauroyl)-lipid IVA acyltransferase | 2846 |
| selD | selenide, water dikinase | 2847 |
| rplsS | 50S ribosomal protein L19 | 2848 |
| trmD | tRNA (guanine-N(1)-)-methyltransferase | 2849 |
| rimM | 16S rRNA processing protein RimM | 2850 |
| rspP | 30S ribosomal protein S16 | 2851 |
| — | conserved hypothetical protein | 2852 |
| nadN | NAD nucleotidase | 2853 |
| aroK | shikimate kinase | 2854 |
| aroB | 3-dehydroquinate synthase | 2855 |
| dam | DNA adenine methylase | 2856 |
| — | conserved hypothetical protein | 2857 |
| pgpB | phosphatidylglycerophosphatase B | 2858 |

TABLE 7-continued

Gene Products of the NTHi Genome

| Gene Name | Product Name | SEQ ID NO: |
|---|---|---|
| ribA | GTP cyclohydrolase II | 2859 |
| — | putative ABC-type oligopeptide transport system, periplasmic component | 2860 |
| — | conserved hypothetical protein | 2861 |
| prlc | oligopeptidase A | 2862 |
| Hsdm2 | putative type I restriction-modification system methyltransferase subunit | 2863 |
| Hsds2 | putative type I restriction-modification system specificity protein | 2864 |
| prrC | putative anticodon nuclease | 2865 |
| — | conserved hypothetical DNA binding protein | 2866 |
| Hsdr2 | putative type I restriction-modification system | 2867 |
| — | conserved hypothetical protein | 2868 |
| arcb | aerobic respiration control sensor protein ArcB | 2869 |
| — | predicted uracil-DNA glycosylase | 2870 |
| bira | BirA bifunctional protein | 2871 |
| guab | inosine-5'-monophosphate dehydrogenase | 2872 |
| guaa | glutamine-hydrolyzing GMP synthase | 2873 |
| — | conserved hypothetical protein | 2874 |
| — | putative transcriptional regulator | 2875 |
| nhaa | Na(+)/H(+) antiporter 1 | 2876 |
| brnq | branched-chain amino acid transport system carrier protein | 2877 |
| — | conserved hypothetical protein | 2878 |
| — | conserved hypothetical protein | 2879 |
| pnp | polyribonucleotide nucleotidyltransferase | 2880 |
| nlpL | lipoprotein NlpI | 2881 |
| dead | Cold-shock DEAD-box protein A homolog | 2882 |
| — | predicted soluble lytic transglycosylase fused to an ABC-type amino acid-binding protein | 2883 |
| — | conserved hypothetical protein | 2884 |
| — | conserved hypothetical protein | 2885 |
| — | conserved hypothetical protein | 2886 |
| arsc | putative arsenate reductase | 2887 |
| perm | putative permease PerM homolog | 2888 |
| secf | protein-export membrane protein SecF | 2889 |
| secd | protein-export membrane protein SecD | 2890 |
| — | conserved hypothetical preprotein translocase subunit YajC | 2891 |
| — | predicted redox protein, regulator of disulfide bond formation | 2892 |
| — | conserved hypothetical protein | 2893 |
| tgt | queuine tRNA-ribosyltransferase | 2894 |
| quea | S-adenosylmethionine:tRNA ribosyltransferase-isomerase | 2895 |
| — | conserved hypothetical protein | 2896 |
| hap | adhesion and penetration protein Hap | 2897 |
| uvra | UvrABC system protein A | 2898 |
| ssb | Single-strand binding protein | 2899 |
| tonb | TonB | 2900 |
| exbd | transport protein ExbD | 2901 |
| exbb | transport protein ExbB | 2902 |
| bcp | bacterioferritin comigratory protein | 2903 |
| dapa | dihydrodipicolinate synthase | 2904 |
| — | conserved hypothetical lipoprotein | 2905 |
| — | conserved hypothetical protein | 2906 |
| lgtC | UDP-galactose--lipooligosaccharide galactosyltransferase | 2907 |
| orfM | predicted xanthosine triphosphate pyrophosphatase | 2908 |
| kdkA | 3-deoxy-D-manno-octulosonic acid kinase | 2909 |
| opsX | ADP-heptose--lipooligosaccharide heptosyltransferase I | 2910 |
| hxuC | heme/hemopexin-binding protein C | 2911 |
| hxuB | heme/hemopexin-binding protein B | 2912 |
| hxuA | heme/hemopexin-binding protein A | 2913 |
| folB | dihydroneopterin aldolase | 2914 |
| — | conserved hypothetical protein | 2915 |
| narQ | sensor protein NarQ | 2916 |
| murB | UDP-N-acetylenolpyruvoylglucosamine reductase | 2917 |
| rpoH | RNA polymerase sigma-32 factor | 2918 |
| djlA | DnaJ-like protein DjlA | 2919 |
| pyrE | orotate phosphoribosyltransferase | 2920 |
| rph | ribonuclease PH | 2921 |
| gltX | glutamyl-tRNA synthetase | 2922 |
| Lpt6 | PE-tn-6--lipooligosaccharide phosphorylethanolamine transferase | 2923 |

TABLE 7-continued

Gene Products of the NTHi Genome

| Gene Name | Product Name | SEQ ID NO: |
|---|---|---|
| rbn | tRNA processing ribonuclease BN | 2924 |
| — | conserved hypothetical protein | 2925 |
| — | conserved hypothetical protein | 2926 |
| udp | uridine phosphorylase | 2927 |
| — | conserved hypothetical metabolite transport protein | 2928 |
| — | conserved hypothetical protein | 2929 |
| mend | menaquinone biosynthesis protein MenD | 2930 |
| menf | menaquinone-specific isochorismate synthase | 2931 |
| Aspc3 | probable aspartate aminotransferase | 2932 |
| mtr | tryptophan-specific transport protein | 2933 |
| sdaa | L-serine dehydratase | 2934 |
| sdac | Serine transporter | 2935 |
| — | probable cation-transporting ATPase | 2936 |
| — | probable heavy metal dependent transcriptional regulator | 2937 |
| metJ | Met repressor | 2938 |
| rho | transcription termination factor rho | 2939 |
| pilD | putative type 4 prepilin-like protein specific leader peptidase | 2940 |
| pilC | putative type IV pilin secretion protein | 2941 |
| pilB | putative type IV pilin secretion protein | 2942 |
| pilA | Type IV pilin subunit protein | 2943 |
| ampD | ampD | 2944 |
| corC | magnesium and cobalt efflux protein CorC | 2945 |
| cutE | apolipoprotein N-acyltransferase | 2946 |
| — | conserved hypothetical RNA methyltransferase | 2947 |
| — | conserved hypothetical protein | 2948 |
| ruvX | putative holliday junction resolvase | 2949 |
| — | prophage CP4-57-like integrase | 2950 |
| — | hypothetical protein | 2951 |
| — | hypothetical protein | 2952 |
| — | hypothetical protein | 2953 |
| — | hypothetical protein | 2954 |
| — | hypothetical protein | 2955 |
| — | hypothetical protein | 2956 |
| proC | pyrroline-5-carboxylate reductase | 2957 |
| hcaT | probable 3-phenylpropionic acid transporter | 2958 |
| xerD | Site-specific recombinase XerD | 2959 |
| — | conserved hypothetical protein | 2960 |
| ruvB | holliday junction DNA helicase RuvB | 2961 |
| ruvA | holliday junction DNA helicase RuvA | 2962 |
| ruvC | holliday junction DNA helicase RuvC | 2963 |
| — | conserved hypothetical protein | 2964 |
| ntpA | dATP pyrophosphohydrolase | 2965 |
| aspS | Aspartyl-tRNA synthetase | 2966 |
| — | conserved hypothetical protein | 2967 |
| — | conserved hypothetical protein | 2968 |
| — | conserved hypothetical protein | 2969 |
| — | Predicted nucleic acid-binding domain, contains PIN domain | 2970 |
| gloA | Lactoylglutathione lyase | 2971 |
| Rnt | Ribonuclease T | 2972 |
| — | conserved hypothetical protein | 2973 |
| — | Predicted primosomal replication protein N | 2974 |
| Efp | Elongation factor P | 2975 |
| — | Predicted lysine 2,3-aminomutase | 2976 |
| oapA | Opacity associated protein OapA | 2977 |
| oapB | Opacity associated protein OapB | 2978 |
| recO | DNA repair protein RecO | 2979 |
| rumA | 23S rRNA (uracil-5--)methyltransferase RumA | 2980 |
| relA | GTP pyrophosphokinase | 2981 |
| dgkA | Diacylglycerol kinase | 2982 |
| Mog | Molybdopterin biosynthesis mog protein | 2983 |
| glnB | Nitrogen regulatory protein P-II | 2984 |
| — | conserved hypothetical protein | 2985 |
| priA | Prismosomal protein N | 2986 |
| trmB | tRNA (guanine-N(7)-)-methyltransferase | 2987 |
| — | conserved hypothetical protein | 2988 |
| napF | Ferredoxin-type protein NapF | 2989 |
| napD | NapD | 2990 |
| napA | Periplasmic nitrate reductase | 2991 |
| napG | Ferredoxin-type protein NapG | 2992 |
| napH | Ferredoxin-type protein NapH | 2993 |
| napB | Diheme cytochrome C NapB | 2994 |
| napC | Cytochrome C-type protein NapC | 2995 |

TABLE 7-continued

Gene Products of the NTHi Genome

| Gene Name | Product Name | SEQ ID NO: |
|---|---|---|
| Adk | Adenylate kinase | 2996 |
| Lic3c | Putative integral membrane signal transducer protein | 2997 |
| galE | UDP-glucose 4-epimerase | 2998 |
| Lic3A | CMP-Neu5Ac--lipooligosaccharide alpha 2-3 sialytransferase | 2999 |
| — | Putative ABC-type nitrate/sulfonate/bicarbonate transport system, ATPase component | 3000 |
| — | Putative ABC-type nitrate/sulfonate/bicarbonate transport system, permease component | 3001 |
| — | Putative ABC-type nitrate/sulfonate/bicarbonate transport system, periplasmic component | 3002 |
| — | Putative transcription activator | 3003 |
| hfeD | Putative ABC-type chelated iron transport system, permease component | 3004 |
| hfeC | Putative ABC-type chelated iron transport system, permease component | 3005 |
| hfeB | Putative ABC-type chelated iron transport system, ATPase component | 3006 |
| hfeA | Putative periplasmic chelated iron binding protein | 3007 |
| — | Hypothetical protein | 3008 |
| pbpG | Penicillin-binding protein 7 homolog precursos | 3009 |
| — | Predicted Fe—S-cluster redox enzyme | 3010 |
| — | Conserved hypothetical protein | 3011 |
| — | Conserved hypothetical transcriptional regulator with an N-terminal xre-type HTH domain | 3012 |
| gcpE | 4-hydroxy-2-methyl-2-(E)-butenyl 4-diphosphate synthase | 3013 |
| hisS | Histidyl-tRNA synthetase | 3014 |
| — | Conserved hypothetical protein | 3015 |
| — | conserved hypothetical protein | 3016 |
| Fdx | Feerdoxin, 2Fe—S | 3017 |
| hscA | Chaperone protein HscA | 3018 |
| — | Conserved hypothetical protein | 3019 |
| hscB | Co-chaperone protein HscB | 3020 |
| — | Conserved hypothetical protein | 3021 |
| nifU | NifU-like protein | 3022 |
| nifS2 | Cysteine sedulferase | 3023 |
| — | Predicted transcriptional regulator | 3024 |
| — | Hypothetical tRNA/rRNA methyltransferase | 3025 |
| Pal | Outer membrane protein P6 precursor | 3026 |
| tolB | TolB | 3027 |
| tolA | TolA | 3028 |
| tolR | TolR | 3029 |
| tolQ | TolQ | 3030 |
| — | Predicted thioestererase | 3031 |
| dinG | Probable ATP-dependent helicase | 3032 |
| — | Possible inactive homolog of metal-dependent proteases, putative molecular chaperone | 3033 |
| — | possible starvation-inducible outer membrane lipoprotein | 3034 |
| lcfA | Long chain fatty acid CoA ligase | 3035 |
| rnD | Ribonuclease D | 3036 |
| — | Conserved hypothetical acyltransferase | 3037 |
| — | Predicted GTPase, probable translation factor | 3038 |
| Pth | Peptidyl-tRNA hydrolase | 3039 |
| — | Conserved hypothetical protein | 3040 |
| — | Conserved hypothetical cupin superfamily metalloenzyme | 3041 |
| xseA | Exodeoxyribonuclease VII large subunit | 3042 |
| adpP | ADP-ribose pyrophoaphatase | 3043 |
| Icc | Predicted phosphohydrolase | 3044 |
| — | Conserved hypothetical protein | 3045 |
| ompP1 | Outer membrane protein P1 precursor | 3046 |
| Ogt | Methylated-DNA-protein-cysteine | 3047 |
| mutH | DNA mismatch repair protein MutH | 3048 |
| mesJ | Putative cell cycle protein MesJ | 3049 |
| accA | Acetyl-coenzyme A carboxylase carboxyl transferase subunit alpha | 3050 |
| znuB | High affinity zinc uptake system membrane protein ZnuB | 3051 |
| znuC | High-affinity zinc uptake system ATP binding protein AnuC | 3052 |
| — | Conserved hypothetical metalloprotease | 3053 |
| tyrR | Transcriptional regulatory protein TyrR | 3054 |
| hfq | host factor-I protein Hfq | 3055 |
| rluC | ribosomal large subunit pseudouridine synthase C | 3056 |

TABLE 7-continued

Gene Products of the NTHi Genome

| Gene Name | Product Name | SEQ ID NO: |
|---|---|---|
| rne | ribonuclease E | 3057 |
| — | Conserved hypothetical protein | 3058 |
| thiM | hydroxyethylthiazole kinase | 3059 |
| thiD | phosphomethylpyrimidine kinase | 3060 |
| thiE | thiamine-phosphate pyrophosphorylase | 3061 |
| — | Conserved hypothetical metabolite transport | 3062 |
| — | hypothetical protein | 3063 |
| — | putative protease | 3064 |
| srmB | ATP-dependent RNA helicase SrmB | 3065 |
| — | predicted O-methyltransferase | 3066 |
| pssA | CDP-diacylglycerol--serine O-phosphatidyltransferase | 3067 |
| fadR | fatty acid metabolism regulator protein | 3068 |
| nhaB | Na(+)/H(+) antiporter 2 | 3069 |
| dsbB | disulfide bond formation protein B | 3070 |
| glmS | glucosamine--fructose-6-phosphate aminotransferase | 3071 |
| hupA | DNA-binding protein HU | 3072 |
| — | conserved hypothetical protein | 3073 |
| nudC | NADH pyrophosphatase | 3074 |
| orfG | conserved hypothetical 21.9 KD protein in locus involved in transformation | 3075 |
| comF | competence protein F | 3076 |
| comE | competence protein E | 3077 |
| comD | competence protein D | 3078 |
| comC | competence protein C | 3079 |
| comB | competence protein B | 3080 |
| comA | competence protein A | 3081 |
| mrcA | penicillin-binding protein 1A | 3082 |
| — | conserved hypothetical protein | 3083 |
| — | conserved hypothetical protein | 3084 |
| recR | recombination protein RecR | 3085 |
| topB | DNa topoisomerase III | 3086 |
| secG | protein-export membrane protein SecG | 3087 |
| fruA | PTS system, fructose-specific IIBC component | 3088 |
| fruK | 1-phosphofructokinase | 3089 |
| fruB | PTS system, fructose-specific IIA/FPr component | 3090 |
| — | conserved hypothetical protein | 3091 |
| vapD | virulence-associated protein D | 3092 |
| vapX | VapX | 3093 |
| — | conserved hypothetical protein | 3094 |
| — | conserved hypothetical protein | 3095 |
| — | putative deoxyribonuclease | 3096 |
| holB | DNA polymerase III, delta subunit | 3097 |
| — | hypothetical protein | 3098 |
| lav | autotransported protein Lav | 3099 |
| tmk | thymidylate kinase | 3100 |
| — | predicted periplasmic solute-binding protein | 3101 |
| surA | survival protein SurA homolog | 3102 |
| pyrR | PyrR bifunctional protein | 3103 |
| mazG | predicted pyrophosphatase MazG | 3104 |
| — | conserved hypothetical protein | 3105 |
| lon | ATP-dependent protease La | 3106 |
| — | predicted Fe—S oxidoreductase | 3107 |
| rpiA | ribose 5-phosphate isomerase A | 3108 |
| serA | D-3-phosphoglycerate dehydrogenase | 3109 |
| — | predicted aminomethyltransferase related to GcvT | 3110 |
| — | conserved hypothetical stress-induced protein | 3111 |
| hisG | ATP phosphoribosyltransferase | 3112 |
| hisD | histidinol dehydrogenase | 3113 |
| hisC | hisitidinol-phosphate aminotransferase 1 | 3114 |
| hisB | histidine biosynthesis bifunctional protein HisB | 3115 |
| hisH | imidazole glycerol phosphate synthase subunit HisH | 3116 |
| hisA | 1-5-[methylideneamino] imidazole-4-carboxamine isomerase | 3117 |
| hisF | imidazole glycerol phosphate synthase subunit HisF | 3118 |
| hisI | histidine biosynthesis bifunctional protein hisIE | 3119 |
| — | conserved hypothetical protein | 3120 |
| tyrP | tyrosine-specific transportprotein 1 | 3121 |
| atpC | ATP synthase epsilon chain | 3122 |
| atpD | ATP synthase beta chain | 3123 |
| atpG | ATP synthase gamma chain | 3124 |
| atpA | ATP synthase alpha chain | 3125 |
| atpH | ATP synthase delta chain | 3126 |
| atpF | ATP synthase B chain | 3127 |

TABLE 7-continued

Gene Products of the NTHi Genome

| Gene Name | Product Name | SEQ ID NO: |
|---|---|---|
| atpE | ATP cynthase C chain | 3128 |
| atpB | ATP synthase A chain | 3129 |
| — | predicted F0F1-type ATP synthase subunit I | 3130 |
| gidB | methyltransferase GidB | 3131 |
| — | conserved hypothetical protein | 3132 |
| — | predicted phosphatase/phosphohexomutase | 3133 |
| — | predicted membrane protein | 3134 |
| luxS | S-ribosylhomocysteinase | 3135 |
| aphA | Class B acid phosphatase | 3136 |
| hslV | ATP-dependent protease HslV | 3137 |
| hslU | HslU, ATP-dependent chaperone of the HslUV protease | 3138 |
| ptoD2 | spermidine/putrescine-binding periplasmic protein 2 precursor | 3139 |
| ordL | probable oxidoereductase OrdL | 3140 |
| rmuC | DNA recombination protein RmuC | 3141 |
| rbsD | ribose transport permease protein | 3142 |
| rbsA | ribose transport ATP-binding protein | 3143 |
| rbsC | ribose transport permease protein | 3144 |
| rbsB | ribose-binding periplasmic protein | 3145 |
| rbsK | ribokinase | 3146 |
| rbsR | ribose operon repressor | 3147 |
| — | predicted membrane protein | 3148 |
| menG | S-adenosylmethionine:2-demtyhylmenaquinone methyltransferase | 3149 |
| menA | 1,4-dihydroxy-2-naphthoate octaprenyltransferase | 3150 |
| — | conserved hypothetical protein | 3151 |
| tehA | tellurite resistance protein | 3152 |
| rpoC | DNA-directed RNA polymerase beta' chain | 3153 |
| rpoB | DNA-directed RNA polymerase beta chain | 3154 |
| rplA | 50S ribosomal protein L1 | 3155 |
| rplK | 50S ribosomal protein L11 | 3156 |
| deoD | purine nucleoside phosphorylase | 3157 |
| — | predicted nucleoside permease | 3158 |
| — | predicted pyruvate-formate lyase-activating enzyme | 3159 |
| — | conserved hypothetical glycyl radical protein | 3160 |
| — | predicted membrane protein | 3161 |
| waaQ | ADP-heptose--lipooligosaccharide heptosyltransferase III | 3162 |
| fba | frustose-biphosphate aldolase | 3163 |
| pgk | phosphoglycerate kinase | 3164 |
| — | probable rubonuclease I | 3165 |
| — | putative ferredoxin-like protein | 3166 |
| tyrQ | tyrosine-specific transport protein 2 | 3167 |
| tdk | thymidine kinase | 3168 |
| gcp | probable O-sialoglycoprotein endopeptidase | 3169 |
| rpsU | 30S ribosomal protein S21 | 3170 |
| — | DNA primase | 3171 |
| rpoD | DNA polymerase sigma factor RpoD | 3172 |
| aspA | aspartate ammonia-lyase | 3173 |
| ureH | urease accessory protein UreH | 3174 |
| ureG | urease accessory protein UreG | 3175 |
| ureF | urease accessory protein UreF | 3176 |
| ureE | urease accessory protein UreE | 3177 |
| ureC | urease alpha subunit | 3178 |
| ureB | urease beta subunit | 3179 |
| ureA | urease gamma subunit | 3180 |
| groES | 10 kDa chaperonin | 3181 |
| groEL | 60 kDa chaperonin | 3182 |
| rplI | 50S ribosomal protein L9 | 3183 |
| rpsR | 30S ribosomal protein S18 | 3184 |
| priB | primsomal replication protein N | 3185 |
| rpsF | 30S ribosomal protein S6 | 3186 |
| infA | translation initiation factor IF-1 | 3187 |
| ksgA | dimethyladenosine transferase | 3188 |
| lic2A | UDP-Gal--lipooligosaccharide galactosyltransferase | 3189 |
| apaH | bis-tetraphosphatase, symmetrical | 3190 |
| — | conserved hypothetical protein | 3191 |
| gnd | 6-phosphogluconate dehydrogenase decarboxylating | 3192 |
| — | conserved hypothetical protein | 3193 |
| — | conserved hypothetical protein | 3194 |
| devB | 6-phosphgluconolactonase | 3195 |
| zwf | glucose-6-phosphate 1-dehydrogenase | 3196 |
| cysQ | cysQ | 3197 |
| — | conserved hypothetical protein | 3198 |
| — | predicted membrane protein | 3199 |

TABLE 7-continued

Gene Products of the NTHi Genome

| Gene Name | Product Name | SEQ ID NO: |
|---|---|---|
| hslR | heat shock protein 15 homolog | 3200 |
| asnC | regulatory protein AsnC | 3201 |
| asnA | aspartate--ammonia ligase | 3202 |
| — | conserved hypothetical transposase-like protein | 3203 |
| — | hypothetical protein | 3204 |
| — | hypothetical protein | 3205 |
| — | hypothetical protein | 3206 |
| gph | phosphoglycolate phosphatase | 3207 |
| rpe | ribulose-phosphate 3-epimerase | 3208 |
| gyrB | DNA gyrase subunit B | 3209 |
| — | predicted transcriptional accessory protein | 3210 |
| greB | transcription elongation factor GreB | 3211 |
| — | conserved hypothetical transcriptional regulator | 3212 |
| oxyR | hydrogen peroxide-inducible genes activator | 3213 |
| pdgC | peroxiredoxin.glutaredoxin | 3214 |
| slyX | slyX | 3215 |
| fkby | probably FKBP-type peptidyl-proyl cis-trans isomerase | 3216 |
| — | conserved hypothetical protein | 3217 |
| — | uncharacterized conserved protein involved in intracellular sulfur reduction | 3218 |
| — | uncharacterized conserved protein involved in oxidation of intracellular sulfur | 3219 |
| — | uncharacterized conserved protein involved in oxidation of intracellular sulfur | 3220 |
| tufB | elongation factor Tu | 3221 |
| coaA | pantothenate kinase | 3222 |
| rseB | sigma-E factor regulatory protein RseB | 3223 |
| rseA | sigma-E factor negative regulator protein homolog | 3224 |
| rpoE | RNA polymerase sigma-E factor | 3225 |
| — | conserved hypothetical protein | 3226 |
| mscL | large-conductance mechanosensitive channel | 3227 |
| trkA | Trk system potassium uptake protein TrkA | 3228 |
| sun | SUN protein | 3229 |
| fmt | methionyl-tRNA formyltransferase | 3230 |
| def | peptide deformylase | 3231 |
| — | hypothetical protein | 3232 |
| — | hypothetical protein | 3233 |
| sxy | DNA transformation protein TfoX | 3234 |
| recA | RecA | 3235 |
| recX | regulatory protein RecX | 3236 |
| crcB | CrcB | 3237 |
| — | predicted hydrolase of the HAD superfamily | 3238 |
| argF | ornithine carbamoyltransferase, catabolic | 3239 |
| arcC | carbamate kinase | 3240 |
| — | predicted membrane protein | 3241 |
| hgpD | pseudogene for hemoglobin-haptoglobin binding protein D | 3242 |
| pepE | peptidase E | 3243 |
| — | predicted C4-dicarboxylate transporter | 3244 |
| abgA | aminobenzoyl-glutamate utilization protein A | 3245 |
| cpdB | 2',3'-cyclic-nucleotide 2'-phosphodiesterase | 3246 |
| — | HTH-type transcriptional regulator | 3247 |
| — | zinc transported ZitB | 3248 |
| gidA | glucose inhibited division protein A | 3249 |
| rpsL | 30S ribosoomal protein S12 | 3250 |
| rpsG | 30S ribosomal protein S7 | 3251 |
| fusA | elongation factor G | 3252 |
| tufB2 | elongation factor Tu | 3253 |
| — | predicted chloride channel protein | 3254 |
| — | predicted chloride channel protein | 3255 |
| dusA | tRNA-dihydrouridine synthase A | 3256 |
| — | conserved hypothetical protein | 3257 |
| trpS | tryptophanyl-tRNA synthetase | 3258 |
| — | predicted protein involved in purine metabolism | 3259 |
| purB | adenylosuccinate lyase | 3260 |
| rplJ | 50S ribosomal protein L10 | 3261 |
| rplL | 50S ribosomal protein L7/L12 | 3262 |
| glmU | bifunctional GlmU protein | 3263 |
| — | hypothetical protein | 3264 |
| pldB | probable lysophospholipase L2 | 3265 |
| asd | aspartate-semialdehyde dehydrogenase | 3266 |
| — | conserved hypothetical protein | 3267 |
| — | predicted 2-methylthioadenine synthetase | 3268 |
| mdaB | putative NADPH-quinone reductase, modulator of drug activity B | 3269 |

TABLE 7-continued

Gene Products of the NTHi Genome

| Gene Name | Product Name | SEQ ID NO: |
|---|---|---|
| rep | ATP-dependent DNA helicase rep | 3270 |
| — | predicted periplasmic lipoprotein | 3271 |
| kdtB | phosphopantetheine adenylyltransferase | 3272 |
| kdtA | 3-deoxy-D-manno-octulosonic acid transferase | 3273 |
| lgtF | UDP-glucose--lipooligosaccharide glucosyltransferase | 3274 |
| tag | DNA-3-methyladenine glycolase | 3275 |
| — | hypothetical protein | 3276 |
| aroE | shikimate 5-dehydrogenase | 3277 |
| — | predicted translation factor SUA5 | 3278 |
| — | Zn-finger domain associated with topoisomerase typr I | 3279 |
| — | probable ABC transporter, ATP binding protein | 3280 |
| — | putative HTH-type transcriptional regulator | 3281 |
| — | conserved hypothetical protein | 3282 |
| hgpB | hemoglobin-haptoglobin binding protein B | 3283 |
| — | hypothetical ABC transporter, ATP-binding protein | 3284 |
| — | probable ABC transporter, ATP binding protein | 3285 |
| — | conserved hypothetical protein | 3286 |
| — | conserved hypothetical protein | 3287 |
| — | putative HTH-type transcriptional regulator | 3288 |
| glpX | fructose-1,6-bisphosphatase class II GlpX | 3289 |
| — | conserved hypothetical protein | 3290 |
| mioC | MioC | 3291 |
| dtd | D-tyrosyl-tRNA (Tyr) deacylase | 3292 |
| ispF | 3-C-methyl-D-erythritol 2,4-cyclodiphosphate synthase | 3293 |
| ispD | 2-C-methyl-D-erythritol 4-phosphate cytidylyltransferase | 3294 |
| ftsB | cell division protein FtcB | 3295 |
| gpt | xanthine-guanine phosphoribosyltransferase | 3296 |
| pepD | aminoacyl-histidine dipeptidase | 3297 |
| xerC | site-specific recombinase XerC | 3298 |
| — | conserved hypothetical protein | 3299 |
| tpiA | triosephosphate isomerase | 3300 |
| glpE | thiosulfate sulfurtransferase GlpE | 3301 |
| — | conserved hypothetical protein | 3302 |
| ilvY | HTH-type transcriptional activator IlvY | 3303 |
| ilvC | ketol-acid reductoisomerase | 3304 |
| glpC | anaerobic glycerol-3-phosphate dehydrogenase subunit C | 3305 |
| glpB | anaerobic glycerol-3-phosphate dehydrogenase subunit B | 3306 |
| glpA | anaerobic glycerol-3-phosphate dehydrogenase subunit A | 3307 |
| glpT | glycerol-3-phosphate transporter | 3308 |
| glpQ | glycerophosphoryl diester phosphodiesterase precursor | 3309 |
| glpF | glycerol uptake facilitator protein | 3310 |
| glpK | glycerol kinase | 3311 |
| gpt2 | xanthine-guanine phosphoribosyltransferase | 3312 |
| hel | outer membrane protein P4, NADP phosphatase | 3313 |
| rluE | ribosomal large subunit pseudouridine synthase E | 3314 |
| — | conserved hypothetical protein | 3315 |
| — | conserved hypothetical protein | 3316 |
| slyD | FKBP-type peptidyl-prolyl cis-trans isomerase SlyD | 3317 |
| — | conserved hypothetical protein | 3318 |
| truD | tRNA pseudouridine synthase D | 3319 |
| surE | acid phosphatase surE | 3320 |
| — | conserved hypothetical protein | 3321 |
| — | conserved hypothetical protein | 3322 |
| lppB | outer membrane antigenic lipoprotein B | 3323 |
| tnaA | tryptophanase | 3324 |
| tnaB | tryptophan-specific transport protein | 3325 |
| mutS | DNA mismatch repair protein MutS | 3326 |
| selA | L-seryl-tRNA selenium transferase | 3327 |
| selB | selenocysteine-specific elongation factor | 3328 |
| — | hypothetical protein | 3329 |
| — | conserved hypothetical protein | 3330 |
| — | conserved hypothetical protein | 3331 |
| hgpC | pseudogene for hemoglobin-haptoglobin utilization protein C | 3332 |
| tig | trigger factor | 3333 |
| clpP | ATP-dependent clp protease proteolytic subunit | 3334 |
| clpX | ATP-dependent Clp protease ATP-binding subunit ClpX | 3335 |

TABLE 7-continued

Gene Products of the NTHi Genome

| Gene Name | Product Name | SEQ ID NO: |
|---|---|---|
| secE | preprotein translocase SecE | 3336 |
| nusG | transcription antitermination protein NusG | 3337 |
| vacJ | VacJ lipoprotein | 3338 |
| — | putative translation initiation inhibitor YjgF family | 3339 |
| htpX | probable protease HtpX | 3340 |
| sirA | SirA | 3341 |
| — | conserved hypothetical protein | 3342 |
| trkH | Trk system potassium uptake protein TrkH | 3343 |
| psiE | PsiE | 3344 |
| hemY | HemY | 3345 |
| hemX | putative uroporphyrin-III C-methyltransferase | 3346 |
| cya | adenylate cyclase | 3347 |
| gpsA | glycerol-3-phosphate dehydrogenase | 3348 |
| cysE | serine acetyltransferase | 3349 |
| — | conserved hypothetical shikimate 5-dehydrogenase-like protein | 3350 |
| — | possible di- and tricarboxylate transporter | 3351 |
| folD | FolD bifunctional protein | 3352 |
| fucP | L-fucose permease | 3353 |
| fucA | L-fuculose phosphate aldolase | 3354 |
| fucU | fucose operon protein FucU | 3355 |
| fucK | L-fuculokinase | 3356 |
| fucI | L-fucose isomerase | 3357 |
| fucR | L-fucose operon activator | 3358 |
| hepA | RNA polymerase associated protein homolog | 3359 |
| rluA | ribosomal large subunit pseudouridine synthase A | 3360 |
| glpG | GlpG | 3361 |
| glpR | glycerol-3-phosphate regulon repressor | 3362 |
| metQ | probable D-methionine-binding lipoprotein MetQ | 3363 |
| metI | probable D-methionine transport system permease protein | 3364 |
| metN | probable D-methionine transport ATP-binding protein | 3365 |
| — | conserved hypothetical protein | 3366 |
| — | conserved hypothetical protein | 3367 |
| — | conserved hypothetical protein | 3368 |
| narP | nitrate/nitrite response regulator protein | 3369 |
| lysA | diaminopimelate decarboxylase | 3370 |
| — | hypothetical protein | 3371 |
| cyaY | CyaY | 3372 |
| recQ | ATP-dependent DNA helicase RecQ | 3373 |
| proS | prolyl-tRNA synthetase | 3374 |
| ostA | organic solvent tolerance protein | 3375 |
| sufI | SufI | 3376 |
| plsC | 1-acyl-sn-glycerol-3-phosphate acyltransferase | 3377 |
| lpxH | UDP-2,3-diacylglucosamine hydrolase | 3378 |
| — | conserved hypothetical sodium dependent transporter | 3379 |
| ilvG | acetolactate synthase isozyme II large subunit | 3380 |
| ilvD | dihydroxy-acid dehydratase | 3381 |
| thd1 | threonine dehydratase biosynthetic | 3382 |
| dnaE | DNA polymerase III alpha subunit | 3383 |
| pgmB | phosphoglucomutase | 3384 |
| secB | protein-export protein SecB | 3385 |
| — | predicted rhodanese-related sulfurtransferase | 3386 |
| dcuB | anaerobic C4-dicarboxylate transporter DcuB | 3387 |
| ndhA | NADH dehydrogenase | 3388 |
| plsB | glycerol-3-phosphate acyltransferase | 3389 |
| lexA | LexA repressor | 3390 |
| dapF | diaminopimelate epimerase | 3391 |
| tpx | probable thiol peroxidase | 3392 |
| purL | phosphoribosylformylglycinamidine synthase | 3393 |
| lex2B | UDP-glucose--lipooligosaccharide glucosyltransferase | 3394 |
| — | conserved hypothetical protein | 3395 |
| — | predicted membrane-bound metallopeptidase | 3396 |
| gpmA | 2,3-bisphosphoglycerate-dependent phsphoglycerate mutase | 3397 |
| rpL31 | 50S ribosomal protein L31 | 3398 |
| mutY | A/G-specific adenine glycosylase | 3399 |
| — | conserved hypothetical protein | 3400 |
| mltC | membrane-bound lytic murein transglycolase C precursor | 3401 |
| — | predicted diadenosine tetraphosphatase and related serine/threonine protein phosphatase | 3402 |
| nadR | bifunctional protein NadR | 3403 |
| ribB | 3,4-dihydroxy-2-butanone 4-phosphate synthase | 3404 |

TABLE 7-continued

Gene Products of the NTHi Genome

| Gene Name | Product Name | SEQ ID NO: |
|---|---|---|
| lpsA | lipooligosaccharide glycosyl transferase | 3405 |
| — | conserved hypothetical tRNA/rRNA methyltransferase | 3406 |
| — | predicted N6-adenine-specific methylase | 3407 |
| FtsY | cell division protein FtsY | 3408 |
| ftsE | cell division ATP-binding protein EtsE | 3409 |
| ftsx | cell division protein ftsx | 3410 |
| atoB | acetyl-CoA acetyltransferase | 3411 |
| atoE | short chain fatty acids transporter | 3412 |
| atoA | acetate CoA-transferase beta subunit | 3413 |
| atoD | acetate CoA-transferase alpha subunit | 3414 |
| — | putative HTH-type transcriptional regulator | 3415 |
| rpsJ | 30S ribosomal protein S10 | 3416 |
| rplC | 50S ribosomal protein L3 | 3417 |
| rplD | 50S ribosomal protein L4 | 3418 |
| rplW | 50S ribosomal protein L23 | 3419 |
| rplB | 50S ribosomal protein L2 | 3420 |
| rpsS | 30S ribosomal protein S19 | 3421 |
| rplV | 50S ribosomal protein L22 | 3422 |
| rpsC | 30S ribosomal protein S3 | 3423 |
| rplP | 50S ribosomal protein L16 | 3424 |
| rpmC | 50S ribosomal protein L29 | 3425 |
| rpsQ | 30S ribosomal protein S17 | 3426 |
| — | conserved hypothetical protein | 3427 |
| rplN | 50S ribosomal protein L14 | 3428 |
| rplX | 50S ribosomal protein L24 | 3429 |
| rplE | 50S ribosomal protein L5 | 3430 |
| rpsN | 30S ribosomal protein S14 | 3431 |
| rpsH | 30S ribosomal protein S8 | 3432 |
| rplF | 50S ribosomal protein L6 | 3433 |
| rplR | 50S ribosomal protein L18 | 3434 |
| rpsE | 30S ribosomal protein S5 | 3435 |
| rpmD | 50S ribosomal protein L30 | 3436 |
| rplO | 50S ribosomal protein L15 | 3437 |
| secY | preprotein translocase SecY subunit | 3438 |
| rpsM | 30S ribosomal protein S13 | 3439 |
| rpsK | 30S ribosomal protein S11 | 3440 |
| rpsD | 30S ribosomal protein S4 | 3441 |
| rpoA | DNA-directed RNA polymerase alpha chain | 3442 |
| rplQ | 50S ribosomal protein L17 | 3443 |
| — | predicted cAMP-binding protein - catabolite gene activator and regulatory subunit of cAMP-dependent protein kinase | 3444 |
| — | predicted permease | 3445 |
| dxr | 1-deoxy-D-xylulose 5'phosphate reductoisomerase | 3446 |
| frr | ribosome recycling factor | 3447 |
| pckA | phosphoenolpyruvate carboxykinase | 3448 |
| hslO | 33 kDa chaperonin | 3449 |
| argH | argininosuccinate lyase | 3450 |
| galU | UTP-glucose-1-phosphate uridylyltransferase | 3451 |
| csrA | carbon storage regulator homolog | 3452 |
| alaS | alanyl-tRNA synthetase | 3453 |
| uspA | universal stress protein A | 3454 |
| pepP | Xaa-Pro aminopeptidase | 3455 |
| — | conserved hypothetical protein | 3456 |
| galM | aldose 1-epimerase | 3457 |
| galK | glactokinase | 3458 |
| galT | galactose-1-phosphate uridylyltransferase | 3459 |
| galR | HTH-type transcriptional regulator GalR | 3460 |
| mglB | D-galactose-binding periplasmic protein precursos | 3461 |
| mglA | galactoside transport ATP-binding protein MglA | 3462 |
| mglC | galactoside transport system permease protein MglC | 3463 |
| — | conserved hypothetical protein | 3464 |
| ispZ | probable intracellular septation protein A | 3465 |
| — | putative acyl-CoA thioester hydrolase | 3466 |
| — | conserved hypothetical protein | 3467 |
| slt | putative soluble lytic murein transglycosylase | 3468 |
| trpR | Trp operon repressor | 3469 |
| mtgA | monofunctional biosynthetic peptidoglycan transglycolase | 3470 |
| frdD | fumarate reductase subunit D | 3471 |
| frdC | fumarate reductase subunit C | 3472 |
| frdB | fumarate reductase iron-sulfur protein | 3473 |
| frdA | fumarate reductase flavoprotein subunit | 3474 |
| genX | putative lysyl-tRNA synthetase | 3475 |
| cpxR | transcriptional regulatory protein CpxR | 3476 |
| smpA | small protein A | 3477 |

TABLE 7-continued

Gene Products of the NTHi Genome

| Gene Name | Product Name | SEQ ID NO: |
|---|---|---|
| ndpA | nucleosid-associated protein NdpA | 3478 |
| — | conserved hypothetical protein | 3479 |
| — | predicted hydrolase of alkaline phosphatase superfamily | 3480 |
| — | conserved hypothetical protein | 3481 |
| mobA | probable molybdopterin-guanine dinucleotide biosyntheses protein A | 3482 |
| — | conserved hypothetical protein | 3483 |
| dsbA | thiol:disulfide interchange protein DsbA | 3484 |
| — | conserved hypothetical protein | 3485 |
| trmA | tRNA (Uracil-5)-methyltransferase | 3486 |
| — | conserved hypothetical protein | 3487 |
| — | predicted positive regulator of Sigma E | 3488 |
| mobB | molybdopterin-guanine dinucleotide biosynthesis protein B | 3489 |
| — | conserved hypothetical protein | 3490 |
| hbpA | heme-binding protein A | 3491 |
| — | putative heme iron utilization protein | 3492 |
| — | conserved hypothetical protein | 3493 |
| polA | DNA polymerase I | 3494 |
| — | conserved hypothetical protein | 3495 |
| — | predicted 5-formyltetrahydrofolate cyclo-ligase | 3496 |
| clpB | ClpB | 3497 |
| — | probable tRNA/rRNA methyltransferase | 3498 |
| vacB | ribonuclease R | 3499 |
| — | conserved hypothetical protein | 3500 |
| pdxH | pyridoxamine 5'-phosphate oxidase | 3501 |
| typA | GTP-binding protein TypA/BipA | 3502 |
| lic3A2 | CMP-neu5Ac-lipooligosaccharide alpha 2-3 sialyltransferase | 3503 |
| glnA | glutamine synthetase | 3504 |
| rmlB | dTDP-glucose 4,6-dehydratase | 3505 |
| pepB | peptidase B | 3506 |
| ndk | nucleoside diphosphate kinase | 3507 |
| — | conserved hypothetical GTP-binding protein | 3508 |
| — | conserved hypothetical transport protein | 3509 |
| rpmA | 50S ribosomal protein L27 | 3510 |
| rplU | 50S ribosomal protein L21 | 3511 |
| ispB | octaprenyl-diphosphate synthase | 3512 |
| — | conserved hypothetical protein | 3513 |
| — | predicted Na+/alanine symporter | 3514 |
| arcA | aerobic respiration control protein ArcA | 3515 |
| dsbD | thiol:disulfide interchange protein DsbD | 3516 |
| — | predicted membrane protein | 3517 |
| purH | bifunctional purine biosynthesis protein PurH | 3518 |
| purD | phosphoribosylamine--glycine ligase | 3519 |
| glyA | serine hydroxymethyltransferase | 3520 |
| coaE | dephospho-CoA kinase | 3521 |
| — | conserved hypothetical zinc-binding protein | 3522 |
| rh1B | ATP-dependent RNA helicase Rh1B | 3523 |
| — | hypothetical transcriptional regulator | 3524 |
| — | predicted membrane-fusion protein | 3525 |
| — | predicted cation/multidrug efflux pump | 3526 |
| — | predicted cell division protein | 3527 |
| emrB | multidrug resistance protein | 3528 |
| emrA | multidrug resistance protein A | 3529 |
| folA | dihydrofolate reductase | 3530 |
| proB | glutamate 5-kinase | 3531 |
| nudH | probable nucleoside polyphosphate hydrolase | 3532 |
| — | predicted permease | 3533 |
| lgt | prolipoprotein diacylglyceryl transferase | 3534 |
| thyA | thymidylate synthase | 3535 |
| — | conserved hypothetical protein | 3536 |
| — | conserved hypothetical protein | 3537 |
| — | conserved hypothetical protein | 3538 |
| secA | preprotein translocase SecA subunit | 3539 |
| mutT | mutator protein MutT | 3540 |
| kefB | glutathione-regulated potassium-efflux system protein | 3541 |
| — | conserved hypothetical SAM-dependent methtransferase | 3542 |
| rpsB | 30S ribosomal protein S2 | 3543 |
| tsf | elongation factor Ts | 3544 |
| lpxD | UDP-3-O-[3-hydroxymyristoyl] glucosamine N-acyltransferase | 3545 |

TABLE 7-continued

Gene Products of the NTHi Genome

| Gene Name | Product Name | SEQ ID NO: |
|---|---|---|
| omp26 | outer membrane protein 26 | 3546 |
| — | protective surface antigen D15 | 3547 |
| — | predicted membrane bound zinc matalloprotease with PDZ domain | 3548 |
| cdsA | phosphaatidate cytidylyltransferase | 3549 |
| uppS | undecaprenyl pyrophosphate synthetase | 3550 |
| leuS | leucyl-tRNA synthetase | 3551 |
| — | conserved predicted lipoprotein | 3552 |
| holA | DNA polymerase III, delta subunit | 3553 |
| glyS | glycyl-tRNA synthetase beta chain | 3554 |
| — | hypothetical protein | 3555 |
| — | conserved hypothetical protein | 3556 |
| — | glutaredoxin-related protein | 3557 |
| glyQ | glycyl-tRNA synthetase alpha chain | 3558 |
| hktE | catalase | 3559 |
| — | predicted glutathionylspermidine synthase | 3560 |
| — | conserved hypothetical protein | 3561 |
| — | conserved hypothetical protein | 3562 |
| eno | enolase | 3563 |
| — | conserved hypothetical protein | 3564 |
| nrfF | formate-dependent nitrite reductase complex nrfFG subunit | 3565 |
| dsbE2 | probable thiol:disulfide interchange protein DsbE | 3566 |
| nrfE | cytochrome c-type biogenesis protein NrfE | 3567 |
| suhB | inositol-1-monophosphatase | 3568 |
| — | conserved hypothetical protein | 3569 |
| — | predicted Type II secretory pathway, PulJ-like protein | 3570 |
| — | conserved hypothetical protein | 3571 |
| — | conserved hypothetical protein | 3572 |
| — | exodeoxyribonuclease V gamma chain | 3573 |
| — | predicted transcriptional regulator | 3574 |
| ribD | riboflavin biosynthesis protein RibD | 3575 |
| degS | protease DegS | 3576 |
| mutM | formamidopyrimidine-DNA glycosylase | 3577 |
| ddc | L-2,4-diaminobutyrate decarboxylase | 3578 |
| — | predicted nucleic acid-binding protein, contains PIN domain | 3579 |
| — | conserved hypothetical protein | 3580 |
| dat | diaminobutyrate--2-oxoglutarate aminotransferase | 3581 |
| rpmG | 50S ribosomal protein L33 | 3582 |
| rpmB | 50S ribosomal protein L28 | 3583 |
| radC | DNA repair protein Radc homolog | 3584 |
| dfp | phosphopantothenoylcysteine synthetase/decarboxylase | 3585 |
| dut | deoxyuridine 5'triphosphate nucleotidohydrolase | 3586 |
| ttk | ttk | 3587 |
| — | hypothetical protein | 3588 |
| crp | catabolite gene activator | 3589 |
| — | hypothetical RNA methyltransferase | 3590 |
| nagZ | beta-hexosaminidase | 3591 |
| — | predicted periplasmic lipoprotein | 3592 |
| — | HIT-like protein | 3593 |
| ileS | isoleucyl-tRNA synthetase | 3594 |
| ribF | riboflavin biosynthesis protein RibF | 3595 |
| mviN | putative virulence factor MviN | 3596 |
| rpsT | 30S ribosomal protein S20 | 3597 |
| — | conserved hypothetical protein | 3598 |
| menB | naphthoate synthase | 3599 |
| menC | O-succinylbenzoate synthase | 3600 |
| aroQ | 3-dehydroquinate dehydratase | 3601 |
| accB | biotin carboxyl carrier protein of acetyl-CoA carboxylase | 3602 |
| accC | biotin carboxylase | 3603 |
| — | conserved hypothetical membrane protein | 3604 |
| panF | sodium/pantothenase symporter | 3605 |
| — | conserved hypothetical protein | 3606 |
| prmA | ribosomal protein L11 methyltransferase | 3607 |
| dusB | tRNA-dihydrouridine synthase B | 3608 |
| fis | DNA-binding protein fis | 3609 |
| smpB | SsrA-binding protein | 3610 |
| pfkA | 6-phosphfructokinase | 3611 |
| — | conserved hypothetical protein | 3612 |
| — | conserved hypothetical protein | 3613 |
| smf | smf | 3614 |
| leuA | 2-isopropylmalate synthase | 3615 |
| leuB | 3-isopropylmalate dehydrogenase | 3616 |

TABLE 7-continued

Gene Products of the NTHi Genome

| Gene Name | Product Name | SEQ ID NO: |
|---|---|---|
| leuC | 3-isopropylmalate dehydratase large subunit | 3617 |
| leuD | 3-isopropylmalate dehydratase small subunit | 3618 |
| igal | IgA-specific serine endopeptidase | 3619 |
| recF | DNA replication and repair protein RecF | 3620 |
| dnaN | DNA polymerase III, beta chain | 3621 |
| dnaA | chromosomal replication initiator protein DnaA | 3622 |
| tbp1 | transferrin-binding protein 1 | 3623 |
| tbp2 | transferrin-binding protein 2 | 3624 |
| — | conserved hypothetical protein | 3625 |
| rpmH | 50S ribosomal protain L34 | 3626 |
| rnpA | ribonuclease P protein component | 3627 |
| — | conserved hypothetical protein | 3628 |
| yidC | proprotein translocase subunit YidC | 3629 |
| trmE | probable tRNA moficiation GTPase TrmE | 3630 |
| ppiD | peptidyl-prolyl cis-trans isomerase D | 3631 |
| — | predicted PR--lipooligosaccharide phosphorylethanolamine transferase | 3632 |
| lspA | lipoprotein signal peptidase | 3633 |
| ispH | 4-hydroxy-3-methylbut-2-enyl diphosphate reductase | 3634 |
| — | conserved hypothetical protein | 3635 |
| tbpA | thiamine-binding periplasmic protein | 3636 |
| thiP | thiamine transport system permease protein | 3637 |
| thiQ | thiamine transport ATP-binding protein | 3638 |
| bioB | biotin synthase | 3639 |
| tktA | transketolase | 3640 |
| serB | phosphoserine phosphatase | 3641 |
| — | conserved hypothetical protein | 3642 |
| corA | magnesium and cobalt transport protein CorA | 3643 |
| — | predicted integral membrane protein | 3644 |
| — | predicted glutamine amidotransferase | 3645 |
| — | hypothetical protein | 3646 |
| — | predicted ATPase | 3647 |
| — | hypothetical protein | 3648 |
| — | predicted ferredoxin | 3649 |
| — | conserved hypothetical protein | 3650 |
| dmsC | anaerobic dimethyl sulfoxide reductase chain C | 3651 |
| dmsB | anaerobic dimenthyl sulfoxide reductase chain B | 3652 |
| dmaA | anaerobic dimethyl sulfoxide reductase chain A | 3653 |
| — | conserved hypothetical protein | 3654 |
| — | putative mercuric transport MerT homolog | 3655 |
| — | predicted copper chaperone MerP homolog | 3656 |
| — | conserved hypothetical ABC transporter | 3657 |
| — | conserved hypothetical transcriptional regulator | 3658 |
| — | conserved putative gamma-carboxymuconolactone decarboxylase subunit | 3659 |
| — | conserved hypothetical protein | 3660 |
| res | putative type III restriction-modification sustem HindVIP enzyme res | 3661 |
| rnhB | ribonuclease HII | 3662 |
| lpxB | lipid-A-disaccharide synthase | 3663 |
| lpxA | acyl0[acyl-carrier-protein]--UDP-N-acetylglucosamine O-Acyltransferase | 3664 |
| fabZ | (3R)-hydroxymyristoyl-[acyl carrier protein] dehydratase | 3665 |
| — | predicted PR--lipooligosaccharide phosphorylethanolamine transferase | 3666 |
| pyrH | uridylate kinase | 3667 |
| nrfD | NrfD, formate-dependent nitrite reductase, membrane component | 3668 |
| nrfC | NrfC, Fe—S-cluster-containing hydrogenase component 1 | 3669 |
| nrfB | NrfB, cytochrome C-type protein | 3670 |
| nrfA | cytochrome c552 | 3671 |
| hrpA | ATP-dependent helicase HrpA homolog | 3672 |
| — | conserved putative small membrane protein | 3673 |
| — | conserved putative membrane protein | 3674 |
| cyoB | probable cyrochrome oxidase subunit II | 3675 |
| cyoA | probable cytochrome oxidase dubunit I | 3676 |
| pyrG | CTP synthase | 3677 |
| pnuC | nictinamide riboside transporter | 3678 |
| — | probable amino-acid ABC transporter ATP-binding protein | 3679 |
| — | probable amino-acid ABC transporter permease protein | 3680 |
| — | probable amino-acid ABC transporter binding protein | 3681 |

TABLE 7-continued

Gene Products of the NTHi Genome

| Gene Name | Product Name | SEQ ID NO: |
|---|---|---|
| murA | UDP-N-acetylglucosamine a-carboxyvinyltransferase | 3682 |
| — | predicted transcriptional regulator, BolA superfamily | 3683 |
| — | predicted NTP binding protein, contains STAS domain | 3684 |
| — | conserved ABC-type transport system protein | 3685 |
| — | conserved ABC-type transport system protein, periplasmic component | 3686 |
| — | conserved ABC-type transport system protein, permease component | 3687 |
| — | conserved ABC-type transport system protein, ATPase component | 3688 |
| sodA | superoxide dismutase [Mn] | 3689 |
| ccmA | heme exporter protein A | 3690 |
| ccmB | heme exporter protein B | 3691 |
| ccmC | heme exporter protein C | 3692 |
| ccmD | heme exporter protein D | 3693 |
| ccmE | cytochrome c-type biogenesis protein CcmE | 3694 |
| ccmF | cytochrome c-type biogenesis protein CcmF | 3695 |
| dsbE | thiol:disulfide interchange protein DsbE | 3696 |
| — | hypothetical protein | 3697 |
| — | conserved hypothetical protein | 3698 |
| ligN | DNA ligase | 3699 |
| zipA | cell division protein ZipA | 3700 |
| cysZ | CysZ | 3701 |
| cysK | cysteine synthase | 3702 |
| rfaF | ADP-heptose--lipooligosaccharide heptosyltransferase II | 3703 |
| xylR | xylose operon refulatory protein | 3704 |
| — | conserved hypothetical Na(+)/H(+) antiporter | 3705 |
| aspC2 | putative aspartate aminotransferase | 3706 |
| xylA | xylose isomerase | 3707 |
| xylB | xylulose kinase | 3708 |
| rfaD | ADP-L-glycero-D-manno-heptose-6-epimerase | 3709 |
| — | thioredoxin-like protein | 3710 |
| deoC | deoxyribose-phosphate aldolase | 3711 |
| comM | competence protein ComM | 3712 |
| engB | Probable GTP-binding protein EngB | 3713 |
| — | D-xylose transport permease protein | 3714 |
| oppF | oligopeptide transport ATP-binsing protein | 3715 |
| oppD | oligopeptide transport ATP-binding protein | 3716 |
| oppC | oligopeptide transport system permease protein | 3717 |
| oppB | oligopeptide transport system permease protein | 3718 |
| oppA | periplasmic oligopeptide-binding protein | 3719 |
| talB | Transaldolase | 3720 |
| — | carbon starvation protein, predicted membrane protein | 3721 |
| mraZ | MraZ | 3722 |
| mraW | predicted S-adenosylmethionine-dependent methyltransferase involved in cell envelope biogenesis | 3723 |
| ftsL | cell division protein FtsL | 3724 |
| ftsI | peptidoglycan synthetase FtsI | 3725 |
| murE | UDP-N-acetylmuramoylalanyl-D-glutamate--2,6-diaminopimelate ligase | 3726 |
| murF | UDP-N-acetylmuramoyl-tripeptide--D-alanyl-D-alanine ligase | 3727 |
| mraY | phospho-N-acetylmuramoyl-pentapeptide-transferase | 3728 |
| murD | UDP-N-acetylmuramoylalanine--D-glutamate ligase | 3729 |
| ftsW | cell division protein FtsW | 3730 |
| murG | UDP-N-acetylglucosamine--N-acetylmuramylpyrophosphoryl-undecaprenol N-acetylglucosamine transferase | 3731 |
| murC | UDP-N-acetylmuramate--L-alanine ligase | 3732 |
| ddlB | D-alanine--D-alanine ligase | 3733 |
| ftsQ | cell division protein FtsQ | 3734 |
| ftsA | cell division protein FtsA | 3735 |
| ftsZ | cell division protein FtsZ | 3736 |
| lpxC | UDP-3-O-[3-hydroxymyristoyl] N-acetylglucosamine deacetylase | 3737 |
| pheA | P-protein | 3738 |
| — | predicted P-loop-containing kinase | 3739 |
| ptsN | nitrogen regulatory IIA protein | 3740 |
| — | probable ABC transporter ATP-binding protein | 3741 |
| — | conserved hypothetical protein | 3742 |
| — | conserved hypothetical protein | 3743 |
| — | conserved hypothetical protein | 3744 |
| pmbA | pmbA | 3745 |
| hpt | hypoxanthine phosphoribosyltransferase | 3746 |
| — | predicted Na+/dicarboxylate symporter | 3747 |

TABLE 7-continued

Gene Products of the NTHi Genome

| Gene Name | Product Name | SEQ ID NO: |
|---|---|---|
| nrdG | anaerobic ribonucleoside-triphosphate reductase activating protein | 3748 |
| cydC | transport ATP-binding protein CydC | 3749 |
| cydD | transport ATP binding protein CydD | 3750 |
| trxB | thioredoxin reductase | 3751 |
| — | thioredoxin domain-containing protein | 3752 |
| hemH | ferrochelatase | 3753 |
| — | conserved hypothetical protein | 3754 |
| — | conserved FAD/FMN-containing dehydrogenase | 3755 |
| ompP5 | outer membrane protein P5 | 3756 |
| — | conserved glutaredoxin-related protein | 3757 |
| — | histidinol-phosphate aminotransferase 2 | 3758 |
| serC | phosphoserine aminotransferase | 3759 |
| — | conserved hypothetical protein | 3760 |
| — | conserved hypothetical protein | 3761 |
| — | conserved hypothetical protein | 3762 |
| trpG2 | putative anthranilate synthase component II | 3763 |
| metK | S-adenosylmethionine synthetase | 3764 |
| sprT | SprT | 3765 |
| opa | opacity protein | 3766 |
| — | conserved hypothetical protein | 3767 |
| artM | arginine transport system permease protein | 3768 |
| artQ | arginine transport system permease protein | 3769 |
| artI | arginine-binding periplasmic protein | 3770 |
| artP | arginine transport ATP-binding protein | 3771 |
| gmhA | phosphoheptose isomerase | 3772 |
| ligA | DNA ligase | 3773 |
| dppF | dipeptide transport ATP binding protein | 3774 |
| dppD | dipeptide transport ATP binding protein | 3775 |
| dppC | dipeptide transport system permease protein | 3776 |
| dppB | dipeptide transport system permease protein | 3777 |
| uvrD | DNA helicase II | 3778 |
| — | predicted organic radical activating enzyme | 3779 |
| — | predicted 6-pyruval-tetrahydropterin synthase | 3780 |
| — | predicted PP-loop superfamily ATPase | 3781 |
| — | conserved hypothetical protein | 3782 |
| ilvE | branched chain amino acid amino transferase | 3783 |
| gcvA | glycine cleavage system transcriptional activator | 3784 |
| — | predicted SAM-dependent methyltransferase | 3785 |
| sucC | succinyl-CoA synthetase beta chain | 3786 |
| sucD | succinyl-CoA synthetase alpha chain | 3787 |
| — | putative translation factor, Sua5 | 3788 |
| rluB | ribosomal large subunit pseudouridine synthase B | 3789 |
| cysB | HTH-type transcriptional regulator CysB | 3790 |
| — | conserved hypothetical adenine-specific methylase | 3791 |
| — | conserved hypothetical protein | 3792 |
| pta | phosphate acetyltransferase | 3793 |
| ackA | acetate kinase | 3794 |
| — | conserved hypothetical protein | 3795 |
| cvpA | colicin C production protein | 3796 |
| — | amidophosphoribosyltransferase | 3797 |
| sulA | cell division inhibitor SulA | 3798 |
| argR | argininr repressor | 3799 |
| mdh | malate dehydrogenase | 3800 |
| lysS | lysyl-tRNA synthetase | 3801 |
| prfB | peptide chain release factor 2 | 3802 |
| dsbC | thiol:disulfide interchange protein DsbC | 3803 |
| recJ | single stranded DNA specific exonuclease RecJ | 3804 |
| — | conserved hypothetical protein | 3805 |
| mtnA | MTA/SAH nucleosidase | 3806 |
| hup | heme utilization protein | 3807 |
| — | putative L-Lactate permease | 3808 |
| fbp | frustose-1,6-bisphosphatase | 3809 |
| truA | tRNA pseudouridine synthase A | 3810 |
| sapZ | Predicted membrane protein | 3811 |
| sapF | ABC-type transport system, ATPase component involved in antimicrobial peptide resistance | 3812 |
| sapD | ABC-type transport system, ATP binding component, involved in antimicrobial peptide resistance | 3813 |
| sapC | ABC-type transport system, permease protein, involved in antimicrobial peptide resistance | 3814 |
| sapB | ABC-type transport system, permease protein, involved in antimicrobial peptide resistance | 3815 |

TABLE 7-continued

Gene Products of the NTHi Genome

| Gene Name | Product Name | SEQ ID NO: |
|---|---|---|
| sapA | ABC-type transport system, periplasmic component, involved in antimicrobial peptide resistance | 3816 |
| — | Predicted ATPase | 3817 |
| Ppc | Phosphoenolpyruvate carboxylase | 3818 |
| purR | HTH-type transcriptional repressor PurR | 3819 |
| dapD | 2,3,4,5-tetrahydropyridine-2,6-dicarboxylate N-succinyltransferase | 3820 |
| PurA | adenylosuccinate synthetase | 3821 |
| — | predicted aspartokinase | 3822 |
| rplY | 50S ribosomal protein L25 | 3823 |
| — | uncharacterized membrane-associate protein | 3824 |
| — | conserved hypothetical protein | 3825 |
| — | putative translation initiation inhibitor, YjgF family | 3826 |
| — | conserved hypothetical protein | 3827 |
| — | conserved hypothetical protein | 3828 |
| — | HTH-type trancriptional regulator | 3829 |
| — | putative ABC-type Co2+ transport system, periplasmic component | 3830 |
| — | conserved hypothetical protein | 3831 |
| cbiM | predicted ABC-type cobalt transport system, permease component | 3832 |
| — | predicted cobalt transport protein | 3833 |
| cbiO | predicted ABC-type cobalt transport system, ATPase component | 3834 |
| aspC | aspartate aminotransferase | 3835 |
| purK | phosphoribosylaminoimidazole carboxylase ATPase subunit | 3836 |
| purE | phosphoribosylaminoimidazole carboxylase catalytic subunit | 3837 |
| hicA | HicA | 3838 |
| hicB | HicB | 3839 |
| pepN | aminopeptidase N | 3840 |
| ribE | riboflavin synthase alpha chain | 3841 |
| norM | probable multidrug resistance protein NorM | 3842 |
| sfsA | sugar fermentation stimulation protein | 3843 |
| tyrS | tyrosyl-tRNA synthase | 3844 |
| prsA | ribose phosphate pyrophosphokinase | 3845 |
| ispE | 4-diphosphocytidyl-2-C-methyl-D-erythritol kinase | 3846 |
| lolB | outer-membrane lipoprotein LolB | 3847 |
| cca | tRNA nucleotidyltransferase | 3848 |
| — | conserved hypothetical protein | 3849 |
| — | putative phosphate permease | 3850 |
| — | conserved hypothetical phosphate transport regulator | 3851 |
| — | predicted membrane protein | 3852 |
| — | conserved hypothetical protein | 3853 |
| — | conserved hypothetical protein | 3854 |
| — | conserved hypothetical protein | 3855 |
| — | hypothetical protein | 3856 |
| — | hypothetical protein | 3857 |
| — | hypothetical protein | 3858 |
| hmw2C | HMW2C, putative glycosyltransferase involved in glycosylation of HMW1A and HMW2A | 3859 |
| hmw2B | HMW2B, OMP-85-like protein required for HMW1A and HMW2A secretion | 3860 |
| —hmw2A | HMW2A, high molecular weight adhesin 2 | 3861 |
| — | conserved hypothetical protein | 3862 |
| radA | DNA repair protein RadA homolog | 3863 |
| lrp | leucine-responsive regulatory protein | 3864 |
| ftsK | DNa translocase FtsK | 3865 |
| lolA | outer-membrane lipoproteins carrier protein precursor | 3866 |
| — | predicted ATPase related to the helicase subunit of the holliday junction resolvase | 3867 |
| — | hypothetical protein | 3868 |
| — | modification methylase BepI-like | 3869 |
| aroA | 3-phosphoshikimate 1-carboxyvinyltransferase | 3870 |
| purU | formyltetrahydrofolate deformylase | 3871 |
| hns | DNA-binding protein H-NS homolog | 3872 |
| — | predicted Na+/H+ antiporter | 3873 |
| — | hypothetical protein | 3874 |
| ilvI | acetolactate synthase large subunit | 3875 |
| ilvH | acetolactate synthase small subunit | 3876 |
| argS | arginyl-tRNA synthetase | 3877 |
| — | conserved hypothetical protein | 3878 |
| — | hypothetical lipoprotein | 3879 |

TABLE 7-continued

Gene Products of the NTHi Genome

| Gene Name | Product Name | SEQ ID NO: |
|---|---|---|
| pcp | outer-membrane lipoprotein PCP precursor | 3880 |
| lgtD | UDP-0glcNAc-lipooligosaccharide N-acetylglucosamine glycosyltransferase | 3881 |
| pgi | glucose-6-phosphate isomerase | 3882 |
| alr | alanine racemase | 3883 |
| dnaB | replicative DNA helicase | 3884 |
| pykA | pyruvate kinase | 3885 |
| — | prophage CP4-57-like integrase | 3886 |
| — | hypothetical protein | 3887 |
| — | hypothetical protein | 3888 |
| — | hypothetical protein | 3889 |
| — | hypothetical protein | 3890 |
| — | hypothetical protein | 3891 |
| — | modification methylase Bsp6I-like | 3892 |
| rdgC | recombination associated protein | 3893 |
| — | hypothetical protein | 3894 |
| ssb3 | single strand binding protein | 3895 |
| — | hypothetical protein | 3896 |
| — | predicted recombinational DNA repair protein, RecE pathway | 3897 |
| — | hypothetical protein | 3898 |
| — | hypothetical protein | 3899 |
| — | modification methylase DpnIIB-like | 3900 |
| — | hypothetical protein | 3901 |
| — | hypothetical protein | 3902 |
| — | hypothetical protein | 3903 |
| — | hypothetical protein | 3904 |
| — | hypothetical protein | 3905 |
| — | hypothetical protein | 3906 |
| — | hypothetical protein | 3907 |
| — | hypothetical protein | 3908 |
| — | hypothetical protein | 3909 |
| — | hypothetical protein | 3910 |
| — | hypothetical protein | 3911 |
| — | hypothetical protein | 3912 |
| — | hypothetical protein | 3913 |
| — | hypothetical protein | 3914 |
| — | hypothetical protein | 3915 |
| — | hypothetical protein | 3916 |
| — | hypothetical protein | 3917 |
| — | hypothetical protein | 3918 |
| — | hypothetical protein | 3919 |
| — | hypothetical protein | 3920 |
| — | hypothetical protein | 3921 |
| — | hypothetical protein | 3922 |
| — | hypothetical protein | 3923 |
| — | predicted DNA modification methylase | 3924 |
| — | hypothetical protein | 3925 |
| — | hypothetical protein | 3926 |
| — | predicted phage terminase large subunit | 3927 |
| — | hypothetical protein | 3928 |
| — | uncharacterized protein, homolog of phage Mu protein gp30 | 3929 |
| — | hypothetical protein | 3930 |
| — | hypothetical protein | 3931 |
| — | hypothetical protein | 3932 |
| — | hypothetical protein | 3933 |
| — | hypothetical protein | 3934 |
| — | hypothetical protein | 3935 |
| — | hypothetical protein | 3936 |
| — | hypothetical protein | 3937 |
| — | hypothetical protein | 3938 |
| — | hypothetical protein | 3939 |
| — | hypothetical protein | 3940 |
| — | hypothetical protein | 3941 |
| — | predicted phage-related minor tail protein | 3942 |
| — | hypothetical protein | 3943 |
| — | hypothetical protein | 3944 |
| — | hypothetical protein | 3945 |
| — | hypothetical protein | 3946 |
| — | hypothetical protein | 3947 |
| — | hypothetical protein | 3948 |
| — | hypothetical protein | 3949 |
| — | hypothetical protein | 3950 |
| — | probable tail fiber protein | 3951 |
| — | hypothetical protein | 3952 |

TABLE 7-continued

Gene Products of the NTHi Genome

| Gene Name | Product Name | SEQ ID NO: |
|---|---|---|
| — | hypothetical protein | 3953 |
| — | conserved hypothetical protein | 3954 |
| — | hypothetical protein | 3955 |
| — | hypothetical protein | 3956 |
| — | mu-like prophage protein gp29 | 3957 |
| — | conserved hypothetical protein | 3958 |
| — | hypothetical protein | 3959 |
| — | conserved hypothetical protein | 3960 |
| — | hypothetical protein | 3961 |
| — | hypothetical protein | 3962 |
| — | hypothetical protein | 3963 |
| — | hypothetical protein | 3964 |
| — | hypothetical protein | 3965 |
| — | hypothetical protein | 3966 |
| — | hypothetical protein | 3967 |
| prfA | peptide chain release factor I | 3968 |
| — | conserved hypothetical protein | 3969 |
| hemK | HemK | 3970 |
| — | conserved hypothetical protein | 3971 |
| kdsA | 2-dehyrdro-3-deoxyphosphooctonate aldolase | 3972 |
| — | putative 2-hydroxyacid dehydrogenase | 3973 |
| lolC | lipoprotein releasing system transmembrane protein | 3974 |
| bioA | adenosylmethionine-8-amino-7-oxononanoate aminotransferase | 3975 |
| bioF | 8-amino-7-oxononanoate synthase | 3976 |
| — | conserved hypothetical protein | 3977 |
| bioC | putative biotin synthesis protein BioC | 3978 |
| bioD-B | probable dethiobiotin synthetase 2 | 3979 |
| lolD | lipoprotein releasing system ATP-binding protein LolD | 3980 |
| lolE | ABC-type transport system, involved in lipoprotein release, permease component | 3981 |
| aroG | phospho-2-dehydro-3-deoxyheptonate aldolase | 3982 |
| impA | impA | 3983 |
| — | predicted Na+/serine symporter | 3984 |
| — | putative NAD(P)H oxidoreductase | 3985 |
| — | predicted component of anaerobic dehydrogenases | 3986 |
| — | predicted nitroreductase | 3987 |
| sppA | protease IV | 3988 |
| licD | phosphorylcholine transferase | 3989 |
| licC | LicC | 3990 |
| licB | LicB | 3991 |
| licA | LicA | 3992 |
| — | predicted glycine/D-amino acid oxidases, deaminating | 3993 |
| fabB | 3-oxacyl-[acyl-carrier-protein] synthase I | 3994 |
| rrxA | glutaredoxin | 3995 |
| rimK | probable ribosomal protein S6 modification protein | 3996 |
| gltS | sodium/glutamate symport carrier protein | 3997 |
| parC | topoisomerase IV subunit A | 3998 |
| parE | topoisomerase IV subunit B | 3999 |
| htrB | lipid A biosynthesis lauroyl acyltransferase | 4000 |
| rfaE | ADP-heptose synthase | 4001 |
| — | hypothetical protein | 4002 |
| uupA2 | ABC transporter ATP-binding protein | 4003 |
| uppB | ABC transporter ATP-binding protein | 4004 |
| — | putative carbonic anhydrase | 4005 |
| asnS | asparaginyl-tRNA synthetase | 4006 |
| ribH | 6,7-dimethyl-8-ribityllumazine synthase | 4007 |
| nusB | N utilization substance protein B | 4008 |
| thiL | thiamine-monophosphate kinase | 4009 |
| pgpA | phosphatidylglycerophosphatase A | 4010 |
| — | predicted threonine efflux protein | 4011 |
| dapB | dihydrodipicolinate reductase | 4012 |
| — | conserved hypothetical ferredoxin-like protein | 4013 |
| — | conserved hypothetical protein | 4014 |
| pheS | ohenylalanyl-tRNA synthetase alpha chain | 4015 |
| pheT | ohenylalanyl-tRNA synthetase beta chain | 4016 |
| himA | integration host factor alpha-subunit | 4017 |
| — | conserved hypothetical lipoprotein | 4018 |
| — | hypothetical protein | 4019 |
| — | putative 5'(3')-deoxyribonucleotidase | 4020 |
| — | NAD-dependent deacetylase | 4021 |
| — | hypothetical protein | 4022 |
| ftsK2 | DNA translocase ftsK | 4023 |
| — | NAD-dependent deacetylase sirtuin 5 | 4024 |
| — | hypothetical protein | 4025 |

TABLE 7-continued

Gene Products of the NTHi Genome

| Gene Name | Product Name | SEQ ID NO: |
|---|---|---|
| — | hypothetical protein | 4026 |
| — | hypothetical protein | 4027 |
| — | predicted serine/threonine protein phosphatase family protein | 4028 |
| — | predicted arylsulfatase A-like enzyme | 4029 |
| — | predicted enzyme related to aldose 1-epimerase | 4030 |
| infC | translation initiation factor IF-3 | 4031 |
| rpmI | 50S ribosomal protein L35 | 4032 |
| rplT | 50S ribosomal protein L20 | 4033 |
| recB | exodeoxyribonuclease V beta chain | 4034 |
| recD | exodeoxyribonuclease V alpha chain | 4035 |
| — | conserved hypothetical protein | 4036 |
| lonB | putative protease Lahomolog, predicted ATP-dependent protease | 4037 |
| fabA | 3-hydroxydecanoyl-[acyl-carrier-protein] dehydratase | 4038 |
| — | conserved hypothetical protein | 4039 |
| — | conserved hypothetical protein | 4040 |
| rpsO | 30S ribosomal protein S15 | 4041 |
| — | conserved hypothetical transposase-like protein | 4042 |
| — | conserved hypothetical protein | 4043 |
| dacB | penicillin-binding protein 4 precursor | 4044 |
| greA | transcription elongation factor GreA | 4045 |
| — | predicted RNA-binding protein containing KH domain, possible ribosomal protein | 4046 |
| ftsJ | ribosomal RNA large subunit methyltransferase J | 4047 |
| FTSh | cell division protein FtsH homolog 1 | 4048 |
| folP | dihydropteroate synthase | 4049 |
| mrsA | predicted phosphomannomutase | 4050 |
| sixA | phosphohistidine phosphatase SixA homolog | 4051 |
| — | conserved hypothetical protein | 4052 |
| — | conserved hypothetical protein | 4053 |
| — | hypothetical protein | 4054 |
| — | hypothetical protein | 4055 |
| — | possible RNA polymerase sigma factor 24 | 4056 |
| — | hypothetical protein | 4057 |
| — | hypothetical protein | 4058 |
| msaB | peptide methionine sulfoxide reductase MsrA/MsrB | 4059 |
| — | conserved hypothetical cytochrome c-type biogenesis protein | 4060 |
| — | conserved hypothetical protein | 4061 |
| — | conserved hypothetical protein | 4062 |
| moeB | molybdopterin biosynthesis protein MoeB | 4063 |
| moeA | molybdopterin biosynthesis protein MoeA | 4064 |
| folE | GTP cyclohydrolase I | 4065 |
| — | conserved hypothetical protein | 4066 |
| bioD-A | probable dethiobiotin synthetase 1 | 4067 |
| metF | 5,10-methylenetetrahydrofolate reductase | 4068 |
| rplM | 50S ribosomal protein L13 | 4069 |
| rpsI | 30S ribosomal protein S9 | 4070 |
| sspA | stringent starvation protein A | 4071 |
| sspB | stringent starvation protein B | 4072 |
| dxs | 1-deoxy-D-xylulose 5-phosphate synthase | 4073 |
| ispA | geranyltranstransferase | 4074 |
| xseB | exodeoxyribonuclease VII small subunit | 4075 |
| thiI | predicted thiamine biosynthesis ATP pyrophosphatase | 4076 |
| — | conserved hypothetical protein | 4077 |
| truC | tRNA pseudouridine synthase C | 4078 |
| — | conserved hypothetical protein | 4079 |
| cspD | cold shock-like protein CspD | 4080 |
| — | conserved hypothetical protein | 4081 |
| usg | predicted aspartate-semialdehyde dehydrogenase | 4082 |
| trpA | tryptophan synthase alpha chain | 4083 |
| trpB | tryptophan synthase beta chain | 4084 |
| — | conserved hypothetical oxidoreductase | 4085 |
| purM | phosphoribosylformylglycinamidine cyclo-ligase | 4086 |
| purN | phosphoribosylglycinamide formyltransferase | 4087 |
| — | predicted ABC-type transport system protein, periplasmic component | 4088 |
| uspE | universal stress protein E | 4089 |
| fnr | fumarate and nitrate reduction regulatory protein | 4090 |
| — | putative integrase/recombinase | 4091 |
| — | conserved hypothetical protein | 4092 |
| — | predicted phage anti-repressor protein | 4093 |
| — | hypothetical protein | 4094 |
| — | hypothetical protein | 4095 |
| — | hypothetical protein | 4096 |

TABLE 7-continued

Gene Products of the NTHi Genome

| Gene Name | Product Name | SEQ ID NO: |
|---|---|---|
| — | hypothetical protein | 4097 |
| — | hypothetical protein | 4098 |
| — | hypothetical protein | 4099 |
| — | predicted transcriptional regulator | 4100 |
| — | hypothetical protein | 4101 |
| — | hypothetical protein | 4102 |
| — | hypothetical protein | 4103 |
| — | hypothetical protein | 4104 |
| — | hypothetical protein | 4105 |
| — | hypothetical protein | 4106 |
| ninB | putative recombination protein NinB | 4107 |
| ninG | putative recombination protein NinG homolog | 4108 |
| — | hypothetical protein | 4109 |
| — | conserved hypothetical protein | 4110 |
| — | hypothetical protein | 4111 |
| — | conserved hypothetical protein | 4112 |
| — | hypothetical protein | 4113 |
| — | conserved hypothetical protein | 4114 |
| — | conserved hypothetical protein | 4115 |
| — | hypothetical protein | 4116 |
| — | conserved hypothetical protein | 4117 |
| — | hypothetical protein | 4118 |
| — | conserved hypothetical protein | 4119 |
| — | predicted phage terminase large subunit | 4120 |
| — | conserved hypothetical protein | 4121 |
| — | uncharacterized protein, homolog of phage Mu protein gp30 | 4122 |
| — | conserved hypothetical protein | 4123 |
| pyrD | dihyrdoorotate dehydrogenase | 4124 |
| trpH | TrpH | 4125 |
| — | conserved hypothetical protein | 4126 |
| fumC | fumurate hydratase class II | 4127 |
| — | putative glycosyl transferase, glycosyl transferase family 8 protein | 4128 |
| holC | DNA polymerase III, chi subunit | 4129 |
| — | conserved hypothetical protein | 4130 |
| — | conserved hypothetical protein | 4131 |
| — | hypothetical protein | 4132 |
| — | conserved hypothetical protein | 4133 |
| — | hypothetical protein | 4134 |
| valS | valyl-tRNA synthetase | 4135 |
| — | hypothetical protein | 4136 |
| trpC | tryptophan biosynthesis protein trpCF | 4137 |
| trpD | anthranilate phosphoribosyltransferase | 4138 |
| — | conserved hypothetical protein | 4139 |
| trpG | anthranilate synthase component II | 4140 |
| trpE | anthranilate synthase component I | 4141 |
| — | pseudogene for conserved hypothetical glycosyltransferase | 4142 |
| ftnB | ferritin-like protein 2 | 4143 |
| ftnA | ferritin-like protein 1 | 4144 |
| pstS | phosphate-binding periplasmic protein precursor PstS | 4145 |
| pstC | phosphate transport system permease protein PstC | 4146 |
| pstA | phoaphate transport system permease proteain PstA | 4147 |
| pstB | phosphate import ATP-binding protein PstB | 4148 |
| phoB | phosphate regulon transcriptional regulatory protein PhoB | 4149 |
| phoR | phosphate regulon sensor protein PhoR | 4150 |
| sbcB | exodeoxyribonuclease I | 4151 |
| — | conserved hypothetical protein | 4152 |
| — | conserved hypothetical protein | 4153 |
| — | cell division protein MukB | 4154 |
| — | cell division protein MukE | 4155 |
| haeIIR | type II restriction exzyme HaeII | 4156 |
| haeIIM | modification methylase HaeII | 4157 |
| mukF | MukF homolog | 4158 |
| — | predicted ATPase of the PP-loop superfamily implicated in cell cycle control | 4159 |
| — | predicted dissimilatory sulfite reductase, desulfoviridin, gamma subunit | 4160 |
| mop | probable molybdenum-pterin binding protein | 4161 |
| pqqL | probable zinc protease | 4162 |
| thrS | threonyl-tRNA synthetase | 4163 |
| acpD | probable acyl carrier protein phosphodiesterase | 4164 |
| topA | DNA topoisomerase I | 4165 |
| — | putative HTH-type transcriptional regulator | 4166 |

TABLE 7-continued

Gene Products of the NTHi Genome

| Gene Name | Product Name | SEQ ID NO: |
|---|---|---|
| pntB | NAD(P) transhydrogenase subunit beta | 4167 |
| pntA | NAD(P) transhydrogenase subunit alpha | 4168 |
| glgP | glycogen phosphorylase | 4169 |
| glgA | glycogen synthase | 4170 |
| glgC | glucose-1-phosphate adenylyltransferase | 4171 |
| glgX | glycogen operon protein GlgX | 4172 |
| glgB | 1,4-alpha-glucan branching enzyme | 4173 |
| malQ | 4-alpha-glucanotransferase | 4174 |
| — | conserved hypothetical protein | 4175 |
| glnS | glutaminyl-tRNA synthetase | 4176 |
| cafA | ribonuclease G | 4177 |
| putP | sodium/proline symporter | 4178 |
| — | conserved hypothetical protein | 4179 |
| cdd | cytiding deaminase | 4180 |
| — | conserved hypothetical DNA-binding ferritin-like protein | 4181 |
| pepT | peptidase T | 4182 |
| potA | spermidine/putrescine transport ATP-binding protein | 4183 |
| potB | spermidine/putrescine transport permease protein | 4184 |
| potC | spermidine/putrescine transport system permease protein | 4185 |
| potD1 | spermidine/putrescine-binding periplasmic protein 1 precursor | 4186 |
| uupA | ABC transporter ATP-binding protein | 4187 |
| — | deoxyguanosinetriphosphate triphosphohydrolase-like protein | 4188 |
| — | putative effector of murein hydrolase | 4189 |
| — | putative effector of murein hydrolase | 4190 |
| — | predicted micrococcal nuclease-like protein | 4191 |
| nifS | predicted selenocysteine lyase | 4192 |
| — | predicted SufE protein probably involved in Fe—S center assembly | 4193 |
| — | Zn-ribbon-containing, possible nucleic-acid binding protein | 4194 |
| — | predicted enzyme related to GTP cyclohydrolase I | 4195 |
| tyrA | T-protein | 4196 |
| truB | tRNA pseudouridine synthase B | 4197 |
| rbfA | ribosome-binding factor A | 4198 |
| hsdM3 | putative type I restriction enzyme HindVIIP M protein | 4199 |
| hsdS3 | putative type I restriction enzyme HindVIIP specificity protein | 4200 |
| — | hypothetical protein | 4201 |
| hsdR3 | putative type I restriction enzyme HindVIIP R protein | 4202 |
| infB | translation initiation factor IF-2 | 4203 |
| nusA | transcriptional elongation protein NusA | 4204 |
| — | conserved hypothetical protein | 4205 |
| — | hypothetical protein | 4206 |
| — | hypothetical protein | 4207 |
| — | hypothetical protein | 4208 |
| — | hypothetical protein | 4209 |
| — | hypothetical protein | 4210 |
| — | hypothetical protein | 4211 |
| — | hypothetical protein | 4212 |
| — | probable tail fiber protein | 4213 |
| — | predicted bacteriophage P2-related tail formation protein gpI | 4214 |
| — | predicted phage-related baseplate assembly protein | 4215 |
| — | predicted baseplate assembly protein W | 4216 |
| — | predicted phage P2-like baseplate assembly protein | 4217 |
| — | hypothetical protein | 4218 |
| — | hypothetical protein | 4219 |
| — | hypothetical protein | 4220 |
| — | hypothetical protein | 4221 |
| — | predicted phage-related tail protein | 4222 |
| — | hypothetical protein | 4223 |
| — | hypothetical protein | 4224 |
| — | hypothetical protein | 4225 |
| — | hypothetical protein | 4226 |
| — | probable bacteriophage tail completion protein gpS homolog | 4227 |
| — | probable bacteriophage tail completion protein gpR homolog | 4228 |
| — | hypothetical protein | 4229 |
| — | hypothetical protein | 4230 |
| — | DnaK suppressor protein, bacteriophage PSP3 gp34 homolog | 4231 |

TABLE 7-continued

Gene Products of the NTHi Genome

| Gene Name | Product Name | SEQ ID NO: |
|---|---|---|
| — | hypothetical protein | 4232 |
| — | predicted phage-related lysozyme | 4233 |
| — | hypothetical protein | 4234 |
| — | hypothetical protein | 4235 |
| — | hypothetical protein | 4236 |
| — | predicted terminase, endonuclease subunit | 4237 |
| — | predicted major capsid protein | 4238 |
| — | predicted capsid scaffolding protein | 4239 |
| — | terminase, ATPase subunit | 4240 |
| — | predicted portal vertex protein | 4241 |
| siaB | acylneuraminate cytidylyltransferase | 4242 |
| — | putative NAD(P)H nitroreductase | 4243 |
| mrp | Mrp | 4244 |
| metG | methionyl-tRNA synthetase | 4245 |
| tehB | tellurite resistance protein | 4246 |
| gloB | probable hydroxyacylglutathione hydrolase | 4247 |
| — | conserved hypothetical protein | 4248 |
| — | conserved hypothetical protein | 4249 |
| — | conserved hypothetical protein | 4250 |
| gyrA | DNA gyrase subunit A | 4251 |
| metX | homoserine O-acetyltransferase | 4252 |
| sanA | SanA | 4253 |
| folC | folypolyglutamate synthase | 4254 |
| accD | acethy-coenzyme A carboxylase carboxyl transferase subunit beta | 4255 |
| htoA | probable periplasmic serine protease do/HhoA-like precursor | 4256 |
| mfd | transcription-repair coupling factor | 4257 |
| — | conserved hypothetical protein | 4258 |
| — | predicted P-loop ATPase fused to an acetyltransferase | 4259 |
| — | conserved hypothetical protein | 4260 |
| — | ABC transported ATP-binding protein | 4261 |
| — | predicted plasmid maintenance system antidote protein | 4262 |
| — | predicted plasmid maintenance system killer protein | 4263 |
| — | predicted ABC-type transport system, periplasmic component | 4264 |
| — | predicted ABC-type transport system, permease component | 4265 |
| uvrB | UvrABC system protein B | 4266 |
| — | predicted phosphoglycerol transferase-like protein | 4267 |
| mao2 | NADP-dependent malic enzyme | 4268 |
| — | possible polysaccharide biosynthesis protein | 4269 |
| rsuA | ribosomal small subunit pseodouridine synthase A | 4270 |
| bcr | bicyclomycin resistance protein | 4271 |
| — | conserved hypothetical protein | 4272 |
| — | predicted membrane protein | 4273 |
| proA | gamma-glutamyl phosphate reductase | 4274 |
| dnaJ | chaperone protein DnaJ | 4275 |
| dnaK | chaperone protein DnaK | 4276 |
| — | conserved hypothetical protein | 4277 |
| mgsA | methylglyoxal synthase | 4278 |
| aceE | pyruvate dehydrogenase E1 component | 4279 |
| aceF | dihydrolipoamide acetyltransferase component of pyruvate dehydrogenase complex | 4280 |
| lpdA | dihydrolipoamide dehudrogenase | 4281 |
| — | hypothetical protein | 4282 |
| apt | adenine phosphoribosyltransferase | 4283 |
| dnzX | DNA polymerase III subunit gamma/tau | 4284 |
| upp | uracil phosphoribosyltransferase | 4285 |
| uraA | probable uracil permease | 4286 |
| — | predicted ATPase involved in DNA replication initiation | 4287 |
| — | predicted translation initiation factor 1-like proterin | 4288 |
| pyrF | orotidine 5'-phosphate decarboxylase | 4289 |
| — | predicted N-acetylglucosaminyl transferase | 4290 |
| — | predicted membrane protein | 4291 |
| ihfB | integration host factor beta subunit | 4292 |
| rpsA | 30S ribosomal protein S1 | 4293 |
| cmk | ctidylate kinase | 4294 |
| — | conserved hypothetical pyridoxine biosynthesis enzyme | 4295 |
| — | predicted glutamine amidotransferase involved in pyridoxine biosynthesis | 4296 |
| dld | D-lactate dehydrogenase | 4297 |
| — | conserved hypothetical protein | 4298 |
| nlpC | probable lipoprotein NlpC | 4299 |

TABLE 7-continued

Gene Products of the NTHi Genome

| Gene Name | Product Name | SEQ ID NO: |
|---|---|---|
| tldD | TldD | 4300 |
| — | predicted methyltransferase | 4301 |
| — | putative lipoprotein | 4302 |
| — | predicted endonuclease distantly related to archael holliday junction resolvase | 4303 |
| — | predicted phosphoheptose isomerase | 4304 |
| — | predicted periplasmic or secreted lipoprotein | 4305 |
| nrdA | ribonucleoside-diphosphate reductase alpha chain | 4306 |
| nrdB | ribonucleoside-diphosphate reductase beta chain | 4307 |
| sucB | dihydrolipoamide succinyltransferase component of 2-oxoglutarate dehydrogenase complex | 4308 |
| sucA | 2-oxoglutarate dehydrogenase E1 component | 4309 |
| — | predicted Zn-dependent hydrolase-like protein, including glyoxylases | 4310 |
| — | conserved putative deoxyribonuclease | 4311 |
| — | conserved hypothetical protein | 4312 |
| — | conserved hypothetical protein | 4313 |
| prc | tail-specific protease precursor | 4314 |
| proQ | predicted activator of osmoprotectant transporter PropP | 4315 |
| — | paraquat-inducible protein A-like protein | 4316 |
| — | paraquat-inducible protein B-like protein | 4317 |
| moaE | molybdopterin converting factor subunit 2 | 4318 |
| moaD | molybdopterin converting factor subunit 1 | 4319 |
| moaC | molybdenum cofactor biosynthesis protein C | 4320 |
| moaA | molybdenum cofactor biosynthesis protein A | 4321 |
| — | predicted regulator of cell morphogenesis and NO signaling | 4322 |
| | predicted regulator of cell morphogenesis and NO signaling | 4323 |
| — | probable phosphosugar isomerase Hi1678 | 4324 |
| yrbI | 3-deoxy-D-manno-octulosonate 8-phosphate phosphatase | 4325 |
| hmw1A | HMW1A, high molecular weight adhesin 1 | 4326 |
| hmw1B | HMW1B, OMP-85-like protein required for secretion of HMW1A and HMW2A | 4327 |
| hmw1C | HMW1C, putative glycosyltransferase involved in glycosylation of HMW1A and HWM2A | 4328 |
| — | predicted membrane protein | 4329 |
| — | conserved hypothetical protein | 4330 |
| sohB | possible protease SohB | 4331 |
| rnfA | predicted NADH:ubiquinone oxidoreductase, subunit RnfA | 4332 |
| rnfB | predicted NADH:ubiquinone oxidoreductase, subunit RnfB | 4333 |
| rnfC | predicted NADH:ubiquinone oxidoreductase, subunit RnfC | 4334 |
| rnfD | predicted NADH:ubiquinone oxidoreductase, subunit RnfD | 4335 |
| rnfG | predicted NADH:ubiquinone oxidoreductase, subunit RnfG | 4336 |
| — | predicted NADH:ubiquinone oxidoreductase, subunit RnfE | 4337 |
| nth | endonuclease III | 4338 |
| — | predicted Na+-dependent transporters of the SNF family | 4339 |
| modC | molybdenum import ATP-binding protein | 4340 |
| modB | molybdenum transport system permease protein | 4341 |
| modA | molybdate-binding periplasmic protein | 4342 |
| mode | Transcriptional regulator ModE | 4343 |
| lsgF | Putative UDP-galactose-lipooligosaccharide galactosyltransferase | 4344 |
| lsgE | Putative UDP-galactose-lipooligosaccharide galactosyltransferase | 4345 |
| lsgD | Putative UDP-glcNAc-lipooligosaccharide N-acetylglucosaminyl glycosyltransferase | 4346 |
| lsgC | Putative UDP-galactose--lipooligosaccharide galactosyltransferase | 4347 |
| lsgB | CMP-N-acetylneuraminate-beta-galactosamide-alpha-2,3-sialytransferase | 4348 |
| lsgA | putative lipooligosaccharide flippase | 4349 |
| — | conserved hypothetical protein | 4350 |
| — | predicted permease | 4351 |
| — | predicted permease | 4352 |
| pepA | cytosol aminopeptidase | 4353 |
| — | predicted choline-glycine betaine transporter | 4354 |

TABLE 7-continued

Gene Products of the NTHi Genome

| Gene Name | Product Name | SEQ ID NO: |
|---|---|---|
| qseC | sensor protein QseC | 4355 |
| qseB | transcriptional regulatory protein QseB | 4356 |
| — | conserved hypothetical protein | 4357 |
| crr | PTS system, glucose-specific IIA component | 4358 |
| ptsI | Phosphoenolpyruvate-protein phosphotransferase | 4359 |
| ptsH | Phosphocarrier protein HPr | 4360 |
| — | probable GTPase | 4361 |
| orn | oligoribonuclease | 4362 |
| wecA | undecaprenyl phosphate | 4363 |
| glnD | [protein-PII] uridylyltransferase | 4364 |
| map | methionine aminopeptidase | 4365 |
| — | conserved hypothetical protein | 4366 |
| — | conserved hypothetical protein | 4367 |
| mrcB | penicillin-binding protein 1B | 4368 |
| purC | phosphoribosylaminoimidazole-succinocarboxamine synthase | 4369 |
| argG | argininosuccinate synthase | 4370 |
| — | Mn2+ and Fe2+ transporter of the NRAMP family | 4371 |
| — | conserved hypothetical protein | 4372 |
| — | predicted allophanate hydrolase subunit 2 | 4373 |
| — | predicted allophanate hydrolase subunit 1 | 4374 |
| rnb | exoribonuclease II | 4375 |
| fabI | enoyl-[acyl-carrier-protein] reductase [NADH] | 4376 |
| prfC | peptide chain release factor 3 | 4377 |
| — | conserved hypothetical protein | 4378 |
| — | predicted branched chain amino acid permease | 4379 |
| — | predicted branched chain amino acid permease | 4380 |
| metR | HTH-type transcriptional regulator MetR | 4381 |
| lldD | L-lactate dehydrogenase | 4382 |
| murI | glutamate racemase | 4383 |
| recG | ATP-dependent DNA helicase | 4384 |
| spoT | guanosine-3',5'-bis 3'pyrophosphohydrolase | 4385 |
| rpoZ | DNA directed RNA polymerase omega chain | 4386 |
| gmk | guanylate kinase | 4387 |

EXAMPLE 10

Comparison of the Genomes of NTHi, Strain 86-028NP and *H. influenzae*, Strain RD The genomic sequence of strain 86-028NP contains 1,913,428 bp. This is approximately 4 percent larger than the strain Rd genome (1,830,137 bp) (Fleischmann et al., *Science* 269: 496-512, 1995). There are also a larger number of genes in strain 86-028NP: 1942 compared to 1743 in strain Rd. The gene complement was compared to that of strain Rd using the Seqman program in the DNASTAR suite. With 80% identity at the nucleotide level as a cutoff value, 285 ORFs were identified in the 86-028NP genome that were absent from the strain Rd genome and 167 ORFs were identified in the strain Rd genome that are absent from the strain 86-028NP genome.

Strain 86-028NP, like strain Rd, has six ribosomal operons. Using tRNAscan-SE v1.11, 58 tRNA genes were identified in the strain 86-028NP genome, representing the 20 common amino acids. The tRNA-Glu, tRNA-Ala and tRNA-Ile genes were located in spacer regions between the 16S and 23S ribosomal RNA genes. A tRNA gene containing the UCA anticodon was also identified. This anticodon corresponds to an opal stop codon and is typically associated with an opal-suppressing tRNA that incorporates selenocysteine. The tRNA is adjacent to two genes encoding selB (NTHI0836), a Sec tRNA specific elongation factor, and selA (NTHI0835), the enzyme that converts serine to dehydroalanine preparatory to forming selenocysteine by incorporation of selenium (Forchhammer et al., *Nature* 342:453-6, 1989) The selD gene (NTHI0297), encoding selenophosphate synthetase was also identified. The importance of this selenocysteine system is evidenced by the coding sequence for the alpha subunit of formate dehydrogenase (NTHI0007) containing an inframe TGA stop codon that is presumably read as a selenocysteine codon. The inframe TGA stop codon was previously noted in the current annotation of the strain Rd formate dehydrogenase gene (GenPept Accession P46448).

A gross comparison between the genomes involving analysis of the gene order of strain 86-028NP and that of strain Rd reveals a single major rearrangement in the form of a large inversion. This 471 kb inversion represents almost 25% of the strain 86-028NP genome and is bounded by NTHI1391, and NTHI1394 (homologues of HI1218 and HI1645 respectively) and by NTHI1949 and NTHI1950 (homologues of HI1219 and HI1647 respectively). HI1219 and HI1646 are partially duplicated genes in strain Rd annotated as cmkA and cmkB (cytidylate kinases). One cmk gene (NTHI1949) is present in strain 86-028NP with a small cmk-like fragment between NTHI1391 and NTHI1394. Several clones from the scaffolding library overlap each end of the inversion in the 86-028NP genome validating our assembly. Within this large inversion are several insertions, the largest of which are approximately 13 kb, 27 kb and 51 kb in size. These regions contain predominantly hypothetical and conserved hypothetical genes as well as a number of homologues of phage genes. For example, the 27 kb insertion contains remnants of HP1- and HP2-like phage genes. The largest insert is bounded by homologues of integrase genes. In strain Rd, a mu-like phage is localized to this region (Morgan et al., *J Mol Biol* 317:337-59, 2002) This phage is not present in the strain 86-028NP genome. Also within the large inverted region is a 21 kb inversion that restores synteny with the Rd genome.

In addition to the large inversion, strain 86-028NP has other regions of divergence from co-linearity with the strain Rd genome. These include 9 regions greater than 5 kb, which contain sequences with no apparent homology to DNA that is present in strain Rd. Two of these regions contain the HMW adhesins that are discussed below. Hypothetical genes predominate in six of the unique regions. The ninth region is approximately 56 kb in size. It lies between NTHI0100 and NTHI0165. BLASTn analysis indicated that genes in this region, designated ICEHin86-028NP, have high homology to genes in the *H. influenzae* type b plasmid, ICEHin1056 (Mohd-Zain et al., *J Bacteriol* 186:8114-22, 2004). ICE-Hin1056 is a member of an extended family of genomic islands that are defined by a series of common core genes (Mohd-Zain et al., *J Bacteriol* 186:8114-22, 2004). ICE-Hin86-028NP possesses homologues of 45 ICEHin1056 ORFs. These include ORFs near the 5' end of ICEHin86-028NP, including the defined core genes, that primarily encode proteins with putative roles in plasmid replication and conjugation and ORFs near the 3' end that primarily encode conserved hypothetical proteins with motifs that suggest that they may be either membrane associated or exported. Notably, ICEHin86-028NP lacks the genes encoding proteins involved in tetracycline, chloramphenicol and β-lactam resistance found in ICEHin1056. Scattered within ICEHin86-028NP are a transposase, resolvases, and a putative integrase regulator suggesting that ICEHin86-028NP is a composite element derived from several mobile genetic elements.

ICEHin1506 has a sequence designated as an attP site 5' the first gene. In strain 86-028NP, a perfect copy of this attP site is present 5' to NTHI0101 and a copy of this attP site, with a single nucleotide change, is present 3' of NTHI0164. The attP sites are implicated in the incorporation of mobile genetic elements into bacterial chromosomes to form genomic islands, possibly suggesting a mechanism by which this large section of genetic material became integrated into the strain 86-028NP genome (Dimopoulou et al., *Antimicrob Agents Chemother* 46:1602-3, 2002). ICEHin86-028NP has a G+C content of 39%, lower than any of the other related genomic islands and close to strain 86-028NP's overall genome G+C content of 38%. This implies a long-term genomic association for this element. The presence of this element with its complement of genes homologous to those in ICEHin1506 (Dimopoulou et al., *Antimicrob Agents Chemother* 46:1602-3, 2002) which are thought to encode membrane-associated and secreted proteins may have important implications for the virulence of strain 86-028NP.

Several members of the Pasteurellaceae including *Haemophilus ducreyi*, *Pasteurella multocida* and *Actinobacillus actinomycetemcomitans* produce well characterized protein toxins. In contrast, *H. influenzae* does not appear to produce protein toxins and genes encoding putative protein toxins were not identified in the strain 86-028NP genome. In *H. influenzae*, the genes encoding glycosyltransferases responsible for endotoxin biosynthesis and genes encoding proteins that give the bacteria enhanced "fitness" during the process of infection have generally been considered virulence determinants. These genes include those that encode adhesins, the heme and haemoglobin binding proteins as well as the genes that encode proteins that protect against oxidative stress.

Contingency Genes

*H. influenzae* has a limited number of two-component regulatory systems and other global regulators. Moxon and co-workers have argued that loci termed "simple contingency loci" provide an alternative mechanism for regulating gene expression, thus increasing the fitness of an organism by contributing to that organism's ability to rapidly respond to changing environmental conditions. These loci contain short tandem sequence repeats either within, or 5' to, a coding region. During DNA replication, addition or loss of a repeat within a reading frame results in an alteration in the reading frame. When localized 5' to a coding region, addition or loss of a repeat results in a change in promoter activity (Bayliss et al., *Clin Invest* 107:657-62, 2001). Loci containing simple sequence repeats have been studied extensively in *H. influenzae*, for example (Hood et al., *Proc Natl Acad Sci USA* 93:11121-5, 1996). Several of the loci described in the following sections as phase variable contain simple sequence repeats.

Adhesins

Strain 86-028NP possesses a number of genes which encode products that primarily function in adherence to host cells (Table 8). One of these, the outer membrane protein P5, has previously been identified and its function carefully dissected (Jiang et al., *Infect Immun* 67:187-92, 1999; Kennedy et al., *Infect Immun* 68:2756-65, 2000; Novotny et al., *J Immunol* 171:1978-83, 2003; Novotny et al., *Infect Immun* 68:2119-28, 2000; Novotny et al., *Vaccine* 20:3590-7, 2002; Sirakova et al., *Infect Immun* 62:2002-20, 1994). Strain 86-028NP possesses a gene cluster containing four genes that are homologues of pilABCD from strain Rd, *Actinobacillus pleuropneumoniae* and *P. multocida* (Bakaletz et al., *Infect Immun* 73:1635-4, 2005; Doughty et al., *Vet Microbial* 72:79-90, 2000; Ruffolo et al., *Infect Immun* 65:339-43, 1997 Stevenson et al., *Vet Microbiol* 92:121-34, 2003). These genes together with the comE gene and genes yet to be identified encode a type IV pilus that has a role in adherence of strain 86-028NP to nasopharyngeal tissues (Kennedy et al., *Infect. Immun.*, 68: 2756-2765, 2000).

Strain 86-028NP possesses two high molecular weight (HMW) adhesin gene clusters that are absent in strain Rd. The high molecular weight adhesins were first characterized in NTHi, strain 12, which has two HMW gene clusters, each encoding three proteins (HMWA, HMWB and HMWC). HMWA is the structural component of the adhesin, HMWB has a role in trans-membrane translocation, while HMWC is required for glycosylation of HMWA (Barenkamp et al., *Infect Immun* 60:1302-13, 1992; Barenkamp et al., *Infect Immun* 62:3320-8; 1994; Grass et al., *Mol Microbiol* 48:737-51, 2003; St Geme et al., *Mol Microbiol* 27:617-30, 1998). Similarly, strain 86-028NP's two HMW gene clusters contain homologues of the hmwA, B and C genes in the same gene context as in strain 12 (Buscher et al., *J Bacteriol* 186:4209-17, 2004). The HMW1A and HMW2A proteins from strain 86-028NP are 72% identical, with the major area of divergence, including a 41 amino acid insertion in HMW2A, toward the C-termini. The paired HMWB and HMWC proteins from strain 86-028NP are 99% identical, respectively. The sequence ATCTTTC is repeated 17 times upstream of hmw1A and 23 times upstream of hmw2A. In strain 12, 16 repeats of this sequence are found 5' of each hmw gene cluster (Barenkamp et al., *Infect Immun* 60:1302-13, 1992).

Hap is an autotransported protein with a domain homologous to the catalytic domain of IgA1 proteases. The NTHI0354 gene encodes a protein with 83% identity to Hap from the NTHi strain N187 (St Geme et al., *Mol Microbial* 14:21.7-3, 1994). Strain 86-028NP, along with other NTHi strains that possess HMW1 and HMW2, lacks the gene encoding Hia, another *Haemophilus* adhesin (Barenkamp et al., *Mol Microbial* 19:1215-23, 1996). Strain 86-028NP also lacks the hif gene cluster, encoding the hemagglutinating pilus as we previously reported (Munson et al., *Infect Immun* 72:3002-10, 2004).

TABLE 8

NTHi genes that encode proteins that primarily function in adherence to host cells

| NTHI# | HI# | Gene name | SEQ ID NO: | Function | Contingency Repeats |
|---|---|---|---|---|---|
| 354 | | hap | 1080 | Adhesion and penetration protein Hap | |
| 406 | 296 | pilD | 1125 | Putative type 4 prepilin-like protein specific leader peptidase (EC 3.4.23.43) | |
| 407 | 297 | pilC | 1126 | Putative type IV pilin secretion protein | |
| 408 | 298 | pilB | 1127 | Putative type IV pilin secretion protein | |
| 409 | 299 | pilA | 1128 | Type IV pilin subunit protein | |
| 1332 | 1164 | ompP5 | 1953 | Outer membrane protein P5 (OMP P5-homologous adhesin) | |
| 1448 | | hmw2C | 2057 | HMW2C, putative glycosyltransferase involved in glycosylation of HMW1A and HMW2A | |
| 1449 | | hmw2B | 2058 | HMW2B, OMP-85-like protein required for HMW1A and HMW2A secretion | |
| 1450 | | hmw2A | 2059 | HMW2A, high molecular weight adhesin 2 | ATCTTTC repeated 23 times, 5' of gene |
| 1983 | | hmw1A | 2530 | HMW1A, high molecular weight adhesin 1 | ATCTTTC repeated 17 times, 5' of gene |
| 1984 | | hmw1B | 2531 | HMW1B, OMP-85-like protein required for secretion of HMW1A and HMW2A | |
| 1985 | | Hmw1C | 2532 | HMW1C, putative gylcosyltransferase involved in glycosylation of HMW1A and HMW1B | |

In Tables 8, 9 and 10, the "NTHI number" refers to the locus tag number within the NTHi, strain 86-028NP genome as indicated at the Microbial-Pathogenesis *H. influenzae* 86028 NP web site and in Genbank Accession No. CP000057. The HI number" refers to the corresponding locus tag number in the TIGR (The Institute for genomic redearc Lipooligosaccharide Synthesis [See [Page 13 of Original Application]

The structure, biosynthesis and role in virulence of *H. influenzae* lipooligosaccharide (LOS) has been studied extensively. Table 9 contains a list of genes involved in lipooligosaccharide biosynthesis. Strain 86-028NP has the full complement of genes required to synthesize the heptose-Kdo-Lipid A portion of LOS. The lgtF and lpsA genes encode glycosyltransferases that add glucose, and glucose or galactose, to heptose residues 1 and 3, respectively. Both of these genes are present in the strain 86-028NP genome, therefore it is likely that carbohydrate chains can be extended from the heptose 1 and heptose 3 residues of the strain 86-028NP LOS (Hood et al., *Microbiology* 150:2089-97, 2004). In the serotype b strain RM153, the lic2C gene encodes a glucosyltransferase that adds glucose to heptose 2 (Hood et al., *Microbiology* 150:2089-97, 2004). In the strain 86-028NP genome, this gene contains a frame shift. The phase variable lic2A and licA genes, encoding a galactosyltranferase and choline kinase, respectively, are present in the strain 86-028NP genome (High et al., *Mol Microbiol* 9:1275-82, 1993; Hood et al., *Glycobiology* 11:957-67, 2001; Weiser et al., *Infect Immun* 65:943-50, 1997). The lex2B gene which encodes a glucosyltransferase in the serotype b strain DL42, as well as a number of other serotypeable strains, is present in the strain 86-028NP genome (Griffin et al., *Microbiology* 149:3165-75, 2003; Jarosik et al., *Infect Immun* 62:4861-7, 1994). Five-prime to the lex2B gene in strain DL42 is the short phase variable lex2A gene. In strain 86-028NP, this gene is out-of-frame compared to the DL42 sequence (Genbank Accession U05670), due to the loss of one tetranucleotide repeat and a 5 bp deletion. Recently, Hood and co-workers described a locus in strain Rd, designated lung, that contains HI0866 through HI0874 (Hood et al., *J Bacteriol* 186:7429-39, 2004). With the exception of a homologue of rmlB, these genes are absent from the strain 86-028NP genome. This includes the siaA gene which encodes a sialyltransferase recently shown to be important in biofilm formation in NTHI strain 2019 (Greiner et al., *Infect Immun* 72:4249-60, 2004; Jones et al., *J Biol Chem* 277:14598-611, 2002). Two copies of a homologue of the lic3A gene, encoding an alternative sialyltransferase, were identified in the strain 86-028NP genome (Hood et al., *Mol Microbiol* 39:341-50, 2001; Jones et al., *J Biol Chem* 277:14598-611, 2002), as well as a copy of the lsgB gene that encodes another sialyltransferase Jones et al., *J Biol Chem* 277:14598-611, 2002).

TABLE 9

NTHi genes involved in lipooligosaccharide biosynthesis

| NTHI# | HI# | Gene name | SEQ ID NO: | Function | Contingency Repeats |
|---|---|---|---|---|---|
| 68 | 58 | kdsB | 831 | 3-deoxy-D-manno-octulosonic acid cytidylyltransferase | |
| 69 | 59 | lpxK | 832 | Tetraacyldisaccharide 4'-kinase | |
| 72 | 60 | msbA | 833 | Lipid A export ATP-binding protein msbA | |
| 296 | 199 | msbB | 1029 | Lipid A biosynthesis (KDO)2-(lauroyl)-lipid IVA acyltransferase | |
| 365 | 258 | lgtC | 1090 | UDP-galactose--lipooligosaccharide galactosyltransferase | GACA repeated 10 times, in frame |

TABLE 9-continued

NTHi genes involved in lipooligosaccharide biosynthesis

| NTHI# | HI# | Gene name | SEQ ID NO: | Function | Contingency Repeats |
|---|---|---|---|---|---|
| 366 | 260 | orfM | 1091 | Xanthosine triphosphate pyrophosphatase | |
| 367 | 260.1 | kdkA | 1092 | 3-deoxy-D-manno-octulosonic acid kinase | |
| 368 | 261 | opsX | 1093 | ADP-heptose--lipooligosaccharide heptosyltransferase I | |
| 383 | 275 | lpt6 | 1107 | PE-tn-6--lipooligosaccharide phosphorylethanolamine transferase | |
| 471 | 351 | galE | 1184 | UDP-glucose 4-epimerase | |
| 472 | 352 | lic3A | 1185 | CMP-neu5Ac--lipooligosaccharide alpha 2-3 sialyltransferase | CAAT repeated 18 times, in frame |
| 512 | 391 | | | Predicted acyltransferase | AGCA repeated 8 times, in frame |
| 649 | 523 | waaQ | 1350 | ADP-heptose--lipooligosaccharide heptosyltransferase III | |
| 677 | 550 | lic2A | 1378 | UDP-galactose--lipooligosaccharide galactosyltransferase | CAAT repeated 14 times, in frame |
| 772 | 652 | kdtA | 1462 | 3-deoxy-D-manno-octulosonic acid transferase | |
| 773 | 653 | lgtF | 1463 | UDP-glucose--lipooligosaccharide glucosyltransferase | |
| 892 | 735 | lpxH | 1569 | UDP-2,3-diacylglucosamine hydrolase | |
| 899 | 740 | pgmB | 1575 | phosphoglucomutase | |
| 913 | | lex2B | 1586 | UDP-glucose--lipooligosaccharide glucosyltransferase | |
| 926 | 765 | lpsA | 1597 | lipooligosaccharide glycosyltransferase | |
| 976 | 812 | galU | 1644 | UTP-glucose-1-phosphate uridylyltransferase | |
| 1034 | | lic3A2 | 1696 | CMP-neu5Ac--lipooligosaccharide alpha 2-3 sialyltransferase | CAAT repeated 18 times, in frame |
| 1037 | 873 | rmlB | 1698 | dTDP-glucose 4,6-dehydratase | |
| 1082 | 915 | lpxC | 1739 | UDP-3-O-[3-hydroxymyristoyl] glucosamine N-acyltransferase | |
| 1180 | 1005 | | | Predicted PE--lipooligosaccharide phosphorylethanolamine transferase | |
| 1220 | 1060 | lpxB | 1858 | Lipid-A-disaccharide synthase | |
| 1222 | 1061 | lpxA | 1859 | Acyl-[acyl-carrier-protein]--UDP-N-acetylglucosamine O-acyltransferase | |
| 1224 | 1064 | | | Predicted PE--lipooligosaccharide phosphorylethanolamine transferase | |
| 1272 | 1105 | rfaF | 1900 | ADP-heptose--lipooligosaccharide heptosyltransferase II | |
| 1278 | 1114 | rfaD | 1906 | ADP-L-glycero-D-manno-heptose-6-epimerase | |
| 1312 | 1144 | gmbA | 1934 | UDP-3-O-[3-hydroxymyristoyl] N-acetylglucosamine deacetylase | |
| 1350 | 1181 | gmhA | 1969 | Phosphoheptose isomerase | |
| 1474 | 1578 | lgtD | 2079 | Putative UDP-glcNAc--lipooligosaccharide N-Acetylglucosamine glycosyltransferase | |
| 1576 | 1557 | kdsA | 2172 | Phospho-2-dehydro-3-deoxyoctonate aldolase and 3-deoxy-D-manno-octulosonic acid 8-phosphate synthetase | |
| 1594 | 1540 | licD | 2189 | Phosphorylcholine transferase | |
| 1595 | 1539 | licC | 2190 | Protein licC, CTP--phosphocholine cytidylyltransferase | |
| 1596 | 1538 | licB | 2191 | Protein licB, putative cho;ine uptake protein | |
| 1597 | 1537 | licA | 2192 | Protein licA, choline kinase | CAAT repeated 15 times, in frame |
| 1606 | 1527 | htrB | 2200 | Lipid A biosynthesis lauroyl acyltransferase | |
| 1607 | 1526 | rfaE | 2201 | ADP-heptose synthase | |
| 1664 | 1337 | mrsA | 2251 | Predicted phosphomannomutase | |
| 1750 | | | | Putative glycosyltransferase, glycosyl transferase family 8 protein | GACA repeated 14 times, in frame |
| 1769 | | | | Putative glycosyltransferase | CCAA repeated 17 times, out of frame |
| 1891 | 1279 | siaB | 2433 | CMP-neu5Ac synthetase | |
| 1921 | 1244 | | | Possible polysaccharide biosynthesis protein | |
| 2002 | 1695 | lsgF | 2548 | Putative UDP-galactose--lipooligosaccharide galactosyltransferase | |
| 2003 | 1696 | lsgE | 2549 | Putative UDP-galactose--lipooligosaccharide galactosyltransferase | |
| 2004 | 1697 | lsgD | 2550 | Putative UDP-glcNAc--lipooligosaccharide N-Acetylglucosaminyl glycosyltransferase | |
| 2005 | 1698 | lsgC | 2551 | Putative UDP-galactose--lipooligosaccharide galactosyltransferase | |

TABLE 9-continued

NTHi genes involved in lipooligosaccharide biosynthesis

| NTHI# | HI# | Gene name | SEQ ID NO: | Function | Contingency Repeats |
|---|---|---|---|---|---|
| 2006 | 1699 | lsgB | 2552 | CMP-N-acetylneuraminate-beta-galactosamide-alpha-2,3-sialyltransferase | |
| 2007 | 1700 | lsgA | 2553 | Putative lipooligosaccharide flippase | |
| 2025 | 1716 | wecA | 2569 | Undecaprenyl-phosphate alpha-N-acetylglucosaminyl 1-phosphate transferase | |

Iron Acquisition

H. influenzae strains have an absolute requirement for either heme or iron, together with protophorphyrin IX (PPIX), the immediate precursor of heme (Evans et al., J Med Microbiol 7:359-65, 1974; White et al., J Bacteriol 85:842-50, 1963). Table 10 contains a list of genes involved in iron acquisition. Three haemoglobin and haemoglobin-haptoglobin binding proteins HgpA, HgpB and HgpC, were identified in H. influenzae type b, strain HI689 (Jin et al., Microbiology 145 (Pt 4):905-14, 1999; Morton et al., Infect Immun 67:2729-39, 1999; Ren et al., Infect Immun 66:4733-41, 1998). In strain HI689, these genes have CCAA tetranucleotide repeats and are known to be regulated by slip-strand mispairing. Two of these genes are present in strain 86-028NP. They both contain CCAA repeats; the hgpB gene is in-frame while the hgpC gene is out-of-frame. The derived amino acid sequence of a third gene that contains CCAA repeats is 45% identical to hgpA. We have designated this gene hgpD. This gene is out-of-frame. Homologues of the hxuABC genes of H. influenzae type b that encode heme and heme-hemopexin complexes (Cope et al., Infect Immun 69:2353-63, 2001; Cope et al., Infect Immun 66:4511-6, 1998; Cope et al., J Bacteriol 177:2644-53, 1995) as well as a homologue of the hemR receptor were identified. Strain 86-028NP also has the gene encoding the heme-binding lipoprotein HbpA (Heath et al., Pediatr Infect Dis J 20:300-5, 2001). Downstream of hbpA is NTHI1022, a hypothetical gene whose product is a member of COG0748, a cluster that includes putative heme utilization proteins. A homologue of the hup gene, recently identified in H. influenzae type b, that encodes a general heme utilization protein, was also identified (Morton et al., Microbiology 150:3923-33, 2004).

In addition to the heme transport systems, iron transport systems were also identified. The hitABC genes encode the FbpABC proteins respectively, members of a highly specific ferric iron ABC transport system that was elegantly characterized by complementing a siderophore-deficient E. coli strain with the hitABC genes cloned from an H. influenzae type b strain (Anderson et al., J Bacteriol 186:6220-9, 2004). Transferrin-binding proteins 1 and 2 encoded by tbpAB (Gray-Owen et al., Infect Immun 63:1201-10, 1995; Gray-Owen et al., Infect Immun 63:3809-15, 1995) as well as genes designated hfeABCD that are homologues of an ABC transport system involved in iron uptake, originally characterized in Yersinia pestis (Bearden et al., J Bacteriol 180:1135-47, 1998) were identified. This latter gene cluster is also present in strain Rd. NTHI2035 encodes a putative homologue of the NRAMP family of $Mn^{2+}$ and $Fe^{2+}$ transporters (Richer et al., J Mol Evol 57:363-7, 2003).

As noted above, H. influenzae can use iron, together with PPIX, as a source of heme for growth in vitro. The hemH gene encoding ferrochelatase, which catalyzes the incorporation of iron into PPIX (Schlor et al., Infect Immun 68:3007-9, 2000), was identified. The gene encoding the global regulator, Fur, was also identified (Andrews et al., FEMS Microbiol Rev 27:215-37, 2003; Smoot et al., J Med Microbiol 48:629-3, 1999).

TABLE 10

NTHi Genes Involved in Iron Acquisition

| NTHI# | HI# | Gene name | SEQ ID NO: | Function | Contingency Repeats |
|---|---|---|---|---|---|
| 177 | 97 | hitA | 931 | hFbpA, Iron-utilization periplasmic protein | |
| 179 | 98 | hitB | 932 | hFbpB, Iron(III)-transport system permease protein | |
| 180 | 99 | hitC | 933 | hFbpC, Iron-utilization ATP-binding protein | |
| 202 | 113 | hemR | 951 | Hemin receptor | |
| 284 | 190 | fur | 1020 | Ferric uptake regulation protein | |
| 369 | 262 | hxuC | 1094 | Heme/hemopexin-binding protein C (Heme: hemopexin utilization protein C) | |
| 370 | 263 | hxuB | 1095 | Heme/hemopexin-binding protein B (Heme: hemopexin utilization protein B) | |
| 371 | 264 | hxuA | 1096 | Heme/hemopexin-binding protein A (Heme: hemopexin utilization protein A) | |
| 477 | 359 | hfeD | 1090 | Putative ABC-type chelated iron transport system, permease component | |
| 478 | 360 | hfeC | 1191 | Putative ABC-type chelated iron transport system, permease component | |
| 479 | 361 | hfeB | 1192 | Putative ABC-type chelated iron transport system, ATPase component | |
| 481 | 362 | hfeA | 1193 | Putative periplasmic chelated iron binding protein | |
| 736 | | hgpD | 1431 | Hemoglobin-haptoglobin binding protein D (Hemoglobin-haptoglobin utilization protein D) | CCAA repeated 17 times, out of frame |

TABLE 10-continued

NTHi Genes Involved in Iron Acquisition

| NTHI# | HI# | Gene name | SEQ ID NO: | Function | Contingency Repeats |
|---|---|---|---|---|---|
| 782 | 661 | hgpB | 1472 | Hemoglobin-haptoglobin binding protein B (Hemoglobin-haptoglobin utilization protein B) | CCAA repeated 12 times, in frame |
| 840 | 712 | hgpC | 1523 | Hemoglobin-haptoglobin binding protein C (Hemoglobin-haptoglobin utilization protein C) | CCAA repeated 20 times, out of frame |
| 1021 | 853 | hbpA | 1684 | Heme-binding protein A (Hemin-binding lipoprotein) | |
| 1168 | 994 | tbp1 | 1817 | Transferrin-binding protein 1 | |
| 1169 | 995 | tbp2 | 1818 | Transferrin-binding protein 2 | |
| 1329 | 1160 | hemH | 1950 | Ferrochelatase | |
| 1390 | 1217 | hup | 2004 | Heme utilization protein | |
| 2035 | 1728 | | 2577 | Mn2+ and Fe2+ transporter of the NRAMP family | |

Oxidative Stress

Although necessary for growth, the active acquisition of iron can have deleterious effects on bacterial cells. Through the Fenton reaction, iron can react with hydrogen peroxide and generate highly reactive hydroxyl radicals. These products have profound effects, including lipid peroxidation and damage to both iron-containing enzymes and DNA (Imlay, Annu Rev Microbiol 57:395-418, 2003). The best-known defense system against hydroxyl radicals consists of superoxide dismutase A and B which convert highly reactive superoxide to hydrogen peroxide, which is then converted, by catalase, into water and oxygen (Demple, Annu Rev Genet. 25:315-37, 1991). Strains 86-028NP and Rd contain the sodA gene (NTHI1251), but lack the sodB gene. Both strains also possess a catalase gene hktE (NTHI1099) (Bishai et al., *J Bacteriol* 176:2914-21, 1994), the oxyR gene (NTHI0704) encoding a primary regulator of genes involved in protection against oxidative stress (Maciver & Hansen, *Infect Immun* 64:4618-29, 1996; Pomposiello et al., *Trends Biotechnol* 19:109-14, 2001) and the gene encoding a chimeric peroxidase termed Prx/Grx that has a glutathione-dependent role in protection against small alkyl hydroperoxides (Pauwels et al., *J Biol Chem* 278:16658-66, 2003; Vergauwen et al., *J Bacteriol* 185:5555-62, 2003; Vergauwen et al., *J Bacteriol* 185:1572-81, 2003). We previously identified NTHI0212, a gene encoding a homologue of the *P. multocida* peroxiredoxin, TsaA that is absent in strain Rd (Munson et al., *Infect Immun* 72:3002-10, 2004). Strain 86-028NP, however, lacks AhpF, a dedicated alkyl hydroperoxide reductase known to be involved in the reduction of TsaA in *Salmonella* (Poole et al., *Biochemistry* 39:6602-15, 2000). Further protection against oxidative stress may be afforded by the ferritin-like proteins encoded by the ftnA and ftnB (NTHI1773 and NTHI1772, respectively) genes. Over-expression of these proteins were shown to protect an iron overloaded *E. coli* fur mutant against oxidative damage Touati et al., *J Bacteriol* 177:2305-14, 1995). A conserved hypothetical gene, NTHI1817, encodes a protein with homology to a DNA-binding ferritin-like protein. This is a member of the Dps family of non-specific DNA binding proteins, which in *S. enterica* have roles in protection against oxidative stress, both in the presence of iron and during phagocytosis, and are important for virulence in a murine model of *Salmonella* infection (Halsey et al., *Infect Immun* 72:1155-8, 2004) In *E. coli*, Dps was shown to preferentially bind iron that had been oxidized by hydrogen peroxide, thus having an important role in abrogating the production of hydroxyl radicals generated via the Fenton reaction (Zhao et al., *J Biol Chem* 277:27689-96, 2002).

Secretion

In addition to the Sec system, strain 86-028NP has genes that encode the TatA, B and C proteins, cytoplasmic membrane-associated proteins that are involved in a Sec-independent transport of proteins with twin arginines in their signal peptides (NTHI0279, NTHI0280 and NTHI0282) (Bolhuis et al., *J Biol Chem* 276:20213-9, 2001; Yen et al., *Arch Microbiol* 177:441-50, 2002). As previously reported, strain 86-028NP possesses NTHI0585, the gene encoding the autotransported protein Lav (Munson et al., *Infect Immun* 72:3002-10, 2004). This protein is absent in strain Rd, present in *Neisseria* and appears, within *Haemophilus*, to be restricted to pathogenic strains (Davis et al., *J Bacteriol* 183:4626-35, 2001). Strain 86-028NP also has the gene encoding an IgA protease (NTHI1164) (Poulsen et al *J Bacteriol* 174:2913-21, 1992), and as noted above, the gene encoding the Hap adhesin. Both are proteins of the autotransporter class. As described above, the HMW adhesins are members of the two-partner secretion pathway group of proteins.

Outer Membrane Proteins

A number of outer membrane protein (OMP) encoding genes have been identified by homology to those in other *Haemophilus* isolates. These include the major OMPs that were all originally identified in *H. influenzae* type b; the surface expressed P1 (NTHI0522), the porin P2 (NTHI0225), the phosphomonoesterase and heme transporter P4 (NTHI0816), the adhesin P5 (NTHI1332) and the lipoprotein P6 (NTHI0501). Strain 86-028NP also shares a number of minor OMPs with other *Haemophilus* strains. These include D15 and the transferrin binding proteins from *H. influenzae* type b, as well as a homologue of OMP26, which was identified in NTHi strain 289 (Munson et al., *Infect Immun* 56:2235-42, 1988; Munson et al., *Infect Immun* 49:544-9, 1985; Munson et al., *J Clin Invest* 72:677-84, 1983; Reidl et al., *J Exp Med* 183:621-9, Reilly et al., *J Bacteriol* 181:6797-805, 1999; Reilly et al., *FEBS Lett* 494:19-23, 2001). All have subsequently been characterized in NTHi strains and analyzed as potential vaccine candidates (Poolman et al., *Vaccine* 19 Suppl 1:S108-15, 2000; Murphy et al. *Curr Opin Infect Dis* 16:129-34, 2003; McMichael et al., *Curr Opin Investig Drugs* 4:953-8, 2003 Cripps et al. *Immunol Cell Biol* 81:46-51, 2003; Bakaletz et al. *Ann Otol Rhinol Laryngol* Suppl 188:82-94, 2002).

Restriction Enzymes Systems:

Strain 86-028NP lacks the HindII and HindIII type II restriction systems (Fleischmann et al., *Science* 269:496-512. 80, 1995; Nwankwo et al., *Gene* 150:75-80. 104, 1994, Smith, & Marley. *Methods Enzymol* 65:104-8, 1980). In contrast, genes encoding the HaeII system that was originally identified in *H. aegyptius* (Slatko et al., *Gene* 74:45-50, 1988) are present in the strain 86-028NP genome but absent in strain Rd. Both strain 86-028NP and strain Rd have Hsd type I restriction systems encoding a methylransferase (HsdM), a sequence recognition protein (HsdS) and a restriction enzyme (HsdR) (Roberts et al., *Nucleic Acids Res* 31:1805-12, 2003). These genes are adjacent in the strain Rd genome (HI1285-HI1287). The 86-028NP genome contains 3 hsd-like loci that each contain 4 genes. One hsd system is encoded by NTHI1838-NTHI1843. In this gene cluster, NTHI1841 encodes a hypothetical protein. A second hsd-like locus is encoded by NTHI0314-NTHI0318. In this gene cluster, NTHI0316 encodes a putative anticodon nuclease. This hsd-like system may be similar to the prr system in *E. coli* (Tyndall et al., *J Mol Biol* 237:266-74, 1994). A third hsd-locus is encoded by NTHI0188-NTHI0193. In this gene cluster, NTHI0190 encodes a predicted transcriptional regulator with a helix-turn-helix domain.

SEQUENCE LISTING (4387 sequences)

SEQ ID NO: 1 - DNA, 1008 bp, H. influenzae
  misc_feature (11)..(11): n is a, c, g, or t
  misc_feature (16)..(16): n is a, c, g, or t
  misc_feature (21)..(21): n is a, c, g, or t
  misc_feature (37)..(37): n is a, c, g, or t
  misc_feature (588)..(588): n is a, c, g, or t
  misc_feature (685)..(685): n is a, c, g, or t
  misc_feature (741)..(741): n is a, c, g, or t
  misc_feature (753)..(753): n is a, c, g, or t
  misc_feature (784)..(784): n is a, c, g, or t
  misc_feature (812)..(812): n is a, c, g, or t
  misc_feature (893)..(893): n is a, c, g, or t
  misc_feature (895)..(895): n is a, c, g, or t
  misc_feature (1008)..(1008): n is a, c, g, or t
ctgttatacgnaattncgggncctcggtacccctttncaaatcagcccttatgcgttttatgatgcaggtcagttccgttataatagcgaaaatgctaaaattacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaaccctgaaatttaatcaactggtaagcgttccgcctaccagttttataactatatgctttacccgccaatttacagtctatacgcaacccttttttacccctgtatatcaagcaaaccaagcaatgctaaaaaacaatttatatgataaactaaaatatactccgcaccatggcgatacaagggatttaataatatgacaaaagaaaatttgcaaaacactccacaaaatacgaccgtttcacttgtggaatcaaacaacaaccaaacttccccgcaaatgcttcaacaatcacccanacctagcctattgcgcttggacaacatatcgaaaaaaagatatgagtttgcttgtcgtgaataatggggattctggaaaaatggatgctaatttggnaggcgttcacgatattgaatttgacgcacccgctcagctagcatatctaccccganaattactcattnattttgccactcgtctcgctaatgcaattancacacttcttttccgacccccgaatggncaaattctggaagaaggggcggttaaagatgaatagcctgcaccgctggttgcacctgatttttgcctcttccccctacgntnacgcagaccatattctcataaatataatatcaaccagattcccgagggggtctttcatttagcacagaaacctctctatgcaaaattcggattttttacttacgaatcaagcn

SEQ ID NO: 2 - DNA, 901 bp, H. influenzae
  misc_feature (1)..(2): n is a, c, g, or t
  misc_feature (10)..(10): n is a, c, g, or t
  misc_feature (28)..(28): n is a, c, g, or t
nntttcatgncactatcccactatgtgncctgcagaacaatcttataggaccccttcatagtttttatgggaattaaaatgaccgattttagattaaacaaacatccctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaagatagtgatacaaaaacaccaccaaaaattgctgaaacggtaaaaacggccaaaacgccccccccagaacaagcaaacaatattaaagacatcgccaaataccatacgggtgttattgtccctgaagctgggctttttcgtccaaccgctcccccattcgtgttgtccataacacccccccatttattactaccgcccgcttacgttcacatctttccttttcttcgccgcgctttcatcatttttctccggcatttttacataagtagtcccttcccgcttccctcctctcctcttcctccttatttttattatgatgtttataagaatctcctctcttacctattccagcctcgttgttctactcgccttctgctaaccctttctcccttttccatcctctctaccccgccccccctttctcttttttttccccctttcttttttccccccacccctcacttttccccgctttattttttacacaccccccgacacaacattcatctccctttgtatccgctcatctttccccccccccccccaccatcctccgcactctatctttccattctatacccccccttcccttttcccccccccccccctttccgactgcaattttttttcttctccccctccg

SEQ ID NO: 3 - DNA, 1250 bp, H. influenzae
  misc_feature (1000)..(1000): n is a, c, g, or t
agtcacggtcataatcattaaggcgaccacgcctgtaattgccattgcttctatgcaactattaaataaggtttttaaggttaattctttatacacaaatttaccaataattatagagtatgctgctgcaacaatggcagattctgttggactgaataagcctgaaaaaataccgccgataattaataatggcgttaagattgcccaaaaagattgtttaaagctgctgcaaagttgttctcttgtggcttttggtgtacgtggataacctcgtttttttgcaatgcgataattcattgccattaaagctaaagtaattaatacaccgggaataaaacctgcaataaagagttttgcgatagattcattggcgatgacaccgtaaataatcattgcaatacttggtggaactaatggcccaataatacaagaagcagcagtaattcctccgcaaatatcatcgtcataaccagcatcacgcattgctttaatctcaagctgacctaaaccgcctgcatcagctaatgcggatcctgacatacctgaaaataataaacttgcgccgatattaacgtgtcccattcctcctgtgtaatgaccgagtaaggatttagcgaaattaaaaatacgttcggtaatcccaccagtattcattagaatacccgttaaaatataaaacggcacggcaagtaatggaaagctgtctaggctatagactaatttttcagttgcggcatttacgacgttccaacgtgtcatagaaaaataaagtagggtagcaataaataaggaccaacctacagggacaccgataaacataatgatgagccaaacgagtaaggcaatatagactgaacttgaaccgagctttatataattgctaattcgcaatactttgaaccaatctggcgcgaaaaataaaattgcaaataaaatgaccgcacttatgataaagaaagtcgcaggtaaatagcttttccctgtcttaaagtttatgggnttgcgcttggataaagcgaaacatcattaatattgcgataacaggtagtgcagcgaaaatccatttttcagaaatgccccctaaagcatcaataggggaatgatgcgtcattaaaagtacgaatacccgaatgaataaaccagaaatactaccaagactaatattgtcccaaaggaatgggaaaattttgaatttttcgggctcaaatagttaaaaaacaaaaaacactggtcttggttttttaacgcac

SEQ ID NO: 4 - DNA, 905 bp, H. influenzae
gctaaaagtatagctcataaattggatctccctacgttatgtttaagtgatgtgttgtgttacggctcgactaccataatttcaagattggtatgtaatccacgtggtaatgtcgaaccttttctgcctcgttctgcgcggaacttttgcagatcttctggttttaatacaatttttcgttttccagaataaaattcaagacttgcttgatctgaaataagcaataattttgtcaatagttcgctacgatcttttgcattcgctgcgggaatagtgatcattttattgcctttaccttttgataataccggtaaatcttgtgctggaaaaatcaacattctgcctgctgatgtgattgcgacaacaagtgcggtagaatttatcaatgttttaggcttcaacactttggcattttctggtaaagaaatcaaggcttttccagccttgttacgtgcaattaaatcttcaaatttacaaataaaaccatatcctgcatcagaagccatcaataattcttgctgttcgctggccattacaacatattcaatggtcgcaccagtgggtaaattgagtttacctgtaagtggttcgccttgggagcgagcggaaggcaaggaaagcggatcgagtgcataactccgccccgtgctatcttcgatcccatggttgcttactttttccaccccccgatctccataccttttcccagctttgccccttattgcttcacgacccatttttttttttcttccccccgtttctcgtccccttctgtaatgttttttgttctggctttttgtgcgcgcctaccactctcttatcattttttgcctccccgccgccgtcccattgtcaacctccgtcgcgctcccctactcttttccctcttgtctccccccgccttg

SEQ ID NO: 5 - DNA, 1083 bp, H. influenzae
tgtaagaacgactgtcccaatgtaatgctaaaaagtattttaagattttagcattggagacactccctaagaacggaatttctgaaaatttggtgtaagtagaactattgttagagaagcaatggttatgttagaagtagaaaaattagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaaatacttgtaataacataggagttaaaaatggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaacgcaaaactgaaatagagattgctggttttatgctggtcagtaggggaaagggtaccagttcatgaagagattaaacctcagactgggaattattcaaaatggatgaatactataaacaaactttcgaatcttgtcaatgcggattgacctgtttgttcaatttatgcctggtttaaactgacttgactggacccgtt

SEQ ID NO: 6 - DNA, 862 bp, H. influenzae
gagaccccctcttaaattgatcgataaaattcaatatttacacgacggttttgataataaagcaaaagagtttgcaaatatcttaaaaatgggtcgtacccaattgcaagatgcggtgccaatgactgttggtcaagaattcaaagctttctccgtattacttgaagaagaagtgcgtaacttaaaacgtacagcaggtttattacttgaagtaaaccttggtgcgactgcaatcggtactggtttaaatacgccacaaggctatacagaattagttgtaaaacaccttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggccctcgtgcaggtttaaaagaaattaatcttcctgaattacaagcaggttcttctattatgccagcaaaagtaaacccagttgttccagaggtggtaaaccaagtgtgctttaaagtaattggtaacgataccactgtgactttcgcatctgaagctggtcaattacaattaaacgtaatggaaccagtgattggtcaagcaatgttcgaatctatcgacatcttaaccaatgcttgtgtgaacttacgcgataaatgcgtggatggcatcactgtaaacaaagaaatttgtgaaaactacgtgtttaattcaatcggtatcgtgacttacttaaatccatttattggtcaccacaacggcgacttagtgggtaaaatctggcgcaaacaggtaaaggcgtaccgtgaggtgtggtaaaaa

SEQ ID NO: 7 - DNA, 906 bp, H. influenzae
  misc_feature (902)..(902): n is a, c, g, or t
acagttgagtgagtcgagtaaccgcattccaaaatccagcatccacgctaccaccgtaaccttgatacattttcccttttgaaacatctatgttttcagagcgtaaaagtgttctcaataaagcttcatcttggttgtcgatagagttaaagaaatcactcacctgggcagataagttttgacgcatatctgtaagtaagcgagattttaatccagctccactttcatcccaccattgatcacaacttgggaaaccaccttttcccgaattaggtaatgccgcatctcgatttgcatcataagggaacgtgctaataggttgctgagccctaaaacgagggtagagctcgctgttattaataagcaatttaccacctaaccaggatgtttcgcggatttgtgccggactcaaggcaagttggcttgtttgtaatttttgacgagccgggatatagcattgttgcacaaattgctgcacttcagttaataatgctgggttagtgatttttttgatgttgcacttcaaatctaacctgacgtaaatcacgctggcaaggcaatacctgcagtcataccataagttagacctttatccactttgtgcatcaacatccaccaaatagggaattcgggctttgtctgtctccaaatggttgtcggaaatggcgcatagccctgatttatccgggaagcaggaacttatagcccattgaatagaatgaacgtcattgatttcaaggttattcatgataccgggattagaggggcctatgtcaaaacacgatagcatgtgggaaggaattcgattgtgagcagcggattaataatccctttctcacttcatatccccttgttaactcgtcacgcaattttaaagatcatccgataagcggaggagcatnaccc

SEQ ID NO: 8 - DNA, 1043 bp, H. influenzae
agttattccacgtataaaacagtataattccatcaatagatcataaaccaacaggagtattttatgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaagatatttccgttgcagatgcctatctttacattatgctcaattggtgtcgagcagtgggtatagatttcagccacttaacacaactttcggcttttatgcaacgtgttgagactgatcaagctgtcgaaaatgtgagaaaaagtgaagaactaaaagtataaacaggaagtttctacaaaaattgcccgtttttaaccgtttgtatcacgttaagtttaaatttaagtgagtaatttcgcttcttacccaacacagctaaccaattgattctactatgattaaactggttaatccaatgtcgcaatgttctactgtcaagttgaaaatgtttactgatgagtgaataatttttaccattttgaatataaaattcgatgacttgttgtttgaaaagagtgttgtatttggctataaaaaatctgcatcttacaattaatttatataagtaaaaatatcttgcttttatcatcgttaaacttagaataaatataaataattatcattaagattt

SEQ ID NO: 9 - DNA, 870 bp, H. influenzae
  misc_feature (733)..(733): n is a, c, g, or t
  misc_feature (801)..(801): n is a, c, g, or t
aaaagtatgccacgttttttcatatcctttttgctttcaacctttacccgcccgttattgtcataatcaacacgaggacgtgataattctgctttcaaatactcaagctctttgatattgctcgataggcttatcagttcatcgtcagggtaaacatccccatgctttactgctcgataggttttatagaatctatctcgcaacgcccaccaagattgggctttaatgttcgaaaacatatcttgattcttttttcctttgatatattcacgctcgggataagcaactgcaccaccagcattaaatccttccacttgtaaagattttggcaagcgtttaaagtgagcttttactcccgcccccacgccaatactatcgaatataatcaaatcagctttaaatttgaccgcactttgatttgttcggttggcggaatcaatcacatcgccattcttccaaacttcaatgtcaagcaccacagaaccgtgaacaaatgcattatcgttactatccgcaccctcatcagccacatcaaagccaactttcttcattcctttagcggtaaaaccgagcttgagatgcgcatccaccgcacattcaatccatacaggcttaataatggctaaatcggaatcagccacaggctcgccctcataaacgtgacgataaagttcataatcacgctcacgcatctgctccatatcttccattaattctttcggaaaatatgggnttgtcttgccaattcactaagaccgatttacaccgctcaggcggatgaatcacaaaacgctgataggnatcatcaagaatattcttcgggttaaagctcacaataatctgcgaaaccgtctcacgaatgggttggac

SEQ ID NO: 10 - DNA, 1188 bp, H. influenzae
  misc_feature (1032)..(1032): n is a, c, g, or t
  misc_feature (1150)..(1150): n is a, c, g, or t
  misc_feature (1157)..(1157): n is a, c, g, or t
  misc_feature (1171)..(1171): n is a, c, g, or t
ggcggttttttattatgctaataatctatttctttaagtaaaaaatctagagattgtatgaaaaagcttgttctgattacttaaagttatcaaacagctcaataaaaatatatttagatacaaaatgtttacgctaatttaagaaaaacgccccatctttttttaagataaatggggaaaaaatattaaagagttataaacccatcataaatatgggtcgcctcgcctgtcatataaagtggatgaccaacaccattccattcgatcatgagcgaaccgcccggtaaatctacttggacattgttgtttaataagccttgcataattccaactgcaacagctgcacaagcaccacttccacaggcttgagtttcgccagcaccacgttcataaactctaagcttaatatgttctttgttgatgatttgcataaaaccagcattgacacgctcaggaaaacgttcgtggctttctaacaaaggaccaagctgttcaacatttgctgtttgaatatcatctacttgtacaacacaatgaggattccccattgaaactgcaccacatagtacggtttgaatatctgtacgcagaatataatttttctcaaatttatttgcggtaaatggaatttttgctggttcccaaattggttcgcccatattcacacgaatttgattatcatcttttaccgtcaaaaccatattacccttttgtgtgctaaccgagatgtcttttttgttagttagcccttttaatgtcacaaaccgagcaaaacaacgagcaccatttccgcattgcgaaacttcgcttccatcagcattaaaaattctataatgaaagtcgagttcaggatcgtaaggagcttcaacaattaaaagttgatcaaacccaattccacaatggcgattggctaaacgtcggatcgtttctggagtaaaaaacacattttgagtgactccatcaaccacaacaaaatcgttacctaatccgtgcattttggaaaactgcatttttccatcctttgtataaatncaagatttttgcattataaagagcagcaaaatcatgggcaataaagcactctagtttaagcaaagtgcgggtaaaaataccggtaaattttttaccgcacttttattcatttcttggntaccagnattacatcccaagncgttatttgccgaatat

SEQ ID NO: 11 - DNA, 992 bp, H. influenzae
  misc_feature (958)..(958): n is a, c, g, or t
acatttattttacaacaacaagaaacagctttgtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccatatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactatcctcaatgggtatccgcgtagatgaaagtgcattacgtttacaagttggcttaacaggcgatgaaaaccgtttaaaatggattggcaccaagatttattaaacggggaaattgccattaactttcgcggtgggtatcgggtcaatctcgcttagcgatgcttttacttcgtaaaacatattgggggaagtgcaatcaagcgtatggccaaaagaatgttnaaaaaatttaaactttctttaaatcattaagtgg

SEQ ID NO: 12 - DNA, 1058 bp, H. influenzae
gagaccccatggcagctgcaattggggctaaattacccgtttctactgcagttggttctatggtaattgatatcggtggtggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaaccgcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaattagaatatgaacaaaaagtgcggttaaaaataaccgcacttttcctttcatttttttcattcaacaagagaaagtttaatgaaacccattttcggcaaagcccctcccctaggtattcgtctgcttatcgctatctttgcatctattgccttaattttagctgatggacgtaatagctcaataacgaaagcacgtagtgcaatggaaacagcaatagggcggtttatattatcttgcaaatagccctagaagcatcttagatggcatttcagaaaatcttgttgataccaataaattacaaattgaaaacaaagtactacgccaacagcttttggaaaaaaatgcagatttactttaacttgatcaactcaagttgaaaatagcgattacgtcttttattaaatctccgttagaaccgatgatacaac

SEQ ID NO: 13 - DNA, 691 bp, H. influenzae
atgatgtggaagcgcagaaataataatttcaccgtcttcttgtttccaagttgcacgcatttttattgagccacgaccttgctcataaattttacgaatttctgattttggcgaaataatttccgcttctgttggaaaatctgggccttgaacaatttcaagtacatcatctaatctcgctttaggattatctagcaacattactgccgcatcagcaatttcgttaatattgtgtggtggaatatctgtggccatccccaccgcaatacctgttgtgccgttcaataaaatatgaggtaaacgagcaggtaaatattgtggttcagccaaggttccatcaaagtttggttgataatctactgttccttgtccgagttcactcaacaagatttcagagattttagataggcgagattccgtataacgcatggcagcgaaggattttggatcatctggtgccccccagttaccttgaccatctacaagcggataacgataagagaagggttgtgccattaacaccatagcttcataacaagcgctgtcaccatgtggatggaatttaccaagtacatcaccgacggtacgagcagattttttgtattttgccgtggcatttaagccaagttcagacatcgcatatacaatacgacgtgacgggtttagggtaccgagccgatatcgtatacag

SEQ ID NO: 14 - DNA, 1097 bp, H. influenzae
  misc_feature (960)..(960): n is a, c, g, or t
tggttccgaaattcggactcggtacccaaatgaaaaaccctcaacaaacagaaaatcttagagctttatttaaacaaaatctttttaggctatcgttcttatggtgttgcagcagcggcacaaacctatttcggtaaagcattgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcngcagcattagaaaaagcttaacgctttctagtgtattacaagacagcccgattctattcaaaacccggacaaaatgtggcacccgaaactccctgatcgtttgatggcccgagcgttaccgtaggatatgtcaatca

SEQ ID NO: 15 - DNA, 866 bp, H. influenzae
aagcattgaaaatatgatatcacaaagcctgtattttttaacaggcttttttgttcaaaaaaatcttcgaactgtttattcgttggagcaaaaatgaagtatgaattagataaaacaagcggcaatgctcgtcgtggtcgcttggtgtttgaacgtccacaaggcacgttcagtgtagaaacccctgcgtttatgccagtgggtacttatggcacggtaaaaggcatgacaccagaagaagtgcgtgcgacaggtgcagaaattttactgggtaacaccttccatttatggcttcgtccaggtcaagaaattatgcgtaaacacggtgatttgcacgattttatgcaatggcatcgtccgattttgactgacagtggcggtttccaagtattcagtttaggtaaattacgtaaaattaccgaagaaggcgtaaaattccaaaacccaattaacggtgagcgaatcttcctttcgcctgaaaaatccatggaaattcaatatgatttgggttctgatatcgtcatgatttttgatgaatgtacgccttacccagcgactttcgattatgcgaaaaaatctatggaaatgtcacttcgttgggcaaaacgcagccacgatcgctttgatgaattaggcaataaaaatgccctatttggtattatccaagggcggtgtatttgaagaattacgtaaagtctcattagaaggcttagtcaatattgggttttgacggttatgcggtggggcggttttagcggtaggcgaacccaaagaagatatgcaccgcatttttagatacatctgcccacaaaatccagctgacaaaccacgttatttaatggggcgtgggtaaaccagaagattaa

SEQ ID NO: 16 - DNA, 874 bp, H. influenzae
  misc_feature (627)..(627): n is a, c, g, or t
cttggttttaatgtaggttgtacagcaaatgcaggaattgcactgctcaaacacaccgataaccacgcataacaaatcacattttttgacattttaaatttcataaccatttccgagtcaatttttatttattaagcaaataaacgatctgcagcaacgttcataatcaaaccgttttcaagttcaacacgtgctgaatcttttaatacttctaccactgttgcttttttagcattatctccagctttaactttcacaacagaaccaacagaaatttgtgaaaaatcaaccgcacttagtgataatttactctcttttttaaggtttttattcgcaggtttacgcggatgctttttttgttgtgcttttttagctacagcttctgctttacgtttttccgcaaaacgcgctttcgcttcagcaagttgctgtgcagcgtgagcaacgtgttctgcatctaatacacccgcaggattaccctgtaaatcaacacgcactgcaccttcacgacagccatataaataacgccaatttgatgtgtattggcgaagagcctgacgcaattgggttttacttacgcgttcatcatcttgtaatgcttcagctaaatcttgaaataaacctatntttaatgggtttgcttcgccctcctaaacaaagcaaagaggaaatttttctgctaaataagtaatgatagcttttgcgttgttaaattttgcacttccgttggccatctgtaacttggaatgataatggcgcgccacccacaactatccccttggggctattaacacaaacacgaacgccttaatttacggcctccccacgaatttatttcggcccgctgtttggcggcaaattctcccacacatac

SEQ ID NO: 17 - DNA, 1230 bp, H. influenzae
  misc_feature (1210)..(1210): n is a, c, g, or t
acgaaatgatgaaattgacaaaacttttccttgccacagccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgagcaatgttaaaacaattaaaagacggttctcttgacttcacctttgcagaatctgctcgcttccagttgttttaccctgaagcagcagtatttgccttaccttatgttattagcaactacaatgttgcacaaaaagccttattcgatacagaatttggtaaagatttaattaaaaaaatggacaaagatcttggtgttactttactttcccaagcttataacggtactcgccaaacgacttcaaaccgtgcaatcaacagtattgcagatatgaaaggcttaaaacttcgtgtaccaaatgctgcaacaaacttagcctatgctaaatatgttggtgcatcgccaacaccaatggcattttctgaagtttatcttgcattacaaacgaatgccgtcgatggtcaagaaaacccgttagcagcagtgcaagcacaaaaattctatgaagtgcaaaaggtcttatcaatgactaaccccatttttgaaggacccaccttatttaggaagcgccgagaattatagggaactccctggagatctctaaagagatccaagagatgtcggcgataatggtggatatctttctctagatatttctggacggggaaaatagatttcaacgcagcgtgtgtgcatcgggggggacgtttagctgccttagttggtcccgtgttggtgtaggtgccctctgtggtgcggggccggggacccgacgggtcggcaggtcattgcggttgattccgtgtggcaatctggtgtgtgtcgagtctcgatcgcgctgacgttcgcggagttgggctcccctcgtctgcgcagcgcgtctcctggttggtgagcgggcactgcacactatgagatagcggcagaggcgcccgcgtgtttgggcacggtggtcgtcctcgatgacagcggttcggcctctctgcaggtgggcagctgtcagtcggtgggtggcggtagagggggggggacggtcgactgtgganggggggtgctgaggccgtgg

SEQ ID NO: 18 - DNA, 828 bp, H. influenzae
atagcaagcaacatccaccaacgttttataggaaattctcgttcactataaatattttgggcgtaagcatgttctaccgcatttgcaatcgcttcaatgtaactaggatatatccctttcacccccatacttttaagttcatctaatagtggctttgtgatttcgccatctgcactatcactataaacataatgccaacatttcacattttcttgagaagatgaagatgtataattaaaccctaaggatttatatagtcctatatgacaaaatatagcatcaacatcatagggaatatgtttacgatgatctgctggttttgattttggtcttacaatttgaaatttcaaggttctatattgcgattttatcgtatctaaaacagctattaaaacgctacaagcggcagcatcgataatatcagtgtcccgaaaatttagtttcaggcgacttcgacttcgtgctgctagttttgctttttcttcgagctcttctttaaatgctacaaattcataccctatttctttagctaaaataattttatatggggcgataacctcaaaaagattaaaggatttatgagcaagatgtttatatttaggctttccgcctctttgtctgattttcttttctttacttgtgagagctcgtaatgttctttgtctaacaatagatctccataatcgaatatccatagttggttccttgggtaacttatgtagaagtcgttttagttattatgttttcatataataatactgaataccaaaacactttccctaacacagaaattgctgtaggggtaccgaggctgatattcgtataaca

SEQ ID NO: 19 - DNA, 870 bp, H. influenzae
  misc_feature (827)..(827): n is a, c, g, or t
  misc_feature (839)..(839): n is a, c, g, or t
tttgcaagtatcccttatcagcaacgtcagcttgcagcacagctcaatttgcaaggttggcaattcgttaaattggtggaatggcctgtttttcgtcagcaatgtttgcccacatttagcttgatttttatgctgtgctttaccagttttaccgttgttcttacgttaggtggtgggcctcaatatacaacattagaaacagcaatttaccaagcgattttatttgaatttgatctgccgaaagcggcactctttgctatgttgcaatttgtattttgcttgcttttatttagtttaacatctcgtttttcgccttctaatcaaaatggcttgagcaatagtaatatttggtttgtgaaacctaaaagtgcggtcaaaattttctatgtttttgttttaattgtttttgtctttttccttttttcgccagttttgaatattcttattagcgcattgagttcatcaagtttactcaaggtttggcataattctcaactttggcgtgcgttaggttattcactttctatcgcacccttgtccgcattacttgcattaacgatggcgattgccttattgcttttatcacgccgtttagaatggttacattatcagaaaatcgctcaatttattattaatgcaggaatggtaattttggcaatcccgattttagtactcgcaatggggttatttttattattacaagagcgtgatttttcgaatattgatttgtttattatcgttgtattttgcaatgcgttaagtgcaatgccttttgttttacgtattttgagcgcacctttcataataatatgcgttattacgaaatntgtggggtctcntagagtcgacctgcaggcagccaagtctggc

SEQ ID NO: 20 - DNA, 1294 bp, H. influenzae
  misc_feature (1226)..(1226): n is a, c, g, or t
aaaatcgcaacattatgaagcgtcaattgcagcttcttttttcaccaaaccaccagcctttcctaatgcaggaactggtttttcatgcttagtaatgatgttgataccttcaacaaacactttaccgtttggtaacactttagttaccttgccacgcttgcccttatctttaccagtaagaacaattacttcatcattttgacggattttagcagccattacattccccttacagtacttctggagctaaagaaatgatcttcatgaatttctcagaacgaagttcacgagtcactggtccaaaaatacgagtaccgattggttgctcagtgttattatttaaaattacacaagcgttaccatcgaaacgaataactgagccatctgggcgacgaacacccttcttggtgcgcacaacaactgcttttaatacatcacctttttttactttaccgcgtggaattgcttcttttacagtaattttgatgatgtcaccaatcgcagcataacgacggtgcgatccacctagaaccttgatacacattacgctgcgagcgcctgaattatcagcaacatccagcatagtctgttcttggatcatattagtgctccgttaagattaaaaaaacaccctttcgggacgaacccatccacactattcagatagaatggcagataggcggcggattttatcaaaagaaaaagagaaaggcaatgataatttagcttcctcttattgatctatttactaaataatccagttaaaatttaccgcacttttggaattataaaaatatcctcatcctctcaaaaatttatcgaatgaaaaataaactgcagaaaaaatgaaacgctctcttctcttaccttagataaattcatcagttttcagattttgggaaaatttccttgcctaaaagccaaagatacagatcgagctcttttaagttaaatctttctaatttataaaatctttgaaaatctatcaaaatctctttaaattttctgtaattttttaaatctttccttttaaaggctgaaaatttatctactttattaaaatagaggagatcttgctccacatagctatcataaattgggaaagcaattggattatgatgactacaatatttagttgcaaaagagtaaaaatacttctccttaccaccaattgttacttctcctaattcacgaactaattcaatatcaccagattttaaacgttnatctaagatctttataccccaaatatgctttgcaacatgatgaatagcaaatatattgtactataaac

SEQ ID NO: 21 - DNA, 994 bp, H. influenzae
agcttgctgcctgcggtcgactctaggagaccccagttccgtgattttgcaggttttcgcaccctagattccgttatccgcgccgataaaattttccaagtgaaaacatttacgattgtcagtcaaaaatttcattgcgaacgcgcgctattaattgcccaagcacataatattgatgccatttgctttgtggcaaaacagccagaattacatttttccacacaaataagagaagtttttgcccgcataaaagcggtttttgacttgatattaggtgttgagccttattttttaggggaacctcagccattgccaaacagcaccacattataaatattgttctaaatcatatttcttctatttttctaaaatcacactaatctaaacttgttaaataaacacaaactggttaaaatccaaccgataaggaaaatactgttttatgctaaagggtttactttaattgtcgttgaactcacaattgatataaaagataaaacagagaaaaaaatagtcacaaaggttaccaaggcaccgtgggtgtgaaatattcttggaaataatattccaaaaaataagggctgattttaaatatcagccctttgctttgatggtacattttattccaccacagcccaaaattcagcaacggtgtggaaagatccaaagactaaaaccacatcattttttaccgcacttttgagtgctgtacacacaccatccataacagaattatctgatgtagcttgaatatttgggaaatgacttttcaatttctctgctaattcatcgcctgactgcccgcgatagccgcctaaagttacacaatgccattcatcaataataggtgttaaatgctcaaataccccatttgcatctttgtctttgagcatcccacacacggcaatcattttaccctcgatgctacgtttaagtgcggtcatttttcagataaatatttgcaggggtaccgagtctgatattcgtataccag

SEQ ID NO: 22 - DNA, 874 bp, H. influenzae
cacttcttccgttgcatttaacttaatctccaatggagaagcgagcaaaaagtcaaaataagtatcccaaattaaatccttttgcacattaatatctttaacaaaatcaatttgctgtaaagtttctacaataagattttcgtgcttacaataaaaatgtatttttatttgagaattacaaataaaatgccccgcaaaaaatacatttggaagtgcggttagttgtgtcaaaattttaaatacacggttaattaacttatcgtattcaacttctgagggtaaacccgtttcatcatcagcctgataatcaatagtaaactgcactattttatcgagacctttaccgtgatatttttcaacatcttcaatatttgcggtaaacacggcaggcataccattcacagtagaacgataattctgccaatttgccatatccatttcgctttcctatttaaattcagcccaaatcggtgcgtgatcagacggtttttccattgctcgaatatctaatgcaatgcccacatcgacacatcgttcagctaatttttggcttatcaaaatatgatcaattcgtaaacctcgattatcatcaaaacctttagaacggtaatcaaaccacgagaatttatcatttgctggtggggtcagcttacgaaaactatcttctaatccataatcatacaaacgttgataccacgctctttcttcaggtaagaaagacatttacctgggcgtaaccacgtttacgaatttatctcccataccatatttaaatacttgggcaatattatatagcccatattaaaatggataaactgggcggtgcttttttaaaactgtgaaaatcgctaaattcttttactgaaataactca

SEQ ID NO: 23 - DNA, 704 bp, H. influenzae
tagtgctaaatggaatgtagataatgatattattccaatgtctgttgcggatatggatattccagcccctcagataatgatagatgaattagaaaaatttaatcgtttaggaatttatggttatactgaattaccagccgactattacaagataatcagtgattatattttcgaacaatatcattattctgttctctctgaaaaaattgtattttgcccaagaataatccaagccgtatctatttatatacgagcatttacaaaagaaaatgatggaatatgtattctatcaccttcatatagtccaatattaaacacgataaaattaaatgacagaaaattatatcaatgtcctttggtttatgaaaatagaaagtatcatattgattttcatttattagaggaatgttttaaacattctaaagtatttgttttaatttctcctcataatccaactggaacgatttggaataaagaagtccttattaaaattataaacttagctaaaaaacataatgtatttatcatttccgatgatgtccacgcagactttacactaacaaatgactcccactatttaatatcatcattagatgaatgggtagcaaatcactcaatgatctgtttatccccagcaaaaacttttaatattccctggattggaaatagctaaccgggtaccgaggctgatattcgtataccag

SEQ ID NO: 24 - DNA, 1188 bp, H. influenzae
  misc_feature (1180)..(1180): n is a, c, g, or t
gaaaattatcgtaatgacttatgttttaatatgaatagatctttttcctctcaaacggggcttgatgttcgttcagaaaatacagggattgttaaatagcctacagttataaatagatcaaataactatttttttaatcaaaagtgcggtactataaataaaccaacattaacgaagtccaacgaaagggaaatattatgacaatttatgcagacaattcttattctatcggaaatacgccgcttgtgcgtttaaaacactttggccataacggcaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaaattagtgcttaccgaaggtgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggtatttctcgcgcgattaaattagattttggtaaacaaatcacttctgttgccgttgagccagtggaatctccggtcattagtcaaactttagcgggtgaagaagtaaaaccaggtccacacaaaattcaaggtatcggtgcgggtttcattcccaaaaatttagatttatctattattgatcgcgtagaaactgttgatagtgataccgcacttgccacagctcgtcgcttaatggcggaagaaggcattcttgcaggtatttcatctggtgcagctgtcgcggctgcagatcgcttagctaaattaccagaatttgccgataaactcattgttgttattttgccttcagcttctgaacgctacttaagcacagcactgtttgaagggattgagggataaacaaaaaagataaggagtaccgagtccgaatncgaaaaca

SEQ ID NO: 25 - DNA, 889 bp, H. influenzae
  misc_feature (880)..(880): n is a, c, g, or t
gttaccgcccagcattccgttcccaaaccatccctaaaattgccccagcaagaagcatgatgtcaggatcggtaagttgtgagtaaaccacgatacttatcactgcgcctaattggaaaagtaagaaacttggtttgcgtccgattcggtcggcgagttgtccgaaaatccaaatgccagccatcatgccgcagacggtaacggcggtccaaagcccagatttagttaaactgaatccaagttgttttgataagaaattaggtaaccaaatcataatgccgtaataaccgaagttttgtacaggaagtgagtacgacgataccaagactaattttgctcgtggctttgtctttaatcagaagctggaatgaacgtaatttatcagtaaagctggattgcgttgaaagtgcggtttgttttttagtgaaaatttcaggttcgtgcagatgagaacgtaagaaccaagcgacaaatgcagggaagatacccactaagaacattccacgccagccaatatgcgggagcaataatggtgtaagcaacgcagcacctaacacaccaacttgccaacccaatgcaacataagatgctgctttcgctcggtggcgtgcaggccatgcttctgctgctagagccatcccaattccaaattcaccgcctaagccaataccagcaattgtgcgataaatcagtaaatcccaataaccttgtgcaatcgcacataaaccagtaaacaccgcaaaaagaagaatagtccaagtcagtacgcgtacacgaccgtatttatcgcttaatgcaccaaataaaatgccgccaaatacggcaccaatcagagtccaagttacgagagatccacctgggcgggtgttagatttaagtntgcggaaat

SEQ ID NO: 26 - DNA, 1379 bp, H. influenzae
  misc_feature (1040)..(1040): n is a, c, g, or t
tgttttcggatatcagcctcggtactcatctacaggtgcaactggaattgccattgcctgtgcaactttcggtttagtattcggtggtatcatcggtggtcctgtcgctcgtttcttattaaatcgccaaaaacaaggcgaaaatcctgaaaatgatgaagttgatgacattcaagaagcatttgaacacccaacttataaacgtaaaattactgcacgttcattaattgaaacaattgcaatgatttcagtatgtttattaattggtcaatatttagatgtacaaacaaaaggtactgcactccaattaccaactttcgtatggtgtttattcactggtgttattgtccgcaatattttaagcaacattttccgtttccaagtagcagaatccgctattgacgtattaggtagcgtaggcttatccatctttttagcaattgctttaatgtcattaagactttgggaacttgcaggtttagcaattgatgtattaattgttcttgctattcaagtcgcatttatggctgcctttgcaatcttcattacttatcgagcaatgggtaaagattacgatgccgtcgtattaagtgctggacactgtggttttggtttaggcgcaaccccaacagcaatcgctaatatgcaagctgttaccagccgttttggaccatcacacaaagcatttttaatcgttccaatggtgggtgcattctttatcgacttaatcaacgcagcattattgaaagtctcatttgcagttgtaaatatgctcgcgtaaagtgcggttgaaattgacaatattttaaaaaatgcctttatcttaaattgataaaggcatttatttcaatataatcaattatttcagctgcaatatcaaccccacttgttttttcaatcatttctaagcctgggcttgcatttacttctaaaaccaataatccattttttgaacgaattaaatccacaccagccacatctaaaccgatggcttttgttgctctaatggctatctgtttctcgtcatcgcttagtataantttttcagtttttccaccacgatgacaattcgctcgaaactcgccatcttgtccgattcgttgcatcgttgcttcaacttgatcaccaattacaaaacacgaatattcgcattgcccgcttcttcattaaatcttgctgcaacataaatatattagtttgcttaaaagctccatattgctcaccggactttgtggcttttagctaaattaccccatttcttgggacccattagcattttaaattgcggcaaactgtattgagaatgccgcttgatttgactttaccgcccttataatgattggaacaggacaccaccttacagaagtgcaacttttcct

SEQ ID NO: 27 - DNA, 958 bp, H. influenzae
ctctttctgtttaatcgttaaattgggtaaatcctttaatcgattcaattttcttaacgtacattctagcttccgctcaagaatctgcttaatagaaagaataatcaattttctacacaatctattactacgtaaaatctgatcagaaagtgcataatattgtgaaagcacaaaccgtttattcaattcattcgttgtaaaaggttcacaacctaatttagttaattgaattgcgagaacaccctcaccgcgtaaataaagttttttattttgccaaatagcaaacattgtctcttccttgtgaaacaaaccgtaaccagtaaaaagatttttaaaggaaacatttcctactaactgatctaacaaggagcaaacgctatctatatgctcatcctttatattcatattaaacctccaatgaataattattttaaaagagtcagtagaagtacttctgatttcatttatatcatgaaatttttactacacctaaatataaatgtcagatttgtgagccagatcgtaaatttaaaatttatttttatctaaacgattggtttatatataaatatactatatttaaaactttttctgagattatttttgtatataatttaatctaattctctgttaaaaacttttattttaagccttccccatcctctttactgaaatatataccccatatttttttattaatataaatatttttcttgacctggacatcaatacagatataatcacaaaaatttgaacattcaaacaggattttaattatggcaactcaagaagaaaacaaaaagccctagcggctgcactaggggcaaatcgaaaaacaatttggtaaaggcttatttttgaattaggcgatcccaaacgttggatgagagtctatttttatggatcacttgggtacagttgcgttgggattggtgcttgccaatggctcaattgaaat

SEQ ID NO: 28 - DNA, 884 bp, H. influenzae
  misc_feature (736)..(736): n is a, c, g, or t
cggtttattcaaatcttctacgtcgccgttatacatatttccagcaccaatatactgatttgcgccttctaccaatgtttttacatattgagtaaagcgtttcggtatgtaagttttgttatcttcaaaggaataaattgaattgaaaaaagcattgaagaaataagagaaaaaggcggaacaattattccgccttaatttatttaatctatcattttaatagttatcatttttatctataatataaaaaccaagttaattactaggagataaaaatggcaaaagatgaagtagggcataattttcttgcacgtttgggtaaaacgcgtttgcgtccaggcggtaaaaaagcgacagattggttaattgctaatggcgattttagccaagataaaaaagtgttagaggttgcctgtaatatggggacgactgcaattggattggcgaaacaatttggttgtcatattgaaggtgttgatttagatgaaaatgcgttagcaaaagcacaagcaaatattgaagcaaatggcttgcaagaaaaaattcatgtacagcgtgcgaatgcgatgaagttgcctttcgaggatgaaagttttgatattgtcatcaatgaagcgatgctcacaatgttacccgtggaagcgaagaaaaagccattgcagaatattttcgagtgttaaaacccaatggtttattgcttactcacgatgttatgctggtggggaatgatcatcanactattctagaaaatatgcgcaaagccgataatgtgactgtcacgccattaacgaaagatggatggaaaagcatattccaagaaagtggcttttaaaatgttgatactttctctggggaggagacattactttcttcaaaggaaagac

SEQ ID NO: 29 - DNA, 871 bp, H. influenzae
  misc_feature (638)..(638): n is a, c, g, or t
acatttatcagtattgtatttggttcatattgattaagtgtaataaaccacgtttgcttttcaatccctttagccaattttgctacctgtaaaataagcaagacatctttatgcaatacggatataagttcttgcagatttttctgcaaaagtgcggtgaaattttcaggtaaattcaagcttagtatttgtttactaaaaaacaaccctatagattgacaagattctataagttgcgcccaatcagtttggctatcaacctgaatagtatttttttcatcaaaaccttgctggtttgccacttgacaaagtgtatcctcagtttcactaagtaataaaggatcttgcccttgcaagagataaactctagccaagctttgcgcaagatgatgatttagttgctctggaaaaatgcggttcattatttcctttttatttgattttgtaacgcaattatttttacgattaattgacgcgctacttgctcgcgcatatcattccaaattacctctcgttcttctgatttggctaatgctgcacgtgcattatcaaagaaagtacggtttactttcgcattgattggatagctttcgccattagcaaggcggaaagtggcttctacttccaacattaaaagnttttctgcctcacgtccgtgcttaaaaatagacgcaacttgatctgaagtaatctggttattaataccgaaaatgggaatattttgttctaattggcgacattaacctgatttcctgcaatttggacgcatataacagaaaaccattatagaagtatcctttcaaggctaatgtcgcctttatttggcaagaaccggatgtgaaaaagccaccccaacaaaagaattcctata

SEQ ID NO: 30 - DNA, 1343 bp, H. influenzae
  misc_feature (1069)..(1069): n is a, c, g, or t
gatatccccaatattgtactgattgggtaatctatctaaaagatacataaagaataataagaagatagtaaaagaatttttcaatgagtatattccattattagatattactgaaagtgatggaacttatttactttggataaactataaaaagctaagtataaatgaaaatgaattagcttattggattaataatttatcaagagtaaaagtatctttggggagtgaatttggcaaagagggagatggtttctttcgtatgaatgtcgctatgcctagaaaaaaattattagaagcattgaatcgaatcaaaaatgggttttgtttattaaacaatagggagatttaatatgaaaaccactcatcgcacaagaatgccaacaacattagaagctttttcaccaatcattgtgatgctattactgttagggcttgggtatgctttatttgatttgccagcagagccattaatgattatttcaacggtatttgctggttttttagttattaaattaggtcattgctatttagatattttagacgccatttcagaaaaaatagctaaaacaatgcctgcgctattaattttaattactgtaggattattaattggaacttggattagtggaggaacaattcctatgatgatctactacggactaaaagcaatatcaccagaatatctttatgtgacagccttattccttactgctattgtttccatttgtactggaacctcttgggggtcagcagggactgtcggtgtggcatttatgggagttgcgattggattagacgccaatttggctgctacggcaggtgctgtggtcgctggtgcgtattttggagataaattatcgccattatctgatacaaccaatattgcatccgcagctgctggcgtagatttatatgagcatatagttcacttactttatacaacattaccatcttttattctttcggctactgtctatgtggtatatggtttaaactacgatttttctaatgtagcgactccagaaaaagtaaatacaatgattcatgagttagagcaagtttatcattntaactttctattacttattccagtcgctattgtattatgggggatctattactaagaaaccgactattccagtgatgttattatcagcatttatcgcaattattaatgctatcttaattcaaaattctctctatctgatgtgattataagcgcaggtaatggaattgatacctcaatgattcaccatacttcagttagctctgaattaagccgtttggtgaatccggggggaaagaactcatggatgggaacactataaatgggttctgggcat

SEQ ID NO: 31 - DNA, 1080 bp, H. influenzae
ttaaacaagtttgtatagttttcaatagtaattgggaatgcataagagttgctaccatctcgagtcagaaaacttacggcaagtaccaataagtttggaatcagcacaaagaagattagccaactgaagataatcgcaacagtaattttctggaatttattattgattatcttcatcgttgagtacaacctccccagccttcgtgccatgtgatacctacgcgttgtcctatgctatgatccatatgtggatcatcttcattaaagaattcacttacaaggacacgcattccgttatgatcaaactctaccgttgattctaatgtcattcctttataagtgcggtcaataatatgaccgataattgctttagaatgttcattttcatctaattcttcaatcacaatatcttcagggcgaaggagtacttgaagtttttgatctttttccacaggcatatccgtataaatatcacaaatacgaccttcaacatttgccagtacaacttgttctgattttcgttcaatcacagtggcttcaaatacgttaatttcgccaatgaaacgagcaacgaataagttagctggatcttcatagatttcacgtggagaaccatcctgtgcgattttacctttacgcaataatacaatacgatcagacattgtaatcgcttcttcttgatcgtgggtgacaaaaataaaggtaatgccaagctgacgttgtaacattttgagttcttgttgcatttgtttacgcaatttgtaatccattgcagataaagactcatcaagtaacaacactttttggtttatttactacggcacgagcgatagcaatacgttgttggttgtccgccaaaaagttgagttgttttaccaccggcattttttgtagtggaccattacccaggcttctaaacacgcgggttaattccctgttcggtacttttgccaacccacaccgaaggccggtgttcaaaatggtccatggcgaaatacccctactttcgaataccgctaaacaagccgtactcccctggccacctggcgtattttcccacttcatatcgttccccttcctc

SEQ ID NO: 32 - DNA, 893 bp, H. influenzae
ggaattcggactcggtacccgcagaagaaaatgaaacgctatgcaatttcttatcacttcgacggcaaaaggtgggcgacagatgtttacgcccattcattcgaagaagcggaagaaaagctaaaagcaatgtcccaaggtactgttgacggcgagattcacctttcagtttacattcctgaaaatccgctatcgaaagtatcaaggttgattacaagaatagctaaaaagtttatgtaagtcagtgactttcatcacaaattttaaacaatttggttaaagaaactcactcggcggaagcgcagacggaagcccaacggtgctaagcggtcgttagattgaaagccctaacctacttagttaagagtgagttttaaagtctgcccatgcaaagccaatgaaaaacggtgcagttgccgaaagtggagctcaagcaggcgaatatcccaatgtggatatttcaaaacacatttgctagtacagagacacaacggcatgtgaaaccgttgcgaatgatagatgaagtgtgttttgaaatggcagacataaaacaaacgaggttcaaatatggaagaaaaacaagaaaaaagcctatctgataaagataaaaatctaatcaaacaggctgtattagaaagtgctgataaaaatacaaatttaacaccaagtgaattagctgagagtgtatgttcggcagtgatgtttattgattcttatgggcgttaaaatatctgaactgggaatgctatcatcaatagattcttgcaatcttgatgataatgttgaaaacaaattgtcaatatcttcggccacatactcattaacttctcgcaaaaattgaaagtttgtttttaaatatctcttggcctatacagaagctttttatctgctga

SEQ ID NO: 33 - DNA, 1690 bp, H. influenzae
  misc_feature (559)..(559): n is a, c, g, or t
  misc_feature (727)..(727): n is a, c, g, or t
  misc_feature (1640)..(1640): n is a, c, g, or t
gattcggctcgtaccctctacaaaataatcctgttacattattctcctaataagattctaaaagtctctcgatcatatatatctgcttctgtatccaaatcattttcatcataaaactctgtgatgccaatctcctcttcttgataaggaagatcatgtattaatatatacttcattgtatcagataaatgacaccaccaatcccaatcttcattagaaatattcccagtagtatctgtatcattgataagttcttctgggaatttatcctctgctaattttgacgtttctttacgggtatcaacgccgttgatgaaattaattaatctatgtcccaaataacgagtattccactcatcagaatattcaaaaccaagatcttcagaaatttctcttaagtaccattattaaaaatatttttttcagtatttgtttaggtgttatgtcaataacacctaaaagaaaaagtgcggttaaaattcattgaattttaaccgcactttaaaaacaaaaaagccaatagatttacactattggcttttattttattactctttgntattaattaagcaataactgctttctcaacaacacgaactaaagtccaagatttggtttttgatagagggcgacattcgcgaatctctacggtatcaccaactttggcttcattgttctcatcgtgtacgtgtaatttagttgtacgacggataaatttaccatatanaggggtgttttacccttacgttccaatagcaacaacgaaagaattttccatttttggcgctaacaactttaccttgtacgctacgaattttatcagtcattactcacccgccttttcggttaatacagtttttacacgtgcaatatcacgacgcacttgcttagcctgatgggtttgttgaagctgaccggtggctgtctgcatacgcaacttgaattgttcacctaaaaggtttactaattcagcattcagctcttcaacactttttgtacgtaattcttgagctttcattacatcaccgtcttagttacgaaagtggtcttaactggcaatttatcagctgctaatgcaaatgcgtttcttgctacttcttcagacacaccatccatttcataaagcactttacccggttggattaatgctacccagtactcaacgttacctttacctttacccatacggacttctaatggttcttcagtaattggtttatttgggaatacactaatccacattttaccttgtcttttttactgcacgtgacattgcacgacgttccgcttcgatccttctagcgtttaaaccacaacgaccttttgtttttatactctatgtttttttcctacctatattacccgtttgttttaccaccggctggggtgtttttgttaatttttatgcatttttcgtactccctgtttcgcttttcttcacgggtttccccgtctcctactaccctctttttctcttgtgcacttcttcttagtttccttgctaactgttgttctattttatttgtcgcatgcttcattttctttctcgcccatagcgcaccctcgtggttttctctctaatatttacattttattccccgccccgccctcggcgtttttttgtttcgcgtctttaatcngcctgcccgcgcaaccatttgttttcttgattttcttcttttctccctcg

SEQ ID NO: 34 - DNA, 1132 bp, H. influenzae
tggatcgattcggctggtaccccaccataacacatttttatctttaaattcagctttaatggtattcaatttgcgacgaacagaactaatacgctgtgcttgacctggcataataaaggtacgaccaacatagcgatttttcacaaatccttgtcgataaggcttccctagaacacgagctatttgtaacgcaatatctgtggaggtttcaggaataggaatgaccacatcaatattatcaatttcatccgcccattcttttgcaatttttttcccgagtttttcccccatatgaacacgtgccgcataaacagagacaccatcaatcgttgaatctgggcgtgcaaaataaacatactcaaaaatacaaggatttaacaccgcactttcggtacattgttgtgaataaagctcgccatcaaatgtcacataaacggcttcgcccgcagcaatatcacgcacaaactcgaaacccacaatatctaaagctactgtttcagaggcgaacatataatcagttttgccattttcttcacgtttacccaacaccaaaggacgaataccaaaaggatctctaaatgcaaccattccgtgtccaataatcatcgctacgcaggcataagcaccacgaatatcattgtgagttttacgaacagcatagaaaatatcttgtggatcaagatggttttgaggaatgtgatcaagatgattagcgagaatattaagaagaagttcagaatctgaattagtgtttacgtgacggcgggcagttttaaagactttttcttttaactccactgagttggttaaattgccggtatgcaccaaagtgacaccataggggagaatttacataaaaggttgtgcctctgagacgctagaacttcctgccgtaagatagcgaaaatgcccttatccagcattttcttgcaagcggaacatatgctctttgacggaacataatgctgactaagccattaactttacgtaagcggaaacgtgtttcataatcaatcgttacaataccctgcccgattttgtccaagaggttgccaaaagagtaatgctgcaataaaaaattattaacccggcatttggtaaaaaaacgcatataccccacattttgggttct

SEQ ID NO: 35 - DNA, 390 bp, H. influenzae
ttctgttaccgaattcggactcgtaccccgggaatccttttgcactagaattatttagagcatcttcagtaatttttatgttggtatcccaaatttctttaaaatctacttcttgagttcttaaccatggaatagtaccgttgtcataatagccattatttgatgttgtaggcgttccgcctgaagaaattttctttgagatttcatcaattgttttccactcaaacccaaccttcccaagttcttcttcacttaacaatttttcccgatagtattcatactgcttctgacgtagtataagctcgctggtaagctcgctggtaagtgctgtcaatgcgtccaaaatttttacgatttctgtttggacggagagtggggggatggggattg

SEQ ID NO: 36 - DNA, 870 bp, H. influenzae
  misc_feature (720)..(720): n is a, c, g, or t
acccaaggtgcatttgtacaatgttggcaagattgacgaaagaactcgtattcttgatttggaaattccccataaggttcactacgtagaatctctaagcgagaaacgccttctggcacttggtttacatcacgacatgagtccatacaggctgtacaaccgatacacgcattttcatcatgtatcattgcgtaacgtttaggtttatccgccttgtcttcttttgcaaaagaaggtaaagatgttcccgtcataaggatcactgcccccatgccagaaacaaagtttcggcgtgagcagactgtcattgtttatccttttgtttggttagtttatcttgttcagctttacgtttttgttgtttaccatggcaatctacgcaaagtttaacgcgttgttttggttgaatacctttcattgcgtcttctttagggtgaagcgtatggcaacttgcgcaaggcaatttcattgcgtgtacatcatgagcccataatttttcacgaagtttgtcaggttgatggcaagcaaaacaaacttggttttgttcttgaactgaatacatcggttttttattaccgaaaatatctccttcaaaacgcataacatctttagcaccgcgacgatgattttcggaaacattgccgtgacagcttacacaagtaatagctttaccgttatttggatttttcttatctaaatgtgcaccatggaatttaccanagtggagttcgccaccagaccgatctagcgtttggtttttatctattttgtcgaatttatggcatttagcacaatattgattaggatcgcgttggttatctaattgcggttcataagtaacatgatccgcagggtttgggcatatccgcc

SEQ ID NO: 37 - DNA, 890 bp, H. influenzae
  misc_feature (145)..(145): n is a, c, g, or t
gcccagacttggctggcctggcaggtcgactctaggaggaccccttcccaaagaaggtcctgtactttgggttgatacacttgcaattcctgtaacagctaaaaatcctgaaggcgcacacaagctgattaactacatgttaggngaaaaaaacagctgaaaaattaaccttagctatcggttacccaacctcaaatattgaagcgaaaaaagcattaccaaaagaaatcactgaagatccagcgatttatccgtcagctgatatattaaaaaatagtcactggcaagatgacgttggcgatgcaattcaattctatgaacaatattatcaagaattaaaagcagcaaaataattggtcaattagcaaagaattaaaatctgattctgtgcaatatttcctctaaataaaaacgccctttcgggcgttattttttaagctttaccgtcagccaaatttttcttttcttctaattcttcccagcgtaaaaatgctgtttctaattcggcttcagtatctgccaatgcttttaatttagcgtcggtaatatcgtgagcttgttggaaaaatgctggatcggctatttcagcttgaagtacggtgattttagtttccaactcttccaatagttgtggaagttgttctagttctcgttgttctttataagaaagtttcacggatttcggctttagaagtgcggtcatttttcaccgcactttcttcttttagtggttcagatttcttcgccttagcctgttcttccaccgctttgcttgcccaaaaattggcttgttgctgtttcgcatcaaagaatcctcccacatacttattcaaagccccttcacctttgaataataacatttggcgcaggattatcgataaatgaccgga

SEQ ID NO: 38 - DNA, 1065 bp, H. influenzae
  misc_feature (836)..(836): n is a, c, g, or t
  misc_feature (911)..(911): n is a, c, g, or t
  misc_feature (952)..(952): n is a, c, g, or t
  misc_feature (1015)..(1015): n is a, c, g, or t
  misc_feature (1022)..(1022): n is a, c, g, or t
  misc_feature (1030)..(1030): n is a, c, g, or t
tgttatacgaatatcggactcggtaccccttatattcttctttaaatcttcctcatttcttgtgctttttttaccatatcttctgaaccaacaaaaagtggaacacgttcatgaagtgcggttggttcgatatctaaaattcgacgataaccatctgttgcgacaccgccagcttgctccgctaaaaatgcaataggattgccttcatataataaacggagttttccatttggatagttggttgcacttggataaatataaatgccgccttttaataagttgcggtggaagtctgctacaagtgaaccaatatagcgagatacgtaagggcgatgagtcgctttatcttcttcttggcaatatttaatatattttttcacaccttgtgggaatttcaggtattgtccttcattgatggaataaattttgccctcttttggcatttgcatattttcgtgggaaagacagaatgtaccgatagacggatcataagtgaaaccattcacaccgtgaccagtggtataaaccaacattgttgatgaaccataaacaatataacccgaggcaacttgtttattacctggttgcataaaatcttctaaggtaacaggtgagccaataggggatacacgacggtaaatggagaaaattgtaccgacggatacgtttacatcaatatttgaagagccatcaaggggatccgttaaaataatatattttgcattacgaccacgttccgtatcaaatgcgataaaactttcctcttcttcagatgcaaacccagccacttcttcacgtgccattatggccgctttcatcgtgttatggggcgaaanaatcgagtttattttgactttcgccttgtacattttcataccagattgaccgagaatatttgtaacctggcttgntatatctcgatgaattatttcgctaaagacgatgacgacanatacactcattcccttagcattttggggatctggttggcgtcaacgaaatcaccttaaggttncatattncctttagntttctaaacatgatataaagggggggggggggggg

SEQ ID NO: 39 - DNA, 934 bp, H. influenzae
  misc_feature (828)..(828): n is a, c, g, or t
  misc_feature (850)..(850): n is a, c, g, or t
  misc_feature (886)..(888): n is a, c, g, or t
  misc_feature (897)..(897): n is a, c, g, or t
tgtatacgaatcggactcgtaccccggcttagatataaccacatgatcggaataaatccagctaagccaatcactgcagctaaaataagccaccagctcattcctgctaaaaacacgacaaataaacctgacgcactgaccaaaattgctgtgcctaaatcaggctgaatcgccacaagcaatgttggcagtagaatcattgcaatcgctataaatgtttcacttaatttaggtggaagcggacgattacctaaatacaccgccaccattaatggcacagcaagttttacaatttcagagggttgaaaacgaataaatcccagatcaagccaacgctgcgcacctttacttgtcgtgccaatagcatctactaagatcaacaacacaaaaccaattaaataaagataaggtgcgatgcgttggtaaaatcttggtggaaattgagccattaacaacataacaataaatccaagtaaaacctgaataattcggttattaaacatcatttcactggcacctgatgcactatataacaccagcataccataagccgttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgcgctaacggtgcggcattacttgaaccaccacctgcattttctaaatcactgtcacaccaatctagggttttcataaggcgcantatgcgtaaaccatgcgtgatncatgcattctttttttcaatcccaccgcattggatnnnttcattttncttttaaactaaacacttgagcagtacccagatttcc

SEQ ID NO: 40 - DNA, 1244 bp, H. influenzae
  misc_feature (1098)..(1098): n is a, c, g, or t
  misc_feature (1111)..(1111): n is a, c, g, or t
  misc_feature (1120)..(1121): n is a, c, g, or t
  misc_feature (1123)..(1123): n is a, c, g, or t
ctggtatacgaatatcggactcggtaccctattgggggtgttgataaccttaaagcacccgtccttttgtgaatgttccgattatcggaattgtaaaacgtgatttgcctgatagtcccgtgcgtattacgccgtttttacaagatattgaagatctagccaatgcaggtgcggatattattgcagtagatggcacgagccgcccacgtcctgtggatattgaaagtgcggtgaaaaaaatccacgaaatgggctgtttggcaatggcagattgttctaatttagaagaaggcttgtattgtaaagcgcttggttttgatattgtcggcagtacgatgtcgggttatacaggtggcgcagtgccagaagaaccagattatcaattagtgaaagatttaaaatcagcgggttgttttgtgatggctgaggggcgttataacacaccagaattggcaaaagtggcaattgaaattggtgcagattgcgtgactgtaggttcagccttaactcgtcttgaacatattgtgagttggtttgctaattcagtgaaatctgcaagatagtcgtaagacgtgtgagaaaagactttacactataaggataagttatgcgttgtttagcactagatattggtgggacaaaaattgcagcggcgattgtaaaaaatggcgaaattgagcaacgtcagcaaattcatacaccacgtgaaaatgtcgtggagggaatgcaccaagcgttaggcaaattgcttgctgattatgaagggcagtttgattatgtagcggtagcatctacggggattatcaataatggtattttaagtgcattaaatccgaaaaacttaggtggcttggcggaatttccacttaaagcgagtattgcaaaacatacggataaaccgattggtttattaaatgatgcacaagctgcgacttatgcggaatatcaattgcaaaattttgaacaggtatcaaatttttgtttttattaccgtttcaacaggagttggcggaggggattgtgctgaaccaaattttgcagacagggttctcgtggtattgcagggcatattggtcatacattagctgatccaatggntgcgatctgtggntggtggcgnncnaaggttggtgtcaaagcgattgcttcagggcgagcattggaaacagtttcttccatggggaagacccggcgatcccaaagaatgtttgagcggttaaaaaaaatgatgaaaaacgaccgcc

SEQ ID NO: 41 - DNA, 958 bp, H. influenzae
  misc_feature (729)..(729): n is a, c, g, or t
  misc_feature (769)..(769): n is a, c, g, or t
ctgtatacgaatcggactcggtacccgtcattgcaatgcccctttcatcattgccatcaagctatcgcgcgccttatcagccttcgctttatcgtaaaaacttggctttgctggaatcatcttcggaatatcctcaaaaggaaaattcgaccgcactttttccgccgcttctgtgagtaatttcggaatagctttcaacgtgtcctcttccgattttttcttgcacttttcgtacagatttttaagcaaccaaaattccacttttgaacgatattgaaattcatcccgattgaatcgggcatagcctaagaaagtgttataacgttggtataattccgcttcgttcggtaaacctagtgcgtgatagtcgtaggctttgcaccaataaacgaacaaccctacgctaggtaaaaatttatcaagcgatttttccgcttcacaaatcccgttctccaactgaggtctcgtaattttttctcgtaccaacacacgcaaccaagtttttttagcagagagataatccgctttcggtttcaaaggctgcacgccaaccaggaaaaattgatttaagctcgttaaagagccagttaatcgtctcttccgcacgctgtgctcgttctggtgggagcgtgtaatttgggttttgtggtattggaatattgcattgcgtaccgtccactgtgaaattcattcctgcaaccagcctgtctgcgtatcgcaatttgggtntttggggggggggaaatggcccaaatgcgggaaattgggncccaggttttcatcacgccatccatgatgcgtaaaatcctgccggttgcgtcaatgcaaatctccacgctcacaatcgaaatccccgcttgccgcttgtttgcaagcggtgaaatgccttggttaatacccttttgcgttggcggggcgataaatcttcccagttgtcgtatacgactgtcagccattt

SEQ ID NO: 42 - DNA, 197 bp, H. influenzae
ctacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaag

SEQ ID NO: 43 - DNA, 944 bp, H. influenzae
agaagatatatgaatgaagagcaaattcttcatttcagaaaaatcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaattcattctattgaaaaatacaaaagtgcggttaaaattagccgcacttttttgcatttaaaaatgcaggaaaatccacttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattctaaacgagttgagcgttctaatagccaaatgccaaaagcgcgagcaaaaaaatcggaacaaacacgtcgctatgataaaaatgtgattaaagcggctcaatttgatatttctccgagtgattttagccgtaatgctctcaatgtagtggaaaaactgcaacgtcaaggtttcgaggcttatatcgttcggtggatgtatccgtgatttattgctcggtaaaaaaccaaagattttgatgttgcaacaaatgctcgcccagagcaaatccaaacatttttcaacgccatgtcggttagtgggtcgccgttttccgctagcacatataaggtttgtccgagaataatggaagccga

SEQ ID NO: 44 - DNA, 865 bp, H. influenzae
gagcttaattaggtggtggttaagggcattctacccctaaatttaatatggatatccgccgatatgtaaaatggtttgatggctttcccaaatcttattgcgcttattggattgcgaaaagtgatcatgaagaaacaaaagattattttcaacgttaaaaattaatcattatgatcaagatgaagtgataaaatagtgaaataaaaggtgctgttcagcaaattctgtgaaacaacacctttatttttctattttttaatcagcactataatataattttccgatttcaattttttgacgacccgtctcttctcgccatttattactatcacgtaaagaatacacacaaccgcaatattcctgttgataaaaccgctcacgcttactaatttcaatcatacgctgtgaaccaccttccttgcgccagttataatcccaataaactacatcatcatatttttccgcagctcgatgcccacagccattgatttgattcatatccttccagcgagaaattcccaagcaactagtaaatacagggaaaccatgttcatgagcatattcagcagctttttcaaagcgcatatcaaaacacattgtgcagcgaatacctctctcaggctcccattccatacccttagcacgatcaaaccaattttgacgatcgtaatcagcatcaataaatggaataccaaatttttttgcaaaacggatattttcttctttacgaatcaaatattctttgagtggatgaatgtttggattgtaaaaataaatcgtaaattcaatgcctgatgcaagaattgcttccatcacttcgccagagcaaggcgcacaacaagaatgcaaaaggagcttattgtgt

SEQ ID NO: 45 - DNA, 905 bp, H. influenzae
accccgtacacgttgaaccatattttcgctgtacgcaccataaccttcttcaggttgtacacgtacttcaaatttgtcgccaacttctttaccttcaagtgctttttcaagaccgactactaaattattgtgaccttgtaaatattctagtggttgatttgctggagcttcatctaccaatacgccatcttgtgtgcgaacttggtaagaaatgctcaccactacatttttttctactttcattatgttttccttataaaaatcggttaaaaagccgtatcattgtaacgaaaattattccacgcgcaagactttacggattaatgaacacgaggctcttcttcatcttcatcatcaaaaaattccccatcgtcaccgtattcatcgtcatcggcatttgggtcttcaaaataggtgccccaaccatcataaatgcctttatgtttttctaacaatggaaggatttgtttttgttgtgcatcgataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcgatgtgatgctcaataatgtaaagcgcatttggatcactgccatcattaagtaaatcttcgataatttcacgggtttctgcttgtaattcagcccattttgacataataaaatcctttcacagaacaaaagtgcggttattttagtggataaatcaccaaaagtcgcatagaatttcgcacaattattttcctaaaaaagaaccttaaccatgctcgaacactcccttatttgcataaaaactcgcaaaaccacgacttttaggctg

SEQ ID NO: 46 - DNA, 907 bp, H. influenzae
  misc_feature (658)..(658): n is a, c, g, or t
  misc_feature (784)..(784): n is a, c, g, or t
  misc_feature (791)..(791): n is a, c, g, or t
  misc_feature (825)..(825): n is a, c, g, or t
gtacactccacacgtagatactggtgattacatcatcgttatcaacgcagacaaagtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtgctgaacaccaacacgctgcacaacaaccacaagtattagatatttaatcacgaggtttagaaaatggcagagaatcaaaactacggcacaggccgccgcaaaagctcttcagctcgtgtatttatcaaaccgggcagtggtaaaatcactatcaatcaacgtgaattagatgtttactttggtcgcgaaacagcacgtatggtagtacgtcagccattagagttggttgaattaactgataaattagacctatacatcactgttaaaggtggtggtatttctggtcaagcgggtgcaatccgtcacggtatcactcgtgcattgatggaatacgatgaaacattacgcccagcacttcgtgcagctggtttcgttactcgggacgcacgtcgcgttgaacgtanaaaagtggggttacacaaagcacgtcgtcgtccacatactcaaaacgttaattttattttcgtttccaaagaaagcagagagaatctctgctttttattatttgagtactctacttattgatatanaacatanaaagatatggtggcaaatagtaatgctttatggnaaaagttgccccttaaaactaaatattttggatcttcgaggataaaggccacccatcagaacgtcagaatgaccctttttaa

SEQ ID NO: 47 - DNA, 1007 bp, H. influenzae
aaaccaactatttacagaataaacacctgaaactttttcacgtagaattaagcgtaatttttcttgcacaatatcagcaagaatattgaataagtatttttgttccgctcgccaagtattatctgcggtaaggtatatttctacatcagctctcggttctttcaaaccattcataataaatgattgagttggtgtatgaataatagtagggacaaagtgacgtatctgagtttttgattcaacagaagctaaataacgttctgccaatttctttacttgattaagctcaatatcgccaataataaaataggtaaaatctgttttatttaaaatataacgttgataagcgttacttaattggtttttatcaaatgctaattgctgtgcttgtttttgagtatagacagtttcaatatttggaaaacgcagttttgaaacggcttgcataaattgtgtttctaaatcaatctgtttgaaataatcacgggtttcacgtcgatatttttctaaggcaagatcggatataggcgaagaacgtaattttaagcggaacaatgtcagtaaattttccaaatctttagggttagatacaccagtaaaaccttgtttatcatcatcaatcacagttgcaattaccaatggatcacgcgaaaaaatttgattaaccgcagaaagagaaagttctccaacacctggtttcatcaactacactaacggcagcacgcaataagtgatagtcccttttctgggataaaacgcaaacccacctttgggtaacagccccgaaaatgtccctggatttggaggtttggcactataggggggaaatcattttacttcctttctttaaagaaatttttaatattcgccccgattcccgtatttttctttggaaatatgacccgggtaaaatgttataggcggaattttcccatttgtgttttttttcacatggggttgtggatttctattgtgtgtcccacatttttttctttatatcaaaggag

SEQ ID NO: 48 - DNA, 749 bp, H. influenzae
agcagcttgctgcctgcagtcgactctaaaggaccccactacaaaaatgggtagcgatgtggcaataaagtcataatttcttttgattcgatcactcttggttgttgttctgacacgttgataccttacaaaaaataaacaaataaaatctgtcggattatacgatatttatagctaaaaataaaacgtactcaatatgctccgtgtttaggacgaatatcaatggctggatcgtcatctttacgatatttttcatcaattcgtttttgcaatccaaagtcatttttatccgattcgttagaaaataaatcttctgtttgcgttaattgaggattttgaattcctatccaatttgcaatcccttctaagaaatttaaacctgatttaaacaccttatattctttgcgttccatatcatctgatgaaattttgaatagcggaatattatggtgctctcggctgaaacagttttgattgaacaaaagtatattgtttttttcatcttgttggtggcacaaaccgtgatctgagaaataaatcattgagaaagtgcggtgatttttcttcgcattttcttcaagctgatcatatacacgttttaaaaattcatcggttttcttaatagacgacacatagcaatttaaataaccatatttcggattaagatctttatcatcaaaaatttttggataatcttcgatacgatcgcaagccattgggtgtgaaccataaatatgcaacacaataaa

SEQ ID NO: 49 - DNA, 664 bp, H. influenzae
tggtttcggatatcagactcggtactttacctgttggtttttctctttgctctgctaattctaatgatgctttaatacgagcttgttttttcgatttttcacgaatagcaactacatcatttacagaaacttggaaagatggaatattaacaacacgaccattcacaacaattgctttatgactcactaattgacgagcctctgcacgagttgcagcaaatcccatgcgataaacaacgttatccaatctaccttctaataacactaataaattttcaccagtgttacctttcaaacggtttgcttctttatagtagttacggaattgacgttctaaaataccatagatacgacgaactttttgtttttcacgtaactgactaccatagtcagacaaacgcggtttacgagcaccgtgctgacctggtgctgtatcaattttacattttgaatcaatcgcacgcacgcctgatttaaggaataaatcagtgccttcacgacggctgagcttgagtttaggacccaaatatcttgccattttctttctccaactatcctatacgtcttaaacacgacgttttttcggtggacgacaaccgttatgaggaatcggagtcacatcagtaatattcgtgatacggaaacccgctgcgtttaacgcacg

SEQ ID NO: 50 - DNA, 986 bp, H. influenzae
attaggtgcagattcattagacacagttgaattagtaatggctttagaagaagaatttgatattgaaattcctgatgaagaagctgaaaaaattaccactgttcaatctgcgattgattacgtgcaaaacaatcaataattttaagttgggcgacgttttaagtcgcctaatttttttctaataatcctctttaaaattaccgcactttttatttttccctttcataaacattgatctaaattatcttttacttaaaatcttggtttaaattttaaaaaattatttagttatatgcctaaaaagaagtattatttgcatagtttttcatttttgaggtgtttatgctttacttagaatttttatttttactattaatgctttatatcggtagccgttacggcggtatcggattaggtgttgtttctggtatcggtcttgctatcgaggttttcgtatttcgtatgccagtggggaaagcaccgattgatgttatgcttatcattcttgcggtggtgacttgcgcatccgtacttgaagcagctggcggtttgaaatttatgttacaaattgctgaacgcattctccgtaaaaatccaaaacgtgtcactttactcggcccattagtcgtctatttattaacctttatgcttggtactggtcactctgtttacacaattatgccaatcatcggcgatgttgcattgaaaaacaaaattcgtccagaacgtccaatggcagcgtcttcggtagcatcgcaattagccatcacatcaagcccactttctgcagctggtgtattttatctaggtaaaaatacagcaatgcccgcttttgagcatattagtttattagatattatttgtgtaaccgtttctgctactttagcgggtacgaatgcgcctttcttatacagtaatgcgcgggggaaaagaagtagcacaagatcctcgatattcacgttgtttaccagatccactattgccga

SEQ ID NO: 51 - DNA, 974 bp, H. influenzae
  misc_feature (775)..(775): n is a, c, g, or t
  misc_feature (813)..(813): n is a, c, g, or t
  misc_feature (866)..(866): n is a, c, g, or t
ctgttaccgaaatcggactcggtacccaggattcagctggtgttgcagtaatcaataaacaaaatgaattacaacgtattcgttgtttaggcaaagttaaagctttagatgaagccgtatcagaaaaaccattaattggtggaacgggaattgcacatactcgctgggcaactcacggcgaaccatcagaaactaatgcgcatccgcattcatcaggtacttttgctgtagtacataacggtattattgaaaatcacgaagaacttcgcgaattattaaaatctcgtggttatgtctttttatcacaaacagatactgaagtgatcgctcacctcgttgaatgggaaatgcgtagcacggattcccttttagaggctgtgcagaaatcggtaaaacaactcacgggcgcatatggtatggtggtaatggacagccgtcatcctgaacatttagtggcagctcgttctgggtagtccacttgtgattggcttaggtatcgggtgaaaatttcttagcttcagatcaacttgcgcttttaagtgttactcgccgttttatctttttagaagaaggagatattgcagatattacacgtcgtacagttgatatttatgatactcacggtaataaggctaaacgtgaaattcacgagtctaatcttgaaaatgacgctgcagagaaaggaaaaatccgccattttatgcagaaagaaatttacgaacagccaactgcacttattaatacaatggaaggggcgtattaatcacgaaatggngaatggtgattcaatcggaatggggcaaaagcatttanaaaaaagtgagcatatcaaattgtgcttgtggacatctataatgcagtatgtngcgcgttatgggtttgaaacttaactgcgggagctgggagttgaaatgcatcaaatttcgtatcgcaattggtacccggccaaaagctaatgatacccttctcattgg

SEQ ID NO: 52 - DNA, 925 bp, H. influenzae
  misc_feature (705)..(705): n is a, c, g, or t
  misc_feature (826)..(826): n is a, c, g, or t
aaaagttcaatcatagatagtaacaaccataaggaatacaaattatgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactggtgcaggagaatgttatccacaaaaatcagcatggcgttcaggttggtgcaaatatgatgcaaacacattattgcagtattgcttatggncgtacaattatagagaagatattgttgacccagattagggtaaaaacaacaagtaaacgggcgctttcactttaggctatcgttaaggattaagcttattagggcctaaatagggcttgcnaaactaaaactttaagataaccgaaaaagcctttcgaattccaggtttcaatgaattagggaaaactatgttttggcactcaaatgaaccgatctgaat

SEQ ID NO: 53 - DNA, 1156 bp, H. influenzae
  misc_feature (609)..(609): n is a, c, g, or t
  misc_feature (926)..(926): n is a, c, g, or t
tgtatacgatatcgactcggtaccctttcaaaaacgctctaaaattgaccgcactttaaatataataatcaagctcaagtggtatttttgcttgtaacaagaactgtttagtgcgctcgtgttgtgggcaagtgaagaatttatctgccgtattttgttctacaatatatccatccgccattaaaatcacacgatccgcgacatctttcgcaaactgcatttcgtgagtaacaataatcattgtccagccttcttgggcgagcatttttagtgtttgtaacacttcgcccaccaattcaggatctaatgccgatgtaggttcatctaataaaataatatcaggttttaccgcaagggctcgagcaatccccactcgctgttgctgaccgccagaaagttgggatggaaataaatccgctttatttttaagccctactttttctagcaaactaagtgctttttcacgagcttgagctttatcttgtttttgcacaacaaccattccctccataacattttcaagggcagaacgatgagggaataaattgtattgctgaaagaccattgatgaacgtcggcgtaacttcaattcatctgctttactaattntctggctaaaatcaatttttagactgccatcagtaaattccaaaatgccttgctctggtcgttcaagcaagtttaaacaacgtaaaaaggtgggttttttccagaacccagagggcctaaaattgcgaccacttcacctttattaatttcaaaatcaatgccttttaacacatgattgccattaaagtttttctgaatattacttacttttaacatagacattcctttataatggcgagataagcgaatttcaagacgatctttgtagaatagataaacaaacagaaatatccataaatcaagctgcctcactatanattaaataaattcatagtcgctgccgtatattctgtgcgacacggatatttctgtcctaaacaggagagctatggagtggcttcactggactataaaagatagaagcgagggcctgaatacgaaagcctgggcataatgaccaaaatgctggcgatattctactatcgctaagagcttccactgctttagttagcataattgagcccaacagttctgtgctaaccctatt

SEQ ID NO: 54 - DNA, 1520 bp, H. influenzae
cttaaatcgccatttgcagatttaataaaaaattaaagtctcttggaatttttcctcctaaaaacgaaaaaatggaaacccttctatgggattccattcatcgttaaaagtcttaaagcctaaatttgtgtcagtcacttacggcgcaaatcgggagaacgtgaccgcactcacggcattgtgaaagccattaaacaagaaacgggcttagaagccgcaccacatttaactggaattgatgccacacctgaagaattaaaacaaattgcgagagattattgggatagtggtattcgccgtattgttgcgttacgcggtgacgaacctaaaggttacgcgaaaaaaccattttatgcgtcagatcttgtggaattactccgttctgtcgctgattttgatatttctgtagccgcttatcctgaagttcatccagaagcaaaatccgcacaagcagacttaattaatttaaaacgtaaaattgattcaggtgcaaaccacgtcattatacaatttttctttgatattgaaaactacctacgttttcgtgatcgttgtgcatcaattggtattgatactgaaatcgtacccggtattttacctgttactaattttaaacaactccaaaaaatggcatcattcactaatgtgaaaattccagcgtggttagttaaagcctatgatggtttggatgatgatccaactacacgtaatcttgtagcagcaagtgttgcaatggatatggtaaaaattttatctcgcgaaggcgtgaatgacttccacttttatacattaaatcgtagtgaattaacttatgctatctgtcatatgttaggtgtaagaccttaattatcacaataatatatttcttttcaaacacaaaataagggcgatatttcgcccttatacaaaactaaaaaaattcaaccgcactttattattttatgaactctgtttgcatatacattaatcgatctatattcgttaaataatgccctaattcttgctcttcggctttatgtaaataaggaattttacctaaaactggcgcattaatatgttcaaccagtaaatcaacaatttctgcataatggcttaataatgcattaattcgacttgtattcaacctaataacggcccacccaacctgttggataacctttattgtcaataaagcgtgatttacacaagcatctttaattcccactctaagtattactggcttattcggctatatattctacctgattaccttttttcttctgccatttgggttataaacacaaatatttttccccccccctaatgctttttctggtttatttgtgtcttttctattatttttccttttttactgtcgattcatttccccgcgcccgcgagcttttttggtcatacgttattatctttcccccgaccagacaaatctcattattgttgagtactcgcatcagctcacatattctctccctatgacccgcttattcattttgctcttcggccttcggttaatatttcgatgt

SEQ ID NO: 55 - DNA, 983 bp, H. influenzae
  misc_feature (941)..(941): n is a, c, g, or t
ttatcgattcggctcggtaccctatcagtaaattacaatatttccgttttcaatccacgcagtaacataatataaaaaaacaggattatccgagcgtatcggcgcagaagtggtttttttacttgctaatactgtattttttcgagtttctgtccaacctgcttcttttaataaaatacttgccaattgatcagatttttcaacacgcacacaaccagaacttaacgctcgatttttacgattaaacaatccgcgatttggcgtatcgtgtaaataaattgcatcagaacttggcatattaaatttataattacctaacgcactatcgccagccgcttgtcgaactcgataaggaaatttattaccaatagattcccaatcaatagaagcaggatcaacaacattgccttgattatctaaaattgaataattatgctccgtaatataatttggatcggctttcatttttggcaataaatcttcattaattaagcgaattggcgcattccaaggtggatttacaaccacattacttaatttgctatacattacaggtgtcctgcgcgaatctgtgccaacaattacccgagattctaaaattaaatcgccatcacgataatactgtaatttatagcttggaatattcacaaaaattccattatgaaaatcaggaatcacacgtaaacgctgtgcattcattgccaatttttgagcaatatttgattctttagaagtcggaataaacatcggcaatgattgaactgtttggcgatataaatgattttctcccgctaaactttgtatgaaatcaagaaagtgattattttccaccgcacttaaccagcgttgaatatgatcattttcaggctgttgggcttgatactgacagatgaatacaaccaattagatgctttgagaacgacattttgggggaattaagnatctaacaaaatcccttataaccctcataaccatccgcctgt

SEQ ID NO: 56 - DNA, 1104 bp, H. influenzae
  misc_feature (779)..(780): n is a, c, g, or t
  misc_feature (809)..(809): n is a, c, g, or t
  misc_feature (823)..(823): n is a, c, g, or t
  misc_feature (846)..(846): n is a, c, g, or t
  misc_feature (923)..(923): n is a, c, g, or t
  misc_feature (945)..(945): n is a, c, g, or t
  misc_feature (951)..(951): n is a, c, g, or t
ctgtatacgatatcgactcggtacccaggaagtgcctttttgttgttcaactaattgagctagaacagtcgcatcaataccaggaaccggaatgaatgaaccaattcgataaacgataagtgcacctaaaacgaaaagtaatcggctttttaattcacctttaccgctattagtacttcttgcttgataacctggttgtttagccatttgctaattattcctcaattgaaccgccagcagcttcaattgctgcttttgcacctttagttacacgtaaaccgcgtaccgttactgcagatttcacttctccagctaaaattactttagcgaattggatatctttagttaagatatttgctgcttttaatgtttctaaagttactacattaccttcaactttggttaattcatttaaacgaacttctgcagtcactgcagatttcattgaagtaaaaccaaattttggtaaacgacggtataacggcatttgaccaccttcgaaaccgcgacgaacaccgctaccagtacgagatttttgacctttatgaccgcggccaccagtcttgcctaaacctgaaccaataccacgaccgaggcgtttagcactatgctttgcaccttcagccggagatagagtatttaaacgcatctcttactcctccactttaaccatgtatgaaacttggttaatcataccacgtactgcaggcgtatcaattaactcaacagtgtggtgcatatggcgaagaccaagaccacgcaaggtagctttatgcttnncgtaacgagcaattgagctacgaacttgngttactttaatagntttagccattattcattaccccncagatttcatcaacagtttacccgcgttttgcagcaaccatttctggggatttcatatttgctaatgcatccatagntgcacgaaccacgttaatcggngttggntagacccatacgctttaaaagggaacgttacgtacacctggcactttcaataccgacgcattgcacaacagcggagatacctggccttcacttgctggctgataaaacacgcgaacagattgaccccttaaatggaggggaagggacctcatt

SEQ ID NO: 57 - DNA, 1075 bp, H. influenzae
aggcctccggttactccatgtaacttgaatgataggcactggtattaaactcggttttatgaagtatattgtgatcataatgtgtgtcaagtgcgtctgaacatagaattatctccactgagtagacaaacatggtaaagtccactgatattaccttgacctttttggctaaaaataccttcaaaattgaccgctctttttcccgcattaaaagctttttctccctctttgatcattgtggtgtaatagtgatcgctaccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacccagcgatgctaaaatcgatggatcccaattaccgctagtaaggttctgtattattgatgctccttgcattgcgcgattctgcaggaattgattcatttcttcctccccgccctttttccatcccttcccttctatgcattttctggaccacctttcccccgtttgccctttttttccggccccccctttttctcgctgctttccttagccttgtgcgatgtttccttttttcttttttccgtcgtccccctgtttgttctccctttttcccctttttgtcccgtcctccgttttcccccgccccgccgtccctttcctttttacattctccccccctttttgccccccgttatatctttggccgttagttgccgccgcccccgtttttctcctttttcccccccgcctcttttcccccccctttttcccccgccctccttgtccttgttctccgtccc

SEQ ID NO: 58 - DNA, 962 bp, H. influenzae
tgtttacgattcggactcggtaccctttctccaactgatttcaagttgattttgacatctttaattgttaaatattcccacaccaaattgagaatattttgatacgttttggtttcaacgctaagctcgttcatttgacagaacaatttaaaatttggtgccatacgttcacataaagcagccataaaagtaagatgttgccaactgtctaagttttctaagcgtttatgaatcggatttcgcatcttatttccttaattcgtaagagttggaatatttattaatcgcatttatgttccgctttacaaagttcaagcgtcacatgaattaatttgcgagcgatagtacccgttggcggtaattctggcaagggttgatcataagaaaaccattgtgcatcatgaatttcactttcctgcaatgttatttctccgctttcataatcagccagaaaaccgaccatttgagaatttggaaatgcccaaggttggctaccgaaataacgaagattttttattgaaatccctgtttcttcaaaaacctctctctgcaccgcttgttcaaatgtttcccctacttcgacaaaacctgcaagcgtcgtgtatattcctccgttaggactataatgtcgcttatgatttgccaatagattttcgtgaccacgacgaaccgcaacaatatttgatgggcaaatcacaggataagtttgatacccccagtgattacattgcactgcaagtcatcttgagtttggtggggtttatgaccggacttccacaaaattattggggttttacgaaaggataatttcccaacctcggtttatatatggaattcatcctctggcggggaaaccaggttcccaactcccaatttcggtgataaatttttgttaacccagccacaagggtgatttgtctttctcatttgcatgcccgtgcccttcaatcgatttttacaac

SEQ ID NO: 59 - DNA, 919 bp, H. influenzae
  misc_feature (623)..(623): n is a, c, g, or t
cgatatcggctcggtacccagtggaagtattaccgattatcgtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcggttggtttaattgcattaattaatgggtattttaagtggcgtaggcgggatgggttcggctatggcgacttaaccttacatctatctttggntttaattttaaaccattagcatacttaattcggtgtaactgatggtgctgaagcaggtattgcaggacaaatgatcgggatgaaattacgggtatggatttggggggtatcttggaattgcaaaaatttacaccagatctgcattgtataactgaaaaacaagcgatatacttcgccttttggggtttgctacttcactcatgcatctaattggggggttgagggggatgccccaaccgccaaggatgtggtccttaaggtacaagccgctatggctgaacttcgctactaatgag

SEQ ID NO: 60 - DNA, 885 bp, H. influenzae
aacttgtttaaagcgggtgctaaagggtacatatgtgttcctgtcagacaattattggcaaaaggcggtattcttaatttttccgttgaatatggagaatcaacaaaaacgggttgatgcagccaaatatcgcaaaaaattagagtggtgttgatggcaggttttactgcgggtaatgaaaaaggcgagttggtattgctcggtcgtaatggctcagactattctgccgcctgttttagccgcttgtttaggcgcaagtgtatgcgaatttggcccgatgtgggcggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccccggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgttcttctcggcattagcgcaggcaaacattagcattgtggcgattg

SEQ ID NO: 61 - DNA, 1239 bp, H. influenzae
gtaattcgactcggtaccctttgtgagttgtgtctaataaatcgctaaaaaaatgctaaaagtgatgatatgagaggggggaatctaggatgtattgatttttcctattgtaaatattttcctacataaattacccttttaatgctaattgtgctatcgtaacctgattagatttaaacaagtccattcaaggagaatacaatgacaacacagttagattcacttcgtaatatgaccgtcgtcgtagctgatactggcgatattgatgcaatcaaaaaataccaaccacaagatgcaacaacaaacccatctttaattttaagtgcttcagcattaccacaatacgccccattaattgatgaagcggttgcttatgcaaaagctcaaagcaatgataaagcacagcaacttattgatgcagaagataaattagcggtaaatattggtttagaaattttaaaaatcgttccagggcgtatttctactgaagtggatgcgcgtctttcttacaacacacaagcaacggttgaaaaagcgcgtaaattaatcgcactttataatgcagcaggcatctcaaatgatcgtattttgattaaaatcgcttccacatggcaaggtatccgagctgcagaaatccttgaaaaagaaggcattaactgtaacttaaccttattattctctgaagctcaagctcgtgcttgtgcagaagcaggcgtttacttaatttctccatttgtaggtcgtattttagactggtacaaagcaaactccgacaaaaaagaatatgcgccagcagaagatccaggcgttatttctgtcaccaaaatctacaattactacaaagaatatggctacaatacagttgtgatgggcgcaagtttccgtaatgtaggcgaaattactgaacttgcaggttgcgatcgcttaaccattgcaccagcattactgaaagaattacaagaaaattcaaccgcacttatacgcaaactagaatacaaaggcgaagtaaaagcgaaaccacaaccattaacagaagctgagttctactggcaacataacagcgatgctatggctgttgaaaaattagcagagggtattcgtaaatttgctattgaccaagaaaaattggaaaccatgctttcagcaaaactttaatctataattcaatataaaaaataaccgcacttcaatctgcttctgaattagttaaagaaaatagggtaccgagccgatattcgt

SEQ ID NO: 62 - DNA, 902 bp, H. influenzae
  misc_feature (537)..(537): n is a, c, g, or t
attactcaaagcaaacagatttgtttatcttaaataaaaggtggaaaatcttatggcaattaaaattggtatcaatggttttggtcgtatcggccgtatcgtattccgtgcagcacaacatcgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtcactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtatacttcaacgcatacgcaggtcaagatatcgtttctaacgcatcttggacaacagactgtttagctcctttagcacgtgttgntcatgagactttcggtatgaaagatgggttaatgaccactgttcacgctgcgactgcaactgttataattgcggatggttccatcatcctaaagactggcgtggatgctcgccttgtttttccaagacatcatttaatttttaccaggtgcaggtgaagccccttggtccttttcttccttgttttaatcgtgctatgattcgggttggttccccccgctccaccgccaatcctatttgcactcctcttatcttttttcccctgccttctcttttctctattctctctccaccccccttcactccttccttaccccctccccctgcgttcttctatgcgcttctcgcctcctcccttgtcctctt

SEQ ID NO: 63 - DNA, 836 bp, H. influenzae
  misc_feature (257)..(257): n is a, c, g, or t
tccattttggcgtccggcaagttccctttttaattcacaagccatagctgattctcaaactcgtggtggtaataatactcttgaaaacaatgtgttccgtttgaaaattgatacattgggtggcgatgtaattagctctgaaatattaaaatatgatgcagaattggattcaaaaaacacccgtttgaattattaaaagatactaaagagcatatttatattgcgcaaagtggtttaattggtaaaaacggtattgnatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaata

SEQ ID NO: 64 - DNA, 1007 bp, H. influenzae
cttggttgctttccattgttttagaagaaatactttagtatccaccccacccattgtgacttcagctgtacgatagccctctgtgccatttggagtaaattcccagtgatgaataaaatccaccagattttttacccgcactttgctgatgttagcgctaacttcatcttgcacaatgccttgttcaatccaaagttcgaccaattttttcggcaataatcgaaccaagatggttttcaacatttgttttggtgaatgttgttttgcttgattaatttcctcttccacattgtggttcggtaataaatcgatttccactgactcagtgggctgccaataattagaaatttgtaacaccgcagggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagatatgagctggcgtacctctaaatggtgaaatacaaaaccaccgcccgacataaatcttacgtccgattttttgccgttgtcgaaactgttaccgatgcctagcttacca

SEQ ID NO: 65 - DNA, 858 bp, H. influenzae
atatggaatttaacaatgatggtctccaattattcaaacaaaatcaaccgcactttgtaggcaatcgcttattagtgaatggtattgaagcaccatatttagatgttgcacggggttggattcgtttacgtttgctcaatgcctcattagcgcgtgcttatgatttacgcttggataatgatcaagaaatgctacttattgcacaagatttaagtttcttacccaaagcgaaatcagtcaaatctttggttctctcgccaggagaacgcgcagaaatactggttaatatgaatgaaattgacaacgtatctctcattagcggaagtaaacgtagcttgtacgaaaaaataaaaaatatgttgttctcaggcgatgaactcgctaataacaccgtccttgaattacgtgctcaaggacaactatccgcatttaacaaacaaccgaatctaactttcgaaacggatgcaccagcaatattacaacaagccgttgcacaaactcgagaatttaatattgatgtcacaaacggtttaattaatcaaagacgttttgacccgcgcaaggttgatgttatggctcgtaaaggcaccattgaacgctggattttaaatgcaagtttacctgttggatttactattcaaggtgccaaatttgttggtggaaagccaaggagaacatcaattacaagctgaagaattagcttggaaagataccgtttgggtaaaaaacaaactcaaattttatgaaatttgatcaagcattctctggcacttcccttcttatttggggatcgaatttatgttagaagattgggctgtttggcgtatgatggttcatgacaaaatttatcttacccag

SEQ ID NO: 66 - DNA, 1141 bp, H. influenzae
  misc_feature (822)..(822): n is a, c, g, or t
  misc_feature (904)..(904): n is a, c, g, or t
  misc_feature (928)..(928): n is a, c, g, or t
  misc_feature (972)..(972): n is a, c, g, or t
  misc_feature (1024)..(1024): n is a, c, g, or t
  misc_feature (1067)..(1068): n is a, c, g, or t
  misc_feature (1070)..(1070): n is a, c, g, or t
caaaattgtaagaaaggtgaatacagtggtgctgatgtatcgcgtgaaggtgtgcaacgtgatttacttccgttagtggaaggctcgacagttagcaccaagcacggaatggttaaaactgatcatatcttatttattgcatctggtgcattccaagttgctcgtccttcagatttaatccctgaactacaagggcgtttgccgattcgtgttgaacttaccgcattaagtgcggcggatttcgagcgcattttaacagaacctcacgcctctttaaccgaacaatataaagccttgatggcaacagaaggggtgaatattgaatttacaacagaggcggttaagaaaattgctgaggctgcattccgagtgaatgaaaaaacggaaaatatcggtgcacgtcgtttacatacggtaatggaacgtttgatggataaaatttctttcagcgcaagcgatatgaatggtcaaacggtcaatattgatgcggcttatgttgcggatgcacttggcgaagtggttgaaaatgaagatttgagccgttttattctttaaagataaaaattttacatataaaagtgcggtaaatttttaccgcacttttttgttttctaaattgagaaactaattagtttttaatttactccaatatttttcataaatatcaacagcttctcctacatcgccttgcataattcctttttctacttcttccgctggtggaaataatttggatcattagcaacttccgcgcttagcaatgttttcgccccattatttggcatagaaaagcccatgcgttcgataacaatttttgcattntcagggcgaagtaaaagtcgatgaactatacgcccttccacgttttgagcggaattcggatagcatattatccatccagaanattgcgccttcttttggatcacanattgagagaattgatttccttctgcgctaaatagctgaacattncaaatatccaattgcacttcgcttgtacggaaaggacttcagagaatagagntaaagtcgctcattgggaaccgttttctaacgctatagctggnntngatgctcttaattgggggaattggcgattaccatcaagataagctacgggacacttacgccatactggaat

SEQ ID NO: 67 - DNA, 1041 bp, H. influenzae
  misc_feature (829)..(829): n is a, c, g, or t
  misc_feature (945)..(945): n is a, c, g, or t
ggtatacgaattcggactcggtacccagctattctccaccaacagaaatatcaataagaaataagcaaatttccctttttttaataaaaaattctatggattataacaaattaatctaaggcatttttcgtaaatgatcgccatcatttttgtgtaatttcataagcgaccaaacaagggcgattacaaaaagtgatgaagttaaaaaagtatagctgaatgcctgttgtaagcaatcacttgcgttaaagaaatgtcgataaagatttaagattattgatgacacagcaataccaaatccaatcccaacttgctgtacaatacttaatacggtagagcctgtgccagactgttgttttgaaagatcgcctacagccagcgtattaattgaagtaaaaatgatcgacatacaagccccataccacataagattacaaataatccaagttagagagctttgtttatctaaccaagccattgaaatcacagaacctgccatcaaaagtgcggatgaaattaacgtggttttataaccccaacgatttaaaattcgtccaattaatattttcaacatcacagaaattaacgcaatcggtgctaatagccagccagacatttcagcactgtaaccgaaagataattggaacatcaaaggcaataaaaagggcacaccagatgcagataatcggataaaaatattagcaataatacctaatctgaatgtacgagttcggaaaagggataaaggtaaaatggcattttcattgtttttagcatagccacaataagttacgagtaacagaataccaacaactaatatgctataagntacacttgaattatgctgactttctccgagtaaatccaaaccaaagcgtataccaactaaccccatgcaaagagtaaaaacctgtccatctaattctctgcctgcccttgatatgntcacacgctgccgatgcaaaattctagccaccatgggatatttataaaaaatcatgcaactgcgtgatgactacatcactaatagccctagatgcc

SEQ ID NO: 68 - DNA, 978 bp, H. influenzae
ctgtatacgatatcgactcggtacccggcctgttttgctatgtaatcaacgacaaattgttgatcgccactcataattacgacatcaatattttgctgttgtaagcgttgaatggcgtgcaagctatcgttttttaaagtatccgtcagtgcatatgcaccgatgggttcatcatttatggatactgcgacaatgctcgcaatttgccaaatatcctctaaatttttaggcaagattaaaccgcaataatcaggtttaccgacttttattgttcccacttgttctaattcggcttgaatgccttgacccacttccatctttgaaaaaagtgcggtgggaatttctaacattttttgttctgctgcttgcacaatagcttttgcaattgggtggttagcttgtcgttcaactgctgctgcaaaacgatacaaatcgtcttcagaatacaccgcactttgtggctgccataaagcagagatttcaagctctccttttgttaatgtgccagttttatcaagtacaacggtatccacgtgggcggtttcctccattgcagccgcatctttaaaccatacgccagcattgactgctttacctaaaccaaccattatggctgctggtgtggctaatcccaaggcacaagggcaagcaatcacaagcacggataccgcgtgaattagtgaagacacactatcattcgtcagaatatagtgagtgcgaaagtacaagtgaatcactaaaacgacaggaacaaacacggaagcaactttgtcagcaatcgagcaatgggtgcttttgaaccttgtgcatctgatatgcatcatcatatcgccagtaaggtttgctccaagctgatttgcttgatagatatagaacttctgtacatcgcccccgctatacttttcactctttgttttctctgacgagatcgcccgtaaggctgcatcaccatccattcccttcatatgcggttgcgag

SEQ ID NO: 69 - DNA, 1297 bp, H. influenzae
atatcgccatcacggttttactgaacaagatctcaacgaaactttcaatataaatcattacgtttataaacgcgataccattaaacttggcgaattagctcaaatgttgaaagaaacatattgtggctcaattggcttggagtttatgcacgtgcaggatatggagcagaaaatgtggctccagagcaagatggaaagcctgttagataaaccgctttttacatctgaagaacgtgtcaattttcttcgtgaactgacagctgcagacggtttagaacgttatcttggtgcgaaattccctggggcgaaacgcttttctttagaaggaagtgatgcgtttattccattgatgaaagaaattattcgccattctagtcgtcaaggggtaaatgatgtggtaatgggaatggcacaccgtgggcgtttgaatatgctcgtgaatgtattaggtaaaaagcctgaaaatttattcgatgaatttgcaggtaaacattccagcgaacgtacgggggatgtgaaatatcatcaaggtttttcttctgattttgccgtagatgataagagagtccacttaacgttggcatttaatccatctcatttggaaatcgtaagccctgttgtgattggttctgttcgatctcgacaaactcgtatgaatgatacagaacatagcaaagtgcttgctattactgttcacggagattcagctgtggcaggacagggggttgttcaagaaacattgaatatgtcaaatgcccgtggttacagtgtgggcggtactattcgcatcgtgattaataaccaaattggttttacgacatctaatccgaatgacacgcgctctacagaatattgcaccgatattgcgaaaatgattcaagcaccgattattcatgttaatggcgatgatcctgaagcggtggcatttactgcgcgtatggcggtggaatatcgtaatttattcaaacgagatatttttattgatttaatttcttatcgtcgccatggccataacgaggcagatgaaccattagccactcaaccaatgatgtatagcatcatcaaaaaacatcctacaccgcgtaaagtttatgcagatcgcttagttttcagaggcgtgatgactgaagacaagtacccggatggcgaatgattatcgcgatgcgctagataatggcgatcgcgtggtatctgaatggcgagaaatggatcggccaaaatgggttgggttgcatatcccattttgatgggcctgcccgccgaaagccatattcccagacccgtttttacgctggta

SEQ ID NO: 70 - DNA, 883 bp, H. influenzae
atcccctgcggttttttattgcatccaattttagtactaaagtaacaacatacgatccccatttgataatatcaaagaataatttattttgattggttgcaatgccatcaaaattttttggtgtgccatcttcatttttttgcacttccaccataccatttttatattgacctttcacgacagccaaatcatcgtgcgcttcgttacgcaacttcaaacaagactgtttagctaaaggttcaacattgctcactttggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcggaaagttggtaatcagccccagcaaattccgctggaattgcggattgttgactatcaaacattgaacagccagacagcaatgctgccatacctaaggttgcaattaatttcacatttgatccttataaaagtgagaatgcacaaaattctagcaatatcttcacaacagataaagcagcaaatgaatttagttttcctgatctgaaaaacttccgctataacgaccgcacttttttacgtttaattaaaggaattcttatgcaaaatccaaaagatgatgtgttatatgcgcctgtttaattgttcgattcccgggaatgttttatcgatatctctttttttaaacctctgttggcttgctaaattaccattaaccccttatttcgcttggt

SEQ ID NO: 71 - DNA, 875 bp, H. influenzae
gttatacgaatatcggactcggtacccaaaaagtatagtgaaaagcagaaaatgccctaattgcggcttctctttcaaacaaaaagatctagagatgtacaaacaaagattagaagctcgacgcttacataatgaagaagtcaatcgtaaaagcacaaaactccacataatttggttttgcatctttgctatttttatcgcagtcacaagctggatggtaaattaatctatcaatgataaatttattaaggagttactattaactcaaaaagctgataaaaattataattctatttataacttacaatggcttgatgaaaatacatcgaaaaaaagatgcttctcttgaagaatggtagataaaaatgcaaaatctaatataacctcttttttcgacaaccatctttatacctgatgtgaacttatctattggtaattttgatcaattctttgaggaaagaaaaattatcttaattaagaaattaagtgatttattaagctaatttataatcatatatcaaatggtagtcattctggaatgtataaaatcttaagagaactaccacttttatctgattatcgcaagttaaaattctaactactaatttagtataaattaaaaatataatttatctttattaaaatatttttataataaatttcatctattttggtatgaaaatgtattacttaataatatttctggaaccattatctattgccgctaggagtaaattaacaaaaataccccgcatttttaccgcacttttatatcttcataaataaaaaatctgccctcaaatagctaaatatttcctttactaaatcagagcagattgaatgcggtattttttatttgaatatacattaagtta

SEQ ID NO: 72 - DNA, 913 bp, H. influenzae
atggtatacgaatatcggactcggtacccacttggtatggcatcaccaaatcgagtcattctctcttttgtattaattgcggtattgatttccgtgatgttatttaatgaaaagtgatgttaaaaatcacagaatggcttgtttatccgttagtcttaattttatttgttctttctatttacttaattcctgaatggaatagtgccgtattatatgaatttccaacaacaggtggtttcttaaccactttatggctaaccattcccgtattagtattttcatttaaccattcgccagcgacttcatcgttcacttgctcacaattccgtgaatacaaaacgtttgagggtgcagaacgccatatcagccatacagaaaaaggcgcttcaacgattttattattcttcgtaatgttcttcgtatttagctgtgtattaacactaacacctgaagaattagtggcagcaaaagaacagaatattagtatcttgtctttcttagcaaataaatttgataatccatatatctcttattttggcccgcttgttgcattcttagcgattacaagttcattcttcggtcactatatgggggcacgtgaaggattagaaggcttatatttgaaaatgaaaggcgaatctgtaaatcgtaaaaaactcaattatgcgaccgcacttttcttcttattaaccttatggggcgttgcgattattaatccaagtatcttaggcttaattgaatctcttggcgccccatcattgcgatgattttattcattatgcccatgtatgcgattcgcaaaatcccagcatgaaacgctacagcggcgtttcagtaatgtatttgtacaattatgggactacatgctatttttgcaggttgttatgggatatttataaccgctttaaatatt

SEQ ID NO: 73 - DNA, 591 bp, H. influenzae
  misc_feature (134)..(134): n is a, c, g, or t
tgctctatcaataaatcagaatatttgataattcccacgctcactggtacaaaaagtaccgccataaaacgaattagcaaacttgcgcctaaataaatccaatttaaatgaatcactcgtgttgttaaacctanaaagagcaataacaatccccaaatacttcctggaacacctgatggaatgtaataagcaataagatttccgagatataacataatagataaaatgaccaacgaacgaactaataaaaataatttttgaatcatatacaaccttttcaactattttcataatatttcaaaattattttacgcttttttttgctaacttgagccattttttcggtaaaataaccagacttagatcaaaaactttgcaaaatgataaatcgaaaaatactattggcgagtttattacttatttttaccgtactttctgcttgttctcgcgaaaaaaatacgtgtcgtgtggttaaaattagtgatggcgatacgctcacttgcctcactaaaggcaataaatccattaaagttcgtttagccgaaattgatgcgccagaaaaatctcaagccttgggcaaaaatcgaaaaa

SEQ ID NO: 74 - DNA, 898 bp, H. influenzae
tgttatcgaattcggactcggtacccggtagattttccttctccatttgcattgcctgtaatccttccaaatcgatatctttagcgataccaaaaggcaattcattattcactaaatacagattagaaccttgtgtaagcaaccaataaccaaaatcatcttgttgaagtattttcattttttctccataaaaataaccgcactttcaaaagtgcggtcattataaatcttcttttataactcactaataataagaatgttcgccacgttgatgctcagttatatcttttgcaccttttaattcattcgggaataagctaacaagttgtttttctacgccatcttttaacgtaacatccaccattgaacaaccgttacagccaccaccaaattgtaaaactgcgtaaccatcttcagtaatttcaattaaggttatacgtccaccgtgatttgcaagctgtgggttaatttgagtttgaattacatattcaacacgttcaatcaatggcgcatcatcagccaccttacgcattttggcattcggtgcttttaaggtcagttgcgcaccaagctcttcggtaacataatcaatttctgcttcttctaagaaaggcaaactcacttcatcaataaatgcagaaaaagtattatatttcatttcaatatcgctttcttccacggcattcggggggcaataagatacgccacattccgcattaggcgtacccggataacgacgaaatacgaatattcgttccttttcctgggggctaaaagtttccgaaaagcgtttggcggctcacaattaggtctgctgggcgccggttctaaacacgttttaaacccgccagaacgctttgtatcaacgcctttttgccttttctcccgccttttcttc

SEQ ID NO: 75 - DNA, 1510 bp, H. influenzae
  misc_feature (1424)..(1424): n is a, c, g, or t
cgcgtaatgggagatggttggacagtaaaaaccaaagatcgcagccattcagcacaatacgaacatcaacttgttgtcacggaaactggttgtgaagtaatgactatccgcgatgaagaaattgcagaaggtcgaatttcgcggattatggtgaatgtgtaattgacataaaattataagataagggcgtagatatacgccctttttgtttttctttataataaaacgacttcgatctaacaaaaggcaattcatatgctgttttctccgacactatcttctcctttaacgccaagtgcggtcaaaattgaacgagaaaatctcaagcaatttgagctcgagaatttttctcgttattccatttttgagcttattgaaaatcgctgtgatttttatgatgccttattgattcaactttggcaggaaatagaattaagtgaacaactggggattgctttaattgcggtgggcggttatggacggcgtgagatgtttcctttgtcggatttagattttttgattttagtcgagcaaaccccaagccctgagattgaagaaaagattactcaatttatccagtttttatgggattgcggttttgaggtgggaaatagtgttcgaaccttagaacaatgcgaatcggaagggaaacaagatattacgattgccaccaatttattagaagcaagatttcttgctggaaatcgaccgcactttgatgcattaaatgaattggtaaaacgtgcagatttttggtcgaaagaagatttttttaatgccaaagtgcaagagcaaatagaacgttatcagcgttatcacaatacggcttataaccttgagccagatattaagtacagccctggaggcttgcgtgatttgcatttgttgtattgggtggcgttgcgccattctggggctttgacccttgaggctattttacaaagtggttttatttatcctcaagaatatcagcaactacaagaaagtcgtgcatttttatttaaagtgcggttcgctttgcatttgattttgaaacgttacgataatcgtctgttgtttgatcgtcaaattaaagtcagtgaattattgggtttccgaggggaaggcaatccagctgtggaaaaaatgatgaaatgttctttccaagcattgcaccgaatttcgctgattagtaatttactgattcagcattatcgagaaaatgtgctttcatcaaatcaggatactgtaattgaccaattagacgatgattcccaactgattaaccaatgcccatgtttcgcgtaatattttttgtttttcatggaaaaaccagcgcgacgtttagattctatctttttatttaacccccgtacgaacctggccaataattatttctgagtctttgggcgcgattacctaattcccttgcaccaactataccnaatttattccaaacccctgcccgtttgcgaaaattttctccgctctttttcgaccccatgtcctttattcgggcgctcaccgcttg

SEQ ID NO: 76 - DNA, 1342 bp, H. influenzae
  misc_feature (1304)..(1304): n is a, c, g, or t
ctttatcacttatattattttcttaattttcgggctaaattatccactcttattggcttttgcggtgggtctttcagttctcgtcccctatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattattatcatttcagtattaatttttggcggtttatggggattttggggtgtattctttgccattcctttagccactttagtaaaggccgtaataaatgccttacctcaagattaaataatctttgaattttaagtactttatttaattagagatttatataaataaaaaatagttaatcgtaaattttcgattaactatttttttaatttattctaaaagtaaatcaactaaggtaattcatcaatttctttatctactttaggtgggatcatatgttcacgacgtaaaccaacatcgtatgcaatggcgatggcaacaaaaatcgaggaataagtaccaaatccaatacctacgagtaaagcaagtgaaaagttatgaatggaaggaccaccaaagaagaacaatgccatcacgacaactaatgtagtaaccgaagtaatgatagttcttgataaagtttgcgttaaagaaatatcaataatatcaatcgtatccaatcgtctaatttttcggaaattttcacgaactcggtcaaataccacaatactatcgttgatggagtaacccaccacagataaaatcgctgcgacaaaagtaagatcaatttcaatttgtaatgcagagaatacccctagcgtaataattacgtcgtgcgcaagagaagcgatactgccaaagcctaaacgccattcaaaacgtgaccccacataaataagcaccattgctaatgtcgctaaagtcgcatataccgcaccttgtgctaattcttcaccaacatttgggccaacgaactcaatactgcgaatttgaatgtctttatctacattctgtagcatacttttgacgtgttcaccaatggtagaatcattattacttgcaggtaaacgaatcatcacatcctgaaccgatcctgtggtttgaacaactggactttcaattccattttcgtgaagtttactacgaatttgttcaaggttagcggactgcgagaagtgagtatcaaataccactccaccagtaaaatctaagccccagttaaatnctttggtaataataaaaaatagagaaattaccataaaa

SEQ ID NO: 77 - DNA, 1257 bp, H. influenzae
tattcgccgtacggttctgtaaaagaggcgaaatattattggaaatgaaactcgcgtaaaagtagtggaaaaacaaattagcggcaccgttccgccaagtggatttccaaattctctatggagaaggcatttcaaaagcaggagaattattagaacttggtgtaaaacacaaacttgtagaaaaatcaggcgcatggtattcctataatggcgaaaaaattggtcaaggaaaggctaattcaatgaaatggcttaacgaaaatatagagaaatcagatgaattagaagctcgtttacgtgctgaattagtggccaatccagaacaagccttaatggcggatattgaacaatctgaaaataatactgaatcagaaagtgattttgaataaagaaaattacaaatgccaaaagtgcggttaaaaatgaccgcactttatatcgattcaataaaatgaaggaataaatccttgtcatctcttgcttttaattacatagttaatcttctttcccgcagagaatatagtgaattcgagctccgcaataaaatgcaggaaaagaacttttcggaagaagaaattgatgatgcattatctttatgccaagcaaaaaattggcaaagcgatcgtcgtttttcagaaaattatctaaattcacgctcacaaaaaggttgtggtgtaggaagaattcgacaagaattacgccaattaaaaggtgtgtcttctgatattattgatgaagttttaatggaatcagaaattgattggtatgaaatggctgagaacttgttacgtaaaaaattcccaaattataacgaacagcaaacgtctaaaatgaaacaaaaaatttggcaatatatgctatcacacggatttcgtagcgatgaatttgctgatttaattgggcaaaaccaaagtgaatgggattaagataaaagttgagaacaaattttatatatccaaatgcctaacacagtcatagctaaacatccgaataaatgcatcattaatacacaaaatccatttaaccacttgtcattaaaaaataattccacaacttcggaagaaaaagacgaaaatgtggttagcgatcctaaaaaacccgtaattaaaaataaccgccattcagaactaatttgtggaaattgccaaaaaaacccaagtaatacaccaataattaaacaaccaagcaaattagcgattaaagtcccaaaagcaaagaggaaaaaaagattaataagggaccgagccgaatcgaaca

SEQ ID NO: 78 - DNA, 994 bp, H. influenzae
  misc_feature (960)..(960): n is a, c, g, or t
gcctgcttgctgcctgcggtcgactctatgagaccccgtcatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactctcacatattcaacaggaattacttagttcggtaaaagatattgttctcggtaaaaataaaatttacaaaaaggagcaaatctgatggaaatcgaggttgtttatcaacatagcgattttattattatcaacaagtctgagggtattagcgttcataaagatcaagaagagcaaggcttaacagaacttgttgcaaaacaactgaatgtgcctaaagtatggttggttcatcgcttagataaagtaacttcaggtttgttaattctggcgttaaatgctgaaagtgcggctgaattttcacgacttttttctgaacataaaatacataaaacgtatctggcattaagtaaccaaaagcctaaaaagaaacaaggtttgattatcggggatatgaagaaatcccgagagggtgcatggaaactttgtcaaaccaaagaaaatccagcaattacacgttttgcaagtgtaagctgtgaacctaatttacgtttatttattttaaaaccacaaacggggaaaacgcatcaattacgtgttgcgatgaaaagtttaggtagcccgattttaggcgatgggctttatggtaaaaacacagaaaaaattgaccgcacttatttgcacgctactcaattggaatttgattatctaaatgattttatttcggtcacttgtttacctctcaaggtcaattttggattaagcctacagttttgagcaggggatttcntagagtcgacctgcagggcatgccaagtctgggc

SEQ ID NO: 79 - DNA, 725 bp, H. influenzae
  misc_feature (694)..(694): n is a, c, g, or t
ttccactccatttgcttgttgagcaaggtaaagtacgtgctgatttatttcatcgcttaaatgttcttactcttaatgtgccgccattacgcgaacgcatgactgatattgagccactggcacaaggttttttacaggaaatcagcgaagaattaaaaattgcaaaaccaactttcgataaagattttcttctttatttgcagaaatatgactggaaagggaatgttcgtgagctttataacaccctttatcgtgcctgctctctggtacaagataatcatttgactatcgaaagtttaaatcttgctccgccacaaagtgcagtaatttctttggatgaatttggaaataaaaccttagatgaaatcatcggttcttatgaggcacaagttctaaaattattttatgcagaatatccaagcacgagaaaattggctcaacgtttaggcgtttcccatactgcgattgcgaataaattgaaacaatatggaattggaaaataattttccgatttgaaatggaaaaagtgcggttgaaatttcctaagaattttcaaccgcacttaataaatattgattgtccattaatggtgttgtgattactctgcttgagtttccacgttttcaactgcttctgttggagtggtatgatggttattattgtgatgcgaaactgaacgagcaggcacggggtnctatagagtcgaccgcaggcagcaagctggc

SEQ ID NO: 80 - DNA, 1315 bp, H. influenzae
agaaggatccccacttaatgcaaatcgaagcattatggcgtgataactggattgcaaataaggtttgtattaaacgttcggaagatatggtgcgtaattggcgcgatattttctcgaatgacttgaaatctgaacagctagacgagttcactaagctcgagcgcagattaaaactgcgtgagacattaactaaagcgttgcaatggtctagtttgtatggggcagtgggtttattacttgtcactgacacaattaacatcacttcgccattgcagcctacagaacgattaaagcggttgattatcttacctaaatggaaaatttcacctacaggacaacgagatgatgatgtgttttcgccaaactttggtcgatatagtgaatataccattattggcggcacacaatctgttttagtgcatcattcacgtttattaattatcaatgccaatgatgcacctttatctgataatgatgtttggggtgtgtcagactttgaaaagattattgatgtacttaaacgctttgatagtgcctcagcgaatgtcggcgaccttatttttgaaagtaaaatcgatattttcaaaattgcagggttatctgacaagatttcagctgggttagaaaatgatgtggctcacgttatttcagcggtgcagtcgattaaatcagcaaccaatagtctgttgcttgatgcggaaaatgagtacgaccgaaaagaattatcttttggtgggttaaaagatttattgacagagtttcgcaatgcggtggcaggtgcggcagatatgccagtcaccattttgtttgggcaatctgtttcgggattggcaagtggagatgaggatattcaaaactaccacgaatccattcatcgattgcaagaaacaagattgcgtcctgtgcttgaagtgcttgatacattactatgcaatgaattatttggtgggcaacctgatgactggtggtttgagtttttaccattgacggtggttaaacaagaacaacaagtcaatatgcttaatacctttgctacagcggcaaatacgttaattcaaaatggcgtagtaaatgaatatcaagtagcaaacgaactgcgcgaaagtggcttgtttgccaatatctccgctgaagacattgaggaaatgaaaaatgttattgaatttgccggaaattttgaagagccacgaaacacggaagaagccccagtttcagccagtgaagatgacccggagaacggcgctttggtattgacacagctttaaccctttctcccaactgaggaccgctgatcgtataatgagccttctcccca

SEQ ID NO: 81 - DNA, 1365 bp, H. influenzae
  misc_feature (1309)..(1309): n is a, c, g, or t
tgtttacgaatatcggctcggttccccgattttctcttcaattggtttagctcagtattagttcagcctaatatcaatcataaaagtaaaacggtagatatagaaatcattctttatccacgtaaaaaaaatgcgatggaactcggtgtgggctttgctactgatggcggcgttcacggacaaataggctggacaaaaccttggattaatagccgtggacatagtttgcgttcaaatctttatctctctgcaccaaaacaaactctagaggcaacttatcgaatgccactgcttaaaaatccattaaattattactatgattttgccgtcggttgggaaggggaaaaagagaacgataccaatacgagagtgcttacgttgtcagcgttacgttattggaataatgcgcatggttggcaatattttggcggacttcgtacgcgatacgacagttttacacaagcggatatcactgataaaaccttacttctttatccaactgttggatttactcgtactcgattacgtggtggttcctttgccacttggggcgatgtgcaaaaaattacttttgatttaagcaaacgaatttggctatcagaatcttcttttataaaagtgcaagcatctagcgcgtgggttcgtacttatgcagaaaatcatcgtatcgttgctcgtgctgaaatcgggtatttacatacaaaaggtattgaaaaaattccgcctacactgcgtttctttgctggtggcgatcgtagtgtgcgcggttacggctataaaaaaattgcgcctaaaaataaaaacggaaaattagttggtggttcgcgattgcttaccgcttctttagaatatcaatatcaagtctatccaaattggtgggcggcaacttttgcagatagtggattagctgccgataattacacggcaaaagaattgcgttatggtgcaggcgttggtgtgcgttgggcatcgccagttggtgcgattaaatttgatattgccacacccattcgtgataaagataacagcaaaaatattcaattttacattggacttggtacagaaatttaaggggaatttatgacagaacacttaccaccatcagaaacttcaccaaaattacctgagaaccctaaaaacaacattgggtacccttggctgcccgtatccgcaatggccgcccatttttctgcccgctgtacggtggacaccgggccgccctcattttcgtcgcgccgcgaacttgttttgctcccctctcccgacgcaccccaaggactttctgctcgtccctcccgcgtgcctcctncacgcccttcgcccccttgtgcctcacctatccgcgcgcggccgtggccgttgcgc

SEQ ID NO: 82 - DNA, 1405 bp, H. influenzae
  misc_feature (1087)..(1087): n is a, c, g, or t
gatggtcggcttttccatggtactattaagcgaatgtgaatccaagccattggttttcccttatttcataaaatggggcgtattatcccgattttttcaaaagttccggtagtaacatcaagccaagggtggctaccataataattgttatgccaagtacggctgaaaatgacagcgtttcgccaagtaatgatacggcaaataagattccgaataatggttcaagtgcaagtaaaataccagagatattagcatcaacggtattgagtcctttatgccataaccaataagcaagccagctacaaccaagcgcaagatataataaacctacaattcccgtggaatttaatgatatttgccagttttctgtcagtaataaggtaaaaggtaatgttgttataacaccaagaacaatactgatggatgtgtaaacttgcgttgaaactttggcaacaactcgccgcgtccaacgtaatacagtcgcaaaaataatccctgcgcttagcactaataagcaacctaataaactaacattatcaatgccttcattattttttccaccattgattaaaattgcaacgccaataaatgccattgcgccgaatagccagtgaaaccattttgctttgtctttaaaaaagaaatgtccaacaaatataacaagtagcggttctagcccaatcatcgtaacggcactagacgcagaggtgtatttcagaccaataaattgtaataaaaagaccgcggtatagttaaagaatgccaaccaccaaagttgtttacgcattggtttatcgatttttttccaacgacgcaaaaaaagtggcattaccaaaatcattgcaataattaaccgcacttgcacaacaagcacaggatccatcatcgaataagtgagcttaccgacgattaatgaactgctccaaataagtagcgcgagaatttgatagagcattgatgtatccctgtgaatagttccaattctatgttttagcctagaaattgctgaaagtgagaaaattaaatatcaccttcctctaagtttagaagaaggtgacagcatattgattgacgcttaaagcgcggnagctcttaattgagttttttcgactcgacgttcgcccacattattacctactaaaacagtgatctatcctttatgtcaccgacggttctatttgatgttccccttattattctgctgcctagctgaccgcagcactatatatttttccactttcgcattccctttcccatccccccttacccttcgttttattccttcccccccttttcattttcccctctcccccgttcttcccccccctcccccccatttgttttttttacctccctattcccccgtccttttttcttgttcccccccccctttatcctccccccc

SEQ ID NO: 83 - DNA, 1431 bp, H. influenzae
  misc_feature (1229)..(1229): n is a, c, g, or t
  misc_feature (1258)..(1258): n is a, c, g, or t
  misc_feature (1263)..(1263): n is a, c, g, or t
  misc_feature (1292)..(1292): n is a, c, g, or t
  misc_feature (1411)..(1411): n is a, c, g, or t
gttttcttatatcagcctcggttctcgtatctcgggtatttcgtgtgtggtattggtaagtaaaggtaaaattagtaattatttctttggattgatttttgcctatacttatttttatgttgcttggggatcgaatttcttaggcgaaatgaacaccgtactttacgtatatttgccctctcaatttattggttactttatgtggaaagccaatatgcaaaatagcgatggtggagaaagcgtgattgcaaaagcattaactgttaaaggatggatgacattaattgttatgactacggttggcactttgctttttgttcaagcattacaagctgctggtggtagttcaacaggtttagatggtctaactacaattattacggttgcggcacagattttaatgattttacgttatcgtgaacagtggttgttatggattggattaaatattctttctattttcttatgggcagagacacctgcaatatacttaatgtattcagcctacttacttaactcgttgtatggttattataactggacgaaattagttaagcgtactaactaaatataaaaacagtaaatagcttataaaaaatccccgttaaatgataaatttaacggggatttttttacttcaaaaacatcaagttatatcataaccaaataaaaatatttcatttttttaccgcacttattgcagaaccaagaattacttcacagattttttgtgattttcataggctgcttttacaaagcctgcaaacaacggatgaccatcacgaggcgtagaagtaaattctggatggaattgacaagcgacaaaccaaggatgatttggcacttcgataatttctaccaattttttatctgcagataatccagttactttcaatcctgctttttcaatttgtggaagcaaggtattgttcacttcatagcgatgacgatgacgttcttcaatgggtttctttgccataaagctcacgagcgtggctacctgataccaaatgacattggttgtgcgcctaaacgcattgttccgccaagatctgattcatcggtacgcacttcagtattaccctccgcatcttgccattctgtgattaatgccaccacaggttgttcacaatctttatcaaattcagatgaattggctttagttaaacccgctacattacgtgcatattcatcaaatgcgatctgcatacctaagcaatacccagtanagggaatttttgttttctcggcatatggngcggnaccgaatttacctctacacacgataccanatccctggaacagatgcatcacgcctttatactcaaccctttggttcacatctggatcatatattatgctacttaaccggtgtaacccgcggtttaagctcattctgatatagctcggnacctaaggatactactccga

SEQ ID NO: 84 - DNA, 1440 bp, H. influenzae
  misc_feature (1360)..(1360): n is a, c, g, or t
tggtatacgaatatcggactcggtacccctttttttatttcttgtgtaacacaatcgcacattcaatcgaatgttgcgtcgctgccaaatgtttactcaatgcttgacgtattttgtcttcttctttcgaagtgatttcgccgtcttctaacgctgtttctaatgcagcaaataacaagcctcgtgcggaaagctcgtgcagttgtaaattagcaagctcaaccttgtctaattcattctctgctacatcaggtacaaaacgcccaccagccaaacggcatagttcatcaataaattgcgtgcagccatattcttgctgaatcgcaattaattcttcatttttgaatcgctgaccctttgtttgataaagacgattctttaattcactttcggtaaaacctaggaatccagctaccgcacttctccccccaggaatccgatcaaccatttcgataataactttcttcatttccataatttttgccttatttttatggttttctttttggtaaaggttggtaaattaatcccacaaatcaggacgtaattcggatttcttgacttttccatctgtaagttcttcaatctttgcgcaacgttccgcaggtactttttcacgccacttggaaacagcccaaggggtaagattgaaatgtcgagccatagccgaaataccgcccacgatttcataagctttttcgattggtagcattttaacctctttattctatttaaagtagtataattctactattaaaaatagaattgaatcaaccattttaattttgtatcttctacctttagtagaataaaggagtgtctatgacagatttagcaagccgacttaatgaattaatggctaaacaaggcaaaaatattgtggatttacaaaaagctgttggcgtaacctatgaaatggctagacgttacactttaggcactgcaaccccgagagataataaaattgaagctatagcgaagtactttggagttacccctgctcatttgaaatacggaacagtcgattctttagaaaatcaagtaacttctaatgtgaaagacgttggctcattcgacttatgggatcgcaatactccactaaatagcgatgaatacgccgttccgttttatcaagacattcgccttgctgctggaaacggatttgctgatgacatagcggactataacaacttcaaattgcgtttttccaaatcaacactacgtaaacaagggcgtacagtacgaaaatgcggtatgtgtgatttgctgacggaaactcgatggagcctgttattcccgatggaacacagttggcattgatcttgggtataaacaatcgagagggaaatatcgcataatnacgggggctctacgctaagctcttacatatgcaacgacaggaaaatcgagttacacgagacccctgtgaatacgatcgaa

SEQ ID NO: 85 - DNA, 1478 bp, H. influenzae
  misc_feature (1254)..(1254): n is a, c, g, or t
caggtgaagttgaaggcgtacactattattttgtatcaaaagaagagtttgaatcactcattgaacaagatttatttctagaatatgccaaagtttttggtggcaattattatggaacctctttacctgcgattgaagaaaatttagcaaaaggcattgatgtatttttagatattgattggcagggtgcccaacaaatccgtaaaaaagtgccttcagtaaaaagcatttttattttaccgccttcattgcctgaattagagcgtcgtttaattggtcgtgggcaagatagtgaagaggttattgccgaacgaatgtcaaaagcgataagtgaaatttcgcattatgacgaatatgattatgtcattgtgaatgatgattttgagaaaacattaaaagatttacaaagtattttgcaatcggaacgcttaactaaagattatcaacaaaaacaaaatgcaatgttaattcaacagctactagcaaaatagggcgaaattgagtattataacgccctttcaatagagcaatttttgacaaatcggagtaaattatggctcgtgttactgtgcaagatgcagtagaaaaaattggtaaccgttttgatttaattttaacggctgcacgtcgtgcaagacaattacaacttaatcaaagtgcaccattagtgccagaagataatgacaaaccaacagtaatcgcattacgtgaaatcgaaaaaggtttgattaatcaagatattatggatgcacaagaattccaaaaaatggcgaaagtgcaagaaacggaagaagcagctgttgcattaattacagaataatcttttaaaagtgcggtaaaaaatcacgatattttaactgcactttctctttcaacgataagtaggtctcctttggaactgtttgcggatttagatcgaattattcaagggtatttgcccgcagataaaattgaactcatcaagcgtgcgtttgtgattgcaagagatgcgcacgaaggacaatttcgctccagcggcgaaccttacattacccatcctgtggcggtagcctccattattgctcaacttcacttagatcacgaagcggtaatggctgcgcttttgcacgatgttattgaagaacaccttatacggaaaaccaactgatagaagaagttcggtgccagtgtagctgaaattgtggacggtgtatcaaaactcgataagttgaaatttcgtactcgccaagaagcacaagtcgagaattttcgcanaatgatttttggcgatgacgcgcgatattcggggtgggggtaatcaagcttgctgaccgcacgcatatatgcgcacgcttgggttcgttacgaccagataccgtcgccgtattgcgaaagaaacgcttgaaactattgtccgctgctctcgtttttaggtttggcccttcaaaatgaatagaagactttcttttcagcatgctccactgttttgagggttaaaa

SEQ ID NO: 86 - DNA, 1531 bp, H. influenzae
  misc_feature (1337)..(1337): n is a, c, g, or t
gagacccctcattgtggcggtggtgcggtacgccgtggtttgattgatgcagaattggctcaacttgccgttgataatggttgggaaggcattattgtatatggtgcagtacgccaaattcagcaattagaaaacctcgatattggtattcatgcccttgcgccaattccagtcagtgcagatgaaagcagtgctggcgagagtgatattccagtgaattttggtggcgtaacctttttcccagaagattatatttacgcagatctgacaggaattatactttcgcaagagcctctagatttagaagattaatttctacttgattaacatcttagtattttatttaagctttcctattctaaacggcgtatcatactaaaaaattaaattgtaactatatgatatataaaaccccgttcaatttgaacggggttaaaagtgcggtaaatttttaatgtgttttatggcttgtgctatacaaaattttgtccgtataagctaaagcaattgccgacactaaaaagcccaagtgcaacaataattgccacatcatcgttttttctggcatattgcttgcattcacaaaagtttgcaacatatggatagatgaaatgccgataatagacatagaaaagtttaactttcaacacggtggcatttacgtggctcatccattcaggttgatcggggtgattacgtgtacgcaatttagatacaaagatttcatagccaccgatagtcaccatcacaagtaagttggcgatcatcacgacatcaatcaaattcaacacgcctaacataattgtgttggaatccatatcatttacattaatcactaactcccataatcctttgataaatttataagagtagattgcaagggtgacaatcaagcccaaataaatcggcacttgcaaccagcgactagcaaaaattattttcgcgataatattcgattgttcgttatatttcgcataaggatcaacaggtttgttttctttcataagattttattcctaaattaaacagtgggttaaataaacaaaaaaaccgcaagaaaatagcagtttttttgaaaatagcaataaggaaattgagttattctaattttatttgaaactgtaaatagactctcttaacaccaagtcggttctacaccaaagtgaggtaattttcattaggatttttaattcgttgcaatagtgtttcaacagcgagtttgccaagttcagcttttcggttggcaaatggtggagagaggaggcgagagataacgagccaattcaatgtcatcatagcccataattgaaagatcttgcggaatacgtaagccttgntgctgaatagcttggtatgcaccgacagcaatggtgtcactacaacaaaaaactgctgtttgacgtgaaagattggagtaagtaaagattgtttgccaagtacaccggctttaaaggcaaaatggactttcacaatccatgagggatttaacgcaatttttgttttcccacagcgcatttttataaccttgcaa

SEQ ID NO: 87 - DNA, 1315 bp, H. influenzae
  misc_feature (1270)..(1270): n is a, c, g, or t
gcccagacttggctggcctgcaggtcgactctaggaaatccccttcgtattttttgaactataccaatgccctaagtggattgcggtatttcgtgcataacgtacaattcctgcgaaggctgacagcataagccccgtgccgaaagacatggctaatacagctaaaattccccagctataaagatcaagcatataagctaaaaataaaacgaaaattgcaccgctacatgggcgcatgccaattgttagaatcacgaggaattgtgattttagattggttgcttgtgcagtttgcgtggggcttggcaaatgttggtgtccacagctacaagtgtttggctgaaaagtgcggttatttttcaccgcacttttttcgtgtagagggaggggattgagggatttaatggttaatttagcttttttacgataggcacgtagaccttgccaaatccaataacagccgagaaataccaataatagcaaggcagttcgttctaaccaaagctggcttaatttgaaataacgtgatgaaagatttagcactacaacaagcaatgttgttgctgtaatcgcgacaatgccttgcattaaggatgaaagtaagctcaagatagtgctttgttttaattggctttcatgcgtggaaagatagctggcaataataaatttgccgtgtcctggcccgagggcatggagtacgccataaataaagctgacgaaaataagtgtgatgcctgccttgatgctattattttgaatttgatgtaaattttccgaaataagctgattaaactctttttgccaactggcaatatgtaagaaaaaccaaggggaaaaatagacaagtaaggcgagtgcaatcactaataacacgagcccagttttatattttttcatttctactcacattgaattattattttttgcgcgaacattacgcctaaggaatcatcttcgttcttttgggatttatcaagtgaagatgcgtaggcttggattttttcatccacattaggttcaattaattttccttggcaatttttcgaaagtgcggaaaaatctaccgcactttttgaagcgtaagtcatcgccacataataagtgggatcgtaagtttgtaagctaaatgtgtttttttctaacttttgcggatgggcgagtggcacatcaaaatataattgcagttgtaagccttgaacattaatgccgtaattttttgggcgaaggggatattttgattttattattctgggcatcatatagatagctngaaatatgctcactgacgatatttcccattacatcatcagaagtt

SEQ ID NO: 88 - DNA, 824 bp, H. influenzae
tttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgatactcgctcacatttaatgttgatgaaagctggctacaggaaggccagacgcgaattatttttgatggcgctaactcggcgtttcatctgtggtgcaacgggcgctgggtcggttacggtcacgacagtcgtttgccgtctgaatttgacctgagcgcatttttacgcgccggagaaaaccgcctcgccgtgatagtgctgcgctgtaatgacggcatatttctggaagatcaggatatgtggcggacgatcggctatttccgtgacgcatctgttgctgcctaaaccgactacacaaatcatcgatttacatgttgccactcgttttaatgatgatcccagccgcgctgtattggaggctgaatttctcatgagcggcgagttagcgtaatactctacggtaacagttttctcatggtcgtagaaacccagtcgcccgattctccctcctttttcggtttaaacataggttagtgaaggggtagcccgattttcacctccccccgtatttcgcaattccctactggtgctccccccattccgaatctttattgtgtggcgataaaatcacccccataatgatccctttaataaccgaccccgctaattgcctttccatctgcgccgttaaaaag

SEQ ID NO: 89 - DNA, 1563 bp, H. influenzae
  misc_feature (1321)..(1321): n is a, c, g, or t
  misc_feature (1347)..(1347): n is a, c, g, or t
  misc_feature (1374)..(1374): n is a, c, g, or t
  misc_feature (1423)..(1423): n is a, c, g, or t
  misc_feature (1486)..(1486): n is a, c, g, or t
  misc_feature (1513)..(1513): n is a, c, g, or t
caagtcgttgttagacacttacaagtggcacagatcagcaacccttagatttagtgaatataatcgactatcttcaaactcaattttaatttaaaaggggaaaaacatggcttattccattgaagaagaacaagagattaaccagttaaaagactggtggaaagagaatggcaaaacaattattgtcgcttttatcttaggtgtgggtggtatgtttggatggcgttattggcaatcgcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactcaaaaacaagatttttcagcagcagaagcaaatttaaaccaagcattaacccaatctcaagatgaagtattaacatctattgttgcattacgtctcagtgcagtacaatttcaattgggtcaattagacaatgctttaaccaccttaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaacctttaaaaaataatacccgcatcaaagtgcgggtattttttcaatcaaatttctgattattcaaattcatccagccattttaataaaatagcctcaagaattgattcatttgatttattcggatcgtcatcaaaatcttcaagttcacaaatccatttatgtaaatcagtaaaacgaactgtttttggatctaaatctggattacgatcgtaaagttcttctgcaattaattgggcgtctgtccatttcattagtgagccgcctcatttgcgtgattaaggttatattttggaatttctaccacaagatcttcatttcccacgacgcattgacaagataaacggctatccatttctaatccccaagccttatctagcatatcttcttcttgatcactcgtttcatttaaagaatcaaacccctcacgaacaatcacgtggcaagttgtacaagcacaagaaccatcacaagcgtgatgaatttctactcccgcattgtgagcaacttctaataagttatctcctgttgcagcatcaacgaccataccttcaggacaaaaatcttcattaggtaaaaaaatcacttttggcataatactttcctcanaattatttaatatctgactgcagttntacggattttcaatgtctgacagattnttacctgtcaaagctttattaattgatgcattcattcggcgagcagcanattcttgggtagcagtgtctaaggctttaattccttgcgcattgcatcgcgatctgaccctgntttactccattaatggtttacacagtntcatatgatgaatcatctggctaagcattcgcccctctgttgagtgcaaa

SEQ ID NO: 90 - DNA, 1502 bp, H. influenzae
  misc_feature (1172)..(1172): n is a, c, g, or t
  misc_feature (1200)..(1201): n is a, c, g, or t
  misc_feature (1215)..(1215): n is a, c, g, or t
  misc_feature (1223)..(1223): n is a, c, g, or t
  misc_feature (1225)..(1225): n is a, c, g, or t
  misc_feature (1292)..(1292): n is a, c, g, or t
attgtcgatttccgtggcgacttcatctaaagcgatttcatagcctgcttgccaatccactttacgttggtgtgcagcatcgagttgatagtagtaatcatcggaaggtttcattgtttactccaagtgcggttaatttcggcttgcttttgtgcggtgtaagcctgcagttctttttctgctgccagtgtaagattaggcggtaaacatacaccgttttcatatatgccccctttcagttcacatcgggtttcttgttggatttgttggcttaattcgttatcgtgccaatcggtggggtgggcattggcgtgtaggctaatcccacccacaatcatggcaataatcaaggcggcgagaaaatagcagattctgtttagccatttttcactgcctttcataaagtgcgtgaagctttgtttttcttggcgtaatggggttttcgagtgtttcatttggggctccttgttagatattaagcattttttcttttgcgattttgcagctgtcttttttgatttcaaagccataggacgggcggttaagctctcgtgcggcgcgtagcgtggatgcactgccagcaactggatcaatcactacatcgccctcatcggtaaagatttcgatgaggcgttttaacacggcaatgggcttttgtgtcgggtgcagtttagggatttccttgcggttgtccttttcccattcgaaccagtttttaatcattttgccgttgttgttaaatttcggcagtttatcgcggtataaaatcaaggcatattctgttgcgccgacgactttcatattcgctttgagcacctgtggtgatgatgatttaataaacaccaaagggatgtgatttttaaagccgtgctgcttggcgtaatcaatcaccattgagatttgctggaaagcgcagaacacaatcatacaaggggctttgccgcgttctttcggttctttgatgagcatttttgaacaaaaatgcataaattcggcaatgcggaaatctttatctgtatcaaaaaaactactgttggctttgtcgctttcgccgtttttgttatcgccgtttacataccattcagggtttgaagcgtaagcattattaccgagattgtagggaatgtcggcgatgactagctgcgcttttgggatgtggtagcgtttgtagntttggaagtgattgtttaataatccggnnttcatttttggtgnttttttantngttttcacaaattccggcttttttcgtttctccttattacccacactattttcctgccgtctccctngctctctttttttctttttttttcgccctatctcaccttttttgttcgttgtgcgccgcagccttctcactcccccaccaaatcgcgtttttttttctcctcttttgctcctcccccgcccttctttttctcttctccttatcctaccccgcccttttctacttctttcttttttttccccccattcctttttcttttatttttttttat

SEQ ID NO: 91 - DNA, 1548 bp, H. influenzae
  misc_feature (509)..(509): n is a, c, g, or t
attgagaatgtgtatctcgttttgatgtggctaattctacttaaagtagatttaattgcaactaaaatttgcacaaaagtagatttattctctactttaatttgtaatccgttgatttaaaaagaaaagaattttgagaaaagttgtttgattgcctgttttttaggcaaattaggtgagggaggtgaaaagttcggtcgatttttgaggtgtttcggtgagttttaggaaaaagaaaaccgccacgaaggcggtttaggtgtcatataaatttaggagtaaagaaagtctttagtgcatctaacttataaattagtccacgcattgcagtgttccttacctcaagattatctgatacaagatgatctgtaattgcttggtttacttctcttaactccattctagggtaacgttctgaatttgataggcttttaatttccagacattttgattgcaatcttttatgaaatgcaatcataaaggtggtaatccatttcatcacttaaatntgattgtgtctttttgtggatatttaacgcttctgtaaaaacagatcgcacaaatcagataattttgagagctctccattataagctgtattttttaaaccccttgcgcctaatatatagcttataggtaacgcaaagatagaaactataagcgcggagaaagctattagatcagaaagagtcatttattatccttcaaagataaaatctcaatctctttttctacataacttttaatttcgtcaataatatcatggtcgtcatttgaaataaggtttttaacaagatttaaaacaacctctggagaaataccttttctaattgctcctccaaaagtttcttcaagaaatgaagagccatatccttctgtgtcatctaaattaagaatgatatcaggatccctttttattgctgggataagaatagaatctctaaattcctctccactagctttaccatctttaatgtaacgtggacctggatattggctgaaatcttttacataaatagtttgcattattattccttaatttcttgtagcggaatgttccactgaacaacagtaccattaatagagtatctagattctttggttaaatctggcttatctttgccattatacacatacattcctcgatttgaacgaattattagcctgcttcctggtgttttgtcaataaatgctcgaatatcacttcccccttttcctctatgtcccaatcctgttcgggtttctttaatgagggtagaggcttttatatataaacaatcttttgtcgggttccccagctgctttagtctattccaaatagtattacaggacatttgctttctgtggtttctttagggatttatggatcccggtgacccaaattcctaaacaaaaggggccaatttctcttctaaggatagcacgcaacattcccccaccagttttatagtgaaaacctccgttccttttaaatatttttgggcggacagtatgttcccacgcctttggttatttctcattggcgcttagggtaataccctttttccc

SEQ ID NO: 92 - DNA, 1248 bp, H. influenzae
attcggctcggtaccccatctgatttcaaagttttctaaacgagtaataacatctttatctacatgtttttcaaagaattgtaagtcgtctttacgctctgctaatactgcacgaaatacgtatttcaacatatcttctgcaagttttgcgttatccgctaaggttgcaaatgcaacttcaggttcaaccatccagaattcagctaagtgacgggtagtattcgagttttctgcacggaatgttgggccaaaagtataaattttgcttaatgcacaagcataggtttcgccgtttaactgacctgaaaccgttaaaaatgattctttaccgaagaaatcttggctgaaatccacttttccattttcactacgtggaagattttctaaatcaagtgtagaaacacggaacatttcacccgcaccttcagtgtctgatgcagtaattaatggggttgccacccagtagaaaccttgctcatggaagaaacggtgaattgcttgagacaagcaatgacgaacacgcgcgaccgcgccaataatattggtacgagggcgtaagtgagctacttcgcgtaaatattcgatagagtggcgttttgctgccattgggtaagtatctggatcttcaacaaaccctgtcacttccactttttctgcttgtaattcaaccgcttgtccttcagaaggtgattcaacgactttaccagttacaatcacagaacagcctgttgttaaacgtaaaatttcgctttcgtaatttttaatatcgttattaataattgcttgaattggatcaaagcaagaaccgtcataaaccgctaagaaagataagcctgctttagaatcgcgacgggtacgaacccaaccacgcacagtgacggtttcaccaatcgccactttcccttgtaatacatcaacaattgatgccactttagacatattaaacctctgtaactgaatgtaattcacataaaattgccgacagtttaccttaataaaggaaattttccataaaaatatagtgttggtgcgggctatgaacaataaaatcgccttaaaaatgagccctaaataaaatagggtaaagcctcattaatattgaatatacgcgattttatgttaaaatctcgggccaaaatcattatggctaataataggaaaaaatatgaaagttttagaaggctcagttgcagcacctaatgcaaaagttgcagtagcaattgctcgttttaacagttttattaatga

SEQ ID NO: 93 - DNA, 1547 bp, H. influenzae
tgtatcgattcggctcgtacctttttacgccttttactacgttgctttttatcaaacttaatctttccgccttatggcaggaattttatcctgaatgcacttcagtttatacaaaacaagctgttgaattatgtcctgcttgccactacacctttacgcaaaaatctatctattacgatcatcaacaaaagatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggtgcattttattttggtgcagccgtattttgcactatgctttccacctcacaatttgatagcaaattaatttggaaaatttatgacagagaaaaataattcctcctcaatagaagaaaaatatcaagaaataacagcgaacttacgtaaaacaaaacgcatttcgcctttttggctattgccttttatcgcattatgtatcggggcaattttattcttccaaattgtgaaagaacgtggtactagcattacgattacctttaccaatggttcaggtatcgttgcggataaaactcaaattcgttatcaaggattacaaattggcatagtaaaagaagttcatttcactgataacctgcaaaaagtggaagttgttgccaatatcaatcctgaagcatcaagtattttgcgtgaaaatacaaaattttggcttgtgcaaccaaatgtttctcttgctggcatttcaggattagattctctcgtgtcaggtaattacatcactcttcaaccgggtgatggcgatcgtgaagatgaatttatagcagaagaacaaggccctattgcacaagtttccgcaggagatttattgattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatgttagtggcattaacgcgaacattagcccatcaggcttaaacctaaatgtagaaagtttaaatgccgttgtacagggggcggtttcttttgactctccagctgacagcccaaaagcagatgagggtaccgagtccgatattcggtacca

SEQ ID NO: 94 - DNA, 995 bp, H. influenzae
  misc_feature (981)..(981): n is a, c, g, or t
  misc_feature (986)..(986): n is a, c, g, or t
agaatttgaattccctgtttcttggggcattgatctttcttctgaacacgaacgtttcttatcggaagaatatttcaaatcaccagttgtggtgaaaaactatccaaaagacattaaagcattctatatgcgtttaaatgatgatggaaaaactgtggcggcaatggacgtgttagctccaggaattggtgaaatcatcggtggttcacaacgtgaagaacgtttagaggtgcttgataaacgcatggaagaaatgggattaaatccagatgattattggtggtatcgcgatcttcgtaaatacggcagtgttccacattctggttttggtcttggttttgaacgtttaatcgtctatgtaactggcgttcaaaatattcgtgatgtaattccattcccacgcgcgccaagaaatgcgaatttctaattcaatttaactttaatattgaccgcacttacgccaaagtgcggttaattttttcagaattttaaggaaagtaaaatggataaaattaaacaactctttgccaacaattacagttgggcacaaagaatgaaagaagaaaattctacttacttcaaagaacttgcggatcatcaaacgccacattacctttggattggttgctctgatagccgtgtacccgctgagaaattgacgaatcttgaaccaggtgagctttttgtacatcgtaatgttgctaaccaagtaattcacacagattttaattgcctttctgttgtgcaatatgccgtcgatgtgcttaaaattgaacatattattatctgtggtcacaccaactgcgggggaattcacgctgctatggcagataaagatttagggcttatcaacaactggcttcttcatattcgtgatatttggtttaaacacggtcatcttctcggtaaacttctccagaaaaacgtgccgatatgctaactaaaattaacgtagcggaaccaggggtaccgaaggcccgnaattncggataaca

SEQ ID NO: 95 - DNA, 1632 bp, H. influenzae
  misc_feature (1236)..(1236): n is a, c, g, or t
  misc_feature (1318)..(1318): n is a, c, g, or t
agttttactgatatcagacctcggtttccttaataatttagcctgcaaacccaatgaaagttcagcaataccatcgagtaaaactgtaccctcatttgcgtattcaaaaaaaccatggtttcgctgtcgccaacttttcgaccaaacatttcactttcggcatcttcatcaggcaacccagcacaatttactgcgataaattttttatcacgacgtaaactctgataatggcaggctttcgctaacaaatcctttcctgtccccgtttcgccttgaattaacaaaggcacatcaaacatagcaaaacgtttcgcgttttctaccgcacttttcatcgcttcactttgtacaataaaacactcgaaaggtttttgtggattaaatttagaaatcgtcatattcagggaatggagataattaagatatggctatgataatttctttacaacaaagtgtaaatattattttacataaggtaaaaatgcgaccatttttgaccgcactttatatcgctaaggttttaacattttttcagcttcacgaacacgaacaaggaattgtttccgttcagctgaagtcataccactgctagtaccgggtaatttaacagtaagaggattcactgctcgaccgttaatacgaaattcataatgtaaatgcggccccgtagaaatgcccgtgttaccagaaagcgcaatacgttcgccttttttaacggtttgccctgcttttactaaggatttgctcaagtgcatataaacagtttgatattcacgcccgtgacgcaacataacataacgcccagcaccgccagcctgataagcgaccttttcaactgtaccatctgctggtgcaataactggtgtgccttgagaaacagagaaatccacgcctttatggggacgaacacgtcctgttactggatggcgacgatttggattaaaaggggaggaaactcgcgcttgtcgctgcaatggataacgagcaaaacctttgcctaaagtttccccttgctgattataataacgaccatttgccgcttgcactgcataataatttttaccaccagatgaaatacgtaacgcttcaacattaccttgacctgtaagtttatcgcctaaatattcacgagaaactataatggcaaattgagtgcctttttttagttttcgtaaactcacttgccattgtaaggcgttactaagttggctaatttgtcgcgtatcaagaccttgntctcttaaactactatttaaagaattttgaatctcgccttttaatacttcttttcgccaaatacttttcttttcaataactnggcgtttaattttccattctcgagacgttcataaatacgttcttttttttcagaaaccgcccaattaatattccaggtttcatttttatttaaaatcagaaaaatgctgacctgttttaagtggctaattcggatcaagctaatcaagggtggactgagaatcatctaacccaaataacttaacatcttttacggatcccttcgggtaccggaaacttattggacagtaattcttagggctgaacgcccgcgtctaataacatatgaggcggcttgggcggggtggggaaaaaccccgatactttgaaaaattt

SEQ ID NO: 96 - DNA, 1085 bp, H. influenzae
  misc_feature (121)..(121): n is a, c, g, or t
accgatatcggctcggtacccttttaatatgtatgtggcacgtggaatggaagatttgattatgcttgcattcgcaggaactgctatcgtattttttgcgtgttccgcttatgtattgacntacgaaaaaagatatgtcatttttatcaagcgcaatgttcgcattatttattgtgttattgcttggtatggtggcgagtttcttcttccaaattcctgcgttatcggtcgcaattagtgcattatttgtagtgttctcaacaatgaccattttgtatgaaaccagtaatattattcacggtggagaaacaaattacattcgcgcaaccgtgaacatctatgtttcaatctacaatttattcttgagtttattaagattactttctatcttttcaagtgatgaataatgattgaattttgactttatgaccccactatttagtggggttattttttggaataggcaatggaaaaacaaatttttgaacattcagttaatgtagaggaagaacactatcagcccaagcaagaattccataatatggaagcaaagctagatgaagcgttggatggagagttacttgatgctcaacttgaacaagcattgaaaccaaaatccagttttagaaaaactttattaaaatttaccgcacttttatttggcttggcgacggttgcacaatccatgcagtggatttgggatagctatcaacaacatcaatggatttatcttgcttttgctttagtcagtttgattatcattttattggggattaaagagattattggcgagtgccgacgtttagttcgtttaaaaaaacgtgagcaatggcaacaacatagtcagcagatttggttagaaagtgcggtaaaaaagggcgatgttttttccgttcataacgcacaaaaaggaaaaaatctctgtttagatattgcagattctttatgcttgggaaatgattctccagccggcatttcattggccacccccttttaattgaaagctttattgcgcggcatgaaaattgcttatttattccagtccgcctggttttgtgttttttttggttgcacaacctaaaaaa

SEQ ID NO: 97 - DNA, 930 bp, H. influenzae
  misc_feature (659)..(659): n is a, c, g, or t
  misc_feature (681)..(681): n is a, c, g, or t
  misc_feature (781)..(781): n is a, c, g, or t
  misc_feature (912)..(912): n is a, c, g, or t
ttcctacttcaaattgacgatatagtacgagagaacctttatcaatacttggtaatgtttgggtatgtaaggttattgttggcgtaagaatatcgcctgtaataccgtgttctgcattgctaatattttgataaagtggataactggttttagcttttccctgagcttgttttgttagtactcgaacaccaccttgtaaccatttttctggtgtcgcggattcaaaacgcaatccatctaatccaatgcttatatcgaaattggttgcagccacaaattgagtatcttcgtgaattaaattacggtattcagaggcaattgctgctttaaattgcacgccatttacatcaattgtttgtgaaacaatttgcccaattatcatattgttataaaacacattttgcccttcgctgacgccgtaattctctggcgcagtgagggttaaaactaacgtgttaggcgcattgagtaataattcattttctttaatcacgttaaattgatgtttagtttcgccgtctcccgcaatcacatcaaaatattcgtcacgaaagaatttttttggttctgctaaattgcctagatccatttttttattgcgtaggacaattttactatttgctttaaacaaagaggctttgttttggatcgatcaatanactgccttctaaatttcatcgntattttccaccgcacttagcttggcgagaatccctatagcattatcttgagaataaacttccgtttgcccctgcataagagcggatgatggcaggattgntacctttaatttcatccacgtttaccgctttaaattgtatagagcgtgaatgactatttcatctgctttgggctgcagctggagagtcaaagaaaccgcccctgtacacgcatttaacttctacatttagnttaagctgatggctatgg

SEQ ID NO: 98 - DNA, 1570 bp, H. influenzae
tgttttcgtattcggactcggttctcctccatcacactgcacacagccttgtagaaaatagtcgctccaagcaggatagcgagtttttttaacggggataatgtcataattaactcctttttagattaaattactattagtttgaaagtgatttattttcctgtcaagcacttgggaataaagtctgatcaaccaattcacaaagtgcattaatcacaaaaagatggttctctaagatacgactttctttggtggctgggattgatatttctagatccttatctgctaaaattccttgaatggcatcgttgttagagccagttagcacaataacattaacttctttgctgacagcatgagaaataatatttagcacgattttttctgtccccaaaggtgcaaaagcaataagtaagtcgcccgattttgcaatggcattaaattgatgacaatacaattcttcaggcggttgttcaaaaacaagtgaagaacccactgcactttctaagctcaataacacagacgggaagcttggtctaactaaatcatatcgattaagtaagtttgagacgagaaactgtgcattggcataagaacgcgacacgccacaggcgataaccttattaccgcctaataaacattgcattaccatttgtgtggcattggtaatattttcagaaagcatgctagatgctgcaatttgaatttgaatactttcgctataaatatcttttactttttgtaacattataaaaagccattaatcgagaaaattaggaatccattgaatatcttgaggtgttttgccaaaagcgattaaatcaaagcggcaattagcatcttctaagctcatattttgttttgcaagccataaatttgcggcatctaaccatttttgttgttttcgccaatctacgctttctatagcagaaccataggcggaatgacttcgttggcgaacttcaacaaagacgatagtttctttgtcattcattattagatcaagttcaccacatttgaaattttgattagccgcaataaatgttaagccttttgattctaaaaaaaggcgagcttgatgctcaaagctcgccccttgctgacgttttaaagaaaacattagtttgcaactggtacaattgcaccatcttgatattgataccaagtcatatcgcgttcaacattacagttggtatcagcacttaaaatccctgttaagccactcaagcgatagcctggcacttggcgtaattcatttaaattgattaatgagcaaccacgcatctgcacccattgcattataacgcatcaattgatatctcccccccgcggattttgctacttctgatatttgggacaatggtatcttaaaaatggaatatcactatacttgtccccgtcatctgtgcgatgaaatccgctttactggttgtcgactttgccctgggtcgaaaactgcataactcgtttaattagtgtccatttttgtgtaaacaccttccttcctgccatttcaagcggaattgctacgcctaaagtgcgggggttttgatatctatttgtgaccgaa

SEQ ID NO: 99 - DNA, 1624 bp, H. influenzae
  misc_feature (1120)..(1120): n is a, c, g, or t
  misc_feature (1213)..(1213): n is a, c, g, or t
ttaaaacaactttttgcaatcactgcaatcgcatcagctctcgttttaacaggctgtaaagaagaccaaaaaaccctgaagctgcagcagcaccgcttaaaatcaaaagttggtgtaatgtctggtcctgagcatcaagttgcagaaattgcagcaaaagtcgctaaagaaaaatacggtttagacgttcaattcgttgaattcaatgactacgcattaccaaatgaagctgtatctaaaggtgatttagatgcaaacgcaatgcaacataaaccttatttagatgaagatgcaaaagcgaaaaatttaaataacttagttatcgtgggtaatactttcgtctatccattagcgggttattctaaaaaaatcaaaaatgtgaatgaattacaagacggtgctaaagttgttgttcctaacgatccaacaaaccgtggtcgtgcattaattcttcttgaaaaacaaggtttaatcaaattaaaagatgcaaataaccttctttcaactgtattagatattgttgaaaatccgaaaaaattaaacatcactgaagtagatacttctgttgcggcacgcgcattagacgacgttgatttagctgtagtaaacaatacttatgcgggtcaagtaggcttaaatgctcaagatgacggtgtatttgtagaagataaagattcgccatatgtgaacattatcgtttctcgtaccgataacaaagacagcaaagctgttcaagatttcgtaaaatcttaccaaacagaagaagtttaccaagaagctcaaaaacactttaaagatggcgttgtaaaaggttggtaatttctaccgcactttaacccattactaaatcccttgcccagcaagggattttcttatctaagctcggaatgttttaaagaatattggtagctaaaaataattagataatacagaaatatgaaatttctttaattgattaaaaaagcaagatacttttacgcttggaaatgtttaattatagaaaagacaataattcagcgagagaatatttagattacttttagataaatttcaattaaatcaaaaattaagagtaatagcttcttttatcgacaaattaataagataatcaaagatattnttaccgcactttaccattacataaaaccaaatttcgtttttctgctcttttcaaataatttgacatgccctcaggaacatcacctgtaaacanatattccacatcacttaattcgcccagcgaacatcgcttgcgagtaatttagagtgatcggccactataggtctgacgtgaacttcaatatcgctcgtttacttgtacttcatgggatcataatccataatgaacatctgcatcatcgcactatccctaaataccgaatcttagcgaaatgagaataaaattaccggagcttcgccgatattccaccatcattctaatgatccgcccgcctaacatattcaaactttattttggcgaaaagattgacggattcagaatggcgcccatttttggatttttggggccaacaagcttggccacaccttggcggggtaccaaattataaaacgaggcccggtgggaacaacttgccttcctggcaatttttttttttaatgaaga

SEQ ID NO: 100 - DNA, 891 bp, H. influenzae
gccagcttgctgcctgcggtcgactctatgagaccccgcagcggtgctaggggaaggacgctatattgtgttagcccgtgaaatgactaaaacttgggaaacgattacagggaatacgattaaaaatttacgcgaatggcttttagaagatcccaatcgtacaaaaggcgagatggttttgattgtggaaggcaaaccaaagtctgacaataacgatgaaatttcgccgcaagcggtaaaggcacttgagttaattgcagaagaattgccacttaaaaaagcagcagctatagttgctgagttgtatggttataagaagaatgctttgtatcaatttggattagcgcatttggaaaaataacctcaaaatcaaccgcactttattaatccgattttaatctgtgctgttgtattaaacggatacaagcactcacaagatatttactttagactggaaaaaatatgttaaaccaagtttcaaatacattactgacaccaagtaatctttcaactcaaacattactcaatatttttgacattatgtcgcatcgcaatattgattatgccgatctgtattttcaacttagccaagatgaaagttgggtattagaagacggcattataaaagaagggcggttttcatattgatcgtggcgttggtgtgcgggctgtttctggtgagaaaacggggtttgcttatgcggatcaaattaatcttgcttctttgcagcaatgtgcggaagcggtaaagggaatgcgcaagtcaaacaggggaatttgatttcgctatccgcttttaaatgtggaaatcctattgctcgttatgcggcgattaatcctttggaaagtttgactaaagagaaaaaaattgagctattacatttgggttgg

SEQ ID NO: 101 - DNA, 1167 bp, H. influenzae
  misc_feature (1025)..(1025): n is a, c, g, or t
  misc_feature (1139)..(1140): n is a, c, g, or t
tggtatacgaatatcagtctcggtacccatttttttctattaatcctaacttaaaagacagaattaaagttagaaagtcagtaaaggactaagcttagtccttttagttcgtattaaataagaaatccgcctttaaatttataagtccatcacttattcatcaacaatatcagtaaattctgcacctaatacttttgctaaatcttgtggcgcaatttctacgcttagcccacgttttccgcctgaaacataaatcgtttcaaactcaagtgcggttgaatttatcacggttttcacgcgtttcttttgacctagcgggctaattcctcctacaagataacctgtacttttttgtgctgcatctttatccgccatttccacttttttcacaccgatagattttgctgctttctttaaattcagcatattggccgttgcaagcacaaaacaagcgagttttttctgatcgccattttccgccacaagtaaggttttaaaagagcggttaggatcaatgcctaatttttcggctgcctcatcaccaaaatgttgattattcggatcatgatcataagtgtgcaagataaaaggaattttttgttttttaagtaaatcaattgcgggtgtcattatttcgttcctggttttggtgtaaaataatgctgattattttacagcggagagaaaaatggacgcaaccttaaatattgcgatagcagcagaatttgaattaagtgaaaaaattgtagagcgtttagaacaaagtacgcttgaaattagcaaagtttctattgttgaaataataccttttgaagaagaacaaaatattcgttttcgcaataaaggcgttgaacaacttgcgccaaatgaagtagagtgggctgattttaattatgtcttttttgcaggaaaacttgagcaaggtgcccatattgcgcaagcagcagaagcagggctgtattggcattgatatgttagggcgttggagggcgctttcggaagggcctggtggtggttcaacgggnaatgaaacacccctacttgacaccccacaccgaacactggtagcttgcccggaccttaaggaacccccctgttttaacccctgcccccgatttccacaaaacaaactccacccnntttttcccccttttcaccccgactcct

SEQ ID NO: 102 - DNA, 1208 bp, H. influenzae
ttttgagcgtttcaaaaatcgtttcagcaagtttaagggaaattcccggtacagaggctatttcatctaaggtcgcctttttcacaccttgtaaaccgccaagatatttcagtaaagcctgacgacgtttagcgcccacaccttcaatagtttctaaaccactttgtgtaaaggctttttgacgttttttacggtgtccgcttattgcgtgattatgactttcatcacggatgtgttgaatcaaatgcaatgccaaactatcatcaggcaaatgaatttcgcggtcttgtttgctgatgatcagtacttcctgcccagctcgacgatccacaccttttgccacgccaattaagtgcggtctatttttatcccattttacttgaagatgttggaacacgttcagcgcacgatttaattgcccttttccaccatcaataaaaataatatcaggaattttatcttcttctaaatcacgctcataacgtttctgcaacgcttgttccattgctgcataatcatccccaccagtaatgccttcaatattaaaacgacgataatcagatttcagtgggccttcttgattaaagacaacacaagatgctaccgtttgatttcccatcgtgtggcttatatcgaaacactccatacgcttaatttcagggagatttaacagatcacacaacgcttgataacgctctgacattcgtgaagattgtttaagttgtacatttaaagccgctttagcattaacttgtgcgagctgtaagtatttactcttatcgccttttacactttcttgaatcgtcacttttctgcctgcttgctccgtaagaagttgctcaagctctgatttttcagctaattgacgatcgacaataatactatttgggatacttcgcccttgatgaccttgtaaataaaattgccccacaaaagtttcggtaagttccgataaatccgtattggcagggactttttgggaaataactgcgattgcctagcacttttccttgacgaataaacatcacttgtacacaggctaaaccgtgttggtaagcgatggacataatatccatatcatctaaacgttcattggatacaaattgtttttcataaccgaacgcacgcctggatttgatcgcgatacgagccgcctgttcaaaactaaattctgcttgctgctcattttccgataataatctacaccg

SEQ ID NO: 103 - DNA, 1106 bp, H. influenzae
  misc_feature (918)..(918): n is a, c, g, or t
  misc_feature (997)..(997): n is a, c, g, or t
atgtaattcctcttgtaaagggcgacaaagcaacccaaaaaatatcttggcttttagatttttcactaaacctgattgcaagtgcggtacaacagaataaaaaacgccacttgctaacgcaccaaaatcggttgaaggtacaccggctaaaaaagcaaattctgatttccacgttgcaccagcaaaagtatgtacacgcaacggcgaagcaaatactgtatcactttgagactcaaacatggaaagtggtggaatagattgctgactaaaagcaaattgatgagggttcagcgtggattccattaatgttacaacaatatcgggttttgtttcagataggttgtttgtatcagatgaaagtgcggtcattttttcaataaaattttggctattgccatcaaaatttggcactttgaaaaaaataccgcgacaagacattggtaaatttaaaaacacatcacgaccatcatcaggcaaagaatctaaccaaacttgcaccgcacttggatttttagaataatgccacatcaagctaaagctaacgataaacaataaagcaccaatgctgttacccaatacccctaaagactcgacatcattaaaaccaaaaatcgcataacctaataacgccagtagcccaataacgccaaacaacgcacctttataatgaattaaggtttcccaatttcgccaatccaccacaagaaagaaatctgaaattaacaaaggctgtttgtaataatgaatttttaaacgatgaaataacatcagcactacaaaaagcactgatgaaaaatttaaagcacgttgccattggctggaaaccataagcatgccgccaaataaaaaagtaaaaagcgtaatagcaaagaaataagtccaacgataatgggagtttacaataaaaatcactgccgncatcgtgaataaagctaagaaaatataagcgatcataaaatttccctatgatatataaacagttaaaattagatatgancatgcctgcgcacttttatcacgtaaacgtatggattgaaccggaaaagaaaaatattgggataatttgaaaataaaggggggggcgataccggtctcgaaacagtgaa

SEQ ID NO: 104 - DNA, 669 bp, H. influenzae
gccagcttgctgcctgcagtcgactctaaaaagacccctgatgaaaacaattacttactggggttaatatttatactctcctctagtacaggaaattattagtcttaattaaataaaaatatttttactcctttcttttaagaatccgctatttttcttagaataaaggcaatatttacccaccttataaggaaaactcaatgattaatagacgtcattttattcaaattggagcaactagcatcctagcgttaagtgcaaaccgttttgcgatggcaaaaggaaagagcgatgttgatttacgcattgtggcaacaacagatgttcatagcttcttgaccgattttgactattataaagatgcaccaaccgataaattcggttttactcgtgcagcaagccttattcgtcaagcacgtgctgaagtgaaaaatagtgtattagtagataacggtgacctaattcaaggtaatccaattgcagactatcaagctgcacaaggctataaagagggtaaatctaaccctgcggtcgattgtttaaatgcgatgaattatgaagtgggtacattaggtaaccacgaatttaactatggtctcaattatcttgcagatgccatcaaacaagctaaattccaaattgtgggtaccgagtcgatattcgatacca

SEQ ID NO: 105 - DNA, 728 bp, H. influenzae
tttttgattaccctttagctggaaaattacatagcgcaggtcgcttagatgtggatacgacaggtttcgtattgcttaccgatgatggacaatggtcacatcgcatcacttcgccaaaacatcattgtgaaaaaacctatttggtaacattagctgatcccgtagaagaaaattatgcagcggcttgttcggaaggtattttattacgcagagaaaaagagcccactaaaccagcaaaattagaaattttagatgattacaatgtgaatctgaccatttctgaaggtcgttatcatcaagtaaaacgtatgtttgccgcacttgggaataaagtcgttggattacatcgctggaaaattggtgatgtagtgttggatgaatccttagaagaaggcgaataccgcccattaactcaaagtgaaattgaaaagttagtaaaataatatgaatcaacaaaaatcgactttcatctttattcttaccctcggtattctctctatgctaccgccctttggcgtggatatgtatttgccgtcttttttagaaattgcgaaagatctcggcgtgagtccagaacaagtacaacacacgctcacctcttttgcttatggcatggcgtttggtcagcttttttgggggccttttggtgatagtttcggacgaaaaccgatcattttactcggtgttattgtgggtgcattaacagctttagtgcttaccgaaataaa

SEQ ID NO: 106 - DNA, 951 bp, H. influenzae
tttcaacccgaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagcttcctcctgctaccgttcgacttgcatgtgttaagcctgccgccagcgttcaatctgagccatgatcaaactcttcaattcaagttcaatcgctcaataaactacttagctataaatagaaacactacttaaaaaagtaatgatgaattttcagttaagcacctattaagacttcaaaattaaaaaatatttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcttataaagataagatggggtggctaatgggattcgaacccacgacaactggaatcacaatccagggctctaccaactgagctatagccaccattaaaagttgttattgcactgacctggcgcgctcgacaagattcgaacttgcgacctttggctccggaggccaacgctctatccaactgagctacgaacgcgttactgcgtcgtcgttgcgggggcgtataggggtcctataagtcgaccgcaggcagcaagctgcc

SEQ ID NO: 107 - DNA, 864 bp, H. influenzae
aagatgtaagcccccttccgtcgcttcgtgacaccttcccccgcagcaggggaaggaaagatttggttgctttatttttttacattatcaattcgattttttatggcgaggagcaagcctaagcctataaatgcgcctggtggcagaatgaaaagtaaaaagctactgtctgtatggtaaatatggtgcgttaaaaattttgcttgttcgccgaatagattttctatgccctcaaaaatcgtgccttgtccaataatttcacgtaatgcgccgagaatggttagactaagtgccattcctaatcccattgaaaacccatcccagatggaatggagtaagctgttttttgaggcgaatgcttctgcgcgaccgataataatacagttggtcacaattaatggaataaaaatccccagtgattgataaagcgtataagtgtaagcattcattaaaagttgaaccgctgttactgtggttgcaatgatcatcacgtagattggaatacggatttccttaggaatatattgacggaaaagggaaatgaccgtatttgtgcaagtgagtacaagcattgttgctaaacccaaaccaagcgcgttggtggctgtgctagacaccgctaaaagtggacaaagcccgagaagttggacaaccgcagggttatttttccaaattccttgagcaaaaatttctttccagatggatttttgttgattttcaaccgcactttctattttttcttcttcaaggcgggatttttttcagtccaacccgtcatattatttcccttgtgttgaaagctgccgcaccatgctttgttttttatcttgattatgctccccgctcaccttgatatcccctcca

SEQ ID NO: 108 - DNA, 1855 bp, H. influenzae
  misc_feature (1564)..(1564): n is a, c, g, or t
  misc_feature (1586)..(1586): n is a, c, g, or t
  misc_feature (1608)..(1608): n is a, c, g, or t
  misc_feature (1625)..(1625): n is a, c, g, or t
  misc_feature (1632)..(1632): n is a, c, g, or t
  misc_feature (1637)..(1637): n is a, c, g, or t
  misc_feature (1669)..(1669): n is a, c, g, or t
  misc_feature (1678)..(1680): n is a, c, g, or t
  misc_feature (1686)..(1686): n is a, c, g, or t
  misc_feature (1700)..(1700): n is a, c, g, or t
  misc_feature (1707)..(1707): n is a, c, g, or t
  misc_feature (1734)..(1734): n is a, c, g, or t
  misc_feature (1807)..(1807): n is a, c, g, or t
  misc_feature (1851)..(1851): n is a, c, g, or t
ctgcttgttatgcgtaaaagcccaacgcccagcaacgcgatctttatttaattttacgaaatcataatctttacgaaagcttatcaaaatttgcacgcacaaccgcaggcatcgcatcaactatattgccactattaagcgtaaatgcttgagcatttggctgaaaataactgactaaattatcacgttgaataatttctttctggcgaccatctaaagtaactaattgtgcgtaggttttgttatcttgtttgatatgtcgataacgaaatgaatccatatttgctggagtagtttgcacaaaggcaatttcataattgagattatccaatgcttgtgtcattttatctaaagactgcttcgcagaaagctcttcagcagaagcaatgctacttaatagcaaagaaagagaaagtgcggtaaattttaatgcgatttttttcatagaaatctaaaggataaaaattcaccacactaaataacaattaggtggtgaatcaataatctgaacaaaggaaaccaatttatcttacttgactgctagcatcagagtgcatacgacgttgcaattcatagttttgcaacattgcaccaatacgacgactttttttctcaagctgatctgaagtcaatgtatctttacttggcgcattatagctaacctcttgaaccgcattattaaatggcaaggtttgcaatactggagcctcaggtaaattagacgcttcgtttttactattgaaagattgaacaccaagtactgccactaaacatacaccagcagcaacagcaacttgcgtcattggcgcaaaaaatgcctttaatttttgcataaatgcagaattatgtgcatcttctggttcaggttgagacaccgcaatgacatcgactttcttcacgtcttctaactcaatcaaatctgccattttagcggtaaaatccccccctaaaaagaccgcactttctttacgcattactgaacgaacggtatgaaatgaatgccaagacgcttgtaattcttcgtctcttaataaagcatctgtcaagtcagttttgacttgttcgccatccatataggctgaaagctgctctttttgcatagtaaactccaatttttattcgctctacattagaggttgaattttattttcgatcatttcccttgctcggaagattcgggaacgaaccgtaccaacaggacaatccataatttctgcaatctcttcgtaacttaaaccttctagctctcgtaacgtaatcgcggtttttaaatcttctggtaagttatgaatagtatcaaaaacaattctttctaactcactagacaacatttcattttcgggtgtatccacatcccgcaagtgcgtacccacatcataattttcagcatcttctgccaaaatatcttcatttggtggacggcgaccttgagccgttaaataattttttgccgtattaacggcaattcgataaagccatgtatagaaagcactttcgccacgaaaagattcaattgagcgataagcttttataaaggattcttgcaccacatcaggaatatcgntacgtgatacatagcgagtcanaagccccgccactttattctgnatacgcgaaaccaacanattgaanggctntcttatccccttgctgcactctttctacaagncctgattgnnntagctngtcagccatatttnctctatngccatatctaacacgccccttatattncagacagcagctcttgctgcatctcaaaccagggtggtggaaaaagttcatacgatcttataattaaaatagnggggatttttttggacgttttgtattctctacatagaatgattntgaa

SEQ ID NO: 109 - DNA, 759 bp, H. influenzae
  misc_feature (603)..(603): n is a, c, g, or t
ggaattcggctcggtacccagaatttgggggcaagatgtggcaccgattcaaaagcaaattgaggctttaccttgggttaaaggtgcaatcgtaagaaaaagtggccaaatcgtttaagtatttgggtatcagaatatcaacctgttgcgttttggaatcaaaatcaatttgttacccttgatggtatcgtttttcagcttccctctgtacgtttaactgcaaaaaatttgccctatttgggcgggcccgattatcagagtttgaaagtaattgagacgtggaaccaaatttatattaatttaaaatcaaataatataatggcaaagggaattaatattgatgatcgcggtgcgtggcagatccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataaaaataactgggtgcgaaaatggttaaaggtgtggaaacaaaaacatagtaggtttagaggttggcacgtcanaagtggtcgctgtagttggcgaagtatttcctgatggtgtagtgaatgtgcttggtgtaggcagttgtccttcaaagggattgatcgtggcagcatcactgatcttgatgccgtagtgggttcgattcaacgtgctattgaagcggcagaatctat

SEQ ID NO: 110 - DNA, 1251 bp, H. influenzae
aaaatctccttatttacgccaatgcgtacattgttaaatatgtaaacacccttatctgtttagataagggtgtttatgttagtaaaacattggctcattttcccaatcaatgtcaagcgggggttcttctactggttcaggttcaataacttgatattctgcttcagtataggaatctgcactctccaattttttgttccaatttcccattatgtgagcaggtgtgtataaatggtaattcacctcatctttaagggtgttaccaataatgacttctcccggtatatgcaagagtgtcatttgtatataacacattaatgctgcagtaaaatccaaatctcttgcttgagcccacatttgttgctgagggttaaagtcctcttcacgcaaataattataagcctcaataatcattacgcctgacccacaagttggctcttgcaatgtcaaaaagccacgttttttaattaaactatgacaatctgatagagttacggctgccattaagtgtgcaatgtgactaggtgtgaaatattgagctttatattgatcacctaaatccaacgacatgaacactgatcctaggaaatcataggttttatgctccaaagcctcaacaataatgttgaaaaggcgactgagagcttgtttttcatcttcattataatgctcgccagctgtctgataacgttgtctcaacgattcatctgcttgtgcaccatatataatgagatagaattccagggcaaagattgtaataaagtcgtaaaacacttctgagcgtcgatattgtggtgctatcgatttaaaaagtgcggtaaattttttctcgaaatccatagattactcctaaaataacgggagcaatcccctttgaggattactccccaaagggtggtttatgagagctctaacaaaaaacgttagaatggtttaatagaggctaagccgctaattttgcttcttcattcgatgttaattcgagagcatttaacaagaattgtgttgcttcacgtgcttgagaagatgctcggaaaatagcttttttatcggcttttaatgcgttaatccaatgttcaatatacgctgcattcttgtgaaaattattgcaaacattcacgtgcgcacaggtaaaggggcttgtgagttcacctattaattttcaaatgctattggtcagaaccaatttataaattaaccccccgtcccgattaaccggccttatgcccggtggcggaccccgttctgcag

SEQ ID NO: 111 - DNA, 1487 bp, H. influenzae
ggtaccgaatatcggactcggtaccctcatggaaccgggcaaagaggggctaatgtcaaaacaacgataagcattgctgggaggagttcgattgtgagccagcggattaataaatcccctttctcaccttcatcatccccttgtttagctacgtcacgccaaattttaaagatcattccgataagcggaagaagccataaccctgttccaacaaataacgcaaaaactccgttattaagcaaccaaccaagtagagtcaggaaatattcaagataactgtcaactgagaatgtcatatttccccctaagctaaagtaatctgtgtaatcgcttcagcaaaaattaaaatcatcgcaattaaccattttgcttttgccggcatagaagatggttggcgacgagaaatggaatagaccatcaacataatcgcaccatatagtaataatcgtactgcaaaccatatccactgcgttttaataaaccaagcacgaatatcaacattctgaagatattgagttgcaaagatgccaattgcagtaagggctaaaaataaaaataaaaggatagcaataaaacggagtacatttttaagccatcctcttgattgtggctttttaccttgagacatcaggactccttattcattacccacagtcttatccccaaaaactggggataagtcagcaggggattcccaaattgcagctaatttccaaagcaaatattgaattaaccaatatgcatcaacgtgatcggttaattccacattaagtctagctggccagttttcggaagaaacacaggtaattggaaacgcccggagatattaaataataaatgcacttcacctttatctcctttagcgtgtactttccaacttgattgagtaaatacacgctgaggaaatgcgcttaattggcagtttgaaccaatttttgtcttaatttttgcaatgaaatgcagcacgtaggctttcacctcatcagaggtaaaagcaagtgattggatgcgaggcccaatgtcaaaaatacgatgaaaagtcatattaggattaggctgcgattgagttaagttcgtcattgactgcaatcccccgttttttgtctaagtctttagcaaccatcaatgccgcatctaactcagtacagttatgttccatcattaattgtttacgttgtgctttctcgtgtttttcagtcatccctagtgctaagtaaagactaggtggaacaacacggaataaggcttccatattggttgcgagcaccacaccttcagtatatttcttatctgcttttttcgcagataacaacatcattttctgagcttcggataaacgacggaaacggtttacctgttcgacttcatcattagaaaggttaagtaattcccaccattcaaccatgctgagtaatttatcagattcatcagggaagtcagccatattctgtgtagctaaccataaccaaatacccaattggggtctc

SEQ ID NO: 112 - DNA, 1059 bp, H. influenzae
caattaaacgaataatcgttgcttttctgaagcggcggcgtatattgtgggctagttggtccataaagtgcaatcaatggacgatttactgctgccgcaatatgcattaaaccactgtcattggtcacgaccgccgtacaatttgcaattaaatccactgcttcatttaagttggtttttcctgctaaattgacacaaaactcacgcaacgcttctggcagtgcttgacgaatttcttctcccactggttcatctttagctgaaccaaatagcgccacagcatagccttgggtaattaacatttctgctaattttgcataatgataatgtggccaacgttttgccgggccaaattccgcaccaggacaaaaaccaataattggacgctcgcctaaaagtgcggtttgttttttaaagttttttaaggtttcagcttgttgagtgggatcaacggttaaataaggttttagaacaggaatatcagccgctttcggtaccgcattttgctcaaaagctaacgcgacataacgttgcaccatcataggataatcacgtttattattgcgtaaatcgttaagcaagaaataacggctttcccctttccagccacgacgcaccgcaatttttgcaaaagcgggaataaaagctgacttcaaggagtttggtaatacgatcgccatatcatattgattgcgcaatgccttacctaaacgataacgcgttcccaattcaaaggctccgtgccctaatggcatttcaatcgccttacgcacttctggcatacgcgcaagcaaaggcttacaccaattcggtgccatcacatcaatattgcagtttggatattgaattttcagttgctggtacaaactgtgcgacatcatcatatcgccaacccaagatgggccaataattagaatattcattttctgtctttcagaaaaagtgcggtcaaaatacttgttattatggcacagagttgaataaaatatgctcctttaccatttagtcgaactctttaggagtcatttcaaatcctttctaaaaacagataaaaaattg

SEQ ID NO: 113 - DNA, 1043 bp, H. influenzae
  misc_feature (858)..(858): n is a, c, g, or t
  misc_feature (905)..(905): n is a, c, g, or t
  misc_feature (924)..(924): n is a, c, g, or t
  misc_feature (936)..(936): n is a, c, g, or t
  misc_feature (963)..(965): n is a, c, g, or t
tgttaccgaatatcgactcggtaccccaaaaaagtaattttatgtttgtttggttattaatgaagcatatcacttattttttattcatttaaacaacttatatggctttctcaacagccaaatttttcctaatcctattttttcttttatgcgttcatttattgttaattaaaatttatttgacaaaaaatgcctaaatcgttatttctatacccactattctaaaaaaaacacaacatctaggagtatcttatgccccatctctcagtcgccaaatttggcggaacatctgttgctaactacaatgcgatgacagcttgtgcaaaaattgtcattgccgatcccaatacacgcgtagttgtgctttctgcatcagctggtgtaacaaatttattagtggctttagtaaatggtgtaaaagcgacagaacgtgaaaaattaattggcaatgatctgcatatcacttcaggtgtggcaaaacgtatttttgatactgttcaatcttataatgtgcgaatgattagttatggggcaagtaccaacaatgtttgtatgttagtacaaagtgaacattctgatgaaattgtacgctcgttacacaaatccttatttgaataaaatttaaacctaaagtgcggtgaaaaatcaccacacttttcttttatatcattgagattaaagccgaaaaagagtaaagtaaacggctgttcatttgactaattaaccgaataaagggcggaattatgggaaaaaaccggttgttatctttaagcgcacaatggggcgatggaaggtaaagggaaaatccgttgatcttttgacggatcgcgtaaataaccgaaattggttatcaaggcngggcataacggcaggcacacacttattatcaatggcgaaaaaacgcnattacgttaaatccatctngggatgttacanccaacgtaactgcttattggaaagggnnngtggggggtcccctgaaccataatgaaagaatggccaactgaaagcagtgttttaagttcgggacggctataatttag

SEQ ID NO: 114 - DNA, 1017 bp, H. influenzae
  misc_feature (828)..(828): n is a, c, g, or t
  misc_feature (875)..(875): n is a, c, g, or t
  misc_feature (890)..(890): n is a, c, g, or t
  misc_feature (892)..(892): n is a, c, g, or t
  misc_feature (944)..(944): n is a, c, g, or t
  misc_feature (968)..(968): n is a, c, g, or t
  misc_feature (971)..(971): n is a, c, g, or t
tagggaaataaaacgtgacagaagtctatcaaaatagagcgcactttgcatataaaatcacataaaaaaaagcgggcatagcccgctctcttatttgcatcatcattatgctgcgtttttacgttcttcttccatacatactgccgcagtaaataatacgtcagttgatgagtttaatgctgtttcggttgagtcttgtaaaataccgataataaaaccaacaccgatcatttgtgctgctacatcatcagaaataccaaataagctacatgctaatgggattaataataatgaaccgcccgctacgccagatgcaccacaagcacaaagtgctgcaacaatacttaataaaagcgcactaacgaaggaaacttctaagcctagtgtatgaactgcggctaaagttaagatagtaatagtaatcgccgcacccgccatattaatgttcgcacccaatggaatagaaacagaataagtttcttcatcaagatttaagcgttttgctaattcaatgttcactggaatatttgctgcagaactacgagtgaagaatgcagttaccccactttcgcgtacacaagtccacactaatgggtaaggattacgacggattttccaataaactaaaataggatttacaacaaaagcagtaaataacatcgtaccaattaatacagcaagtaattgcacataaccggcctaatgcgactaaacctttatcagataagggtttcagccactaaaccgaatacaccaaatggtgcaaaaagaataatcacgtgaacaatttttgatacgccttctgcaaaacagaaatacgttcttagntgcatcagatgcatgacgtaagccaacctaaaccgatagaccatgcntatacaccaataagntntgcttttgaaaatgcatttaatgggatatctaccacgtttaagaataggggntaataaaactggccacgctttggnggngctgagctgcatctcctttggttgcagacaacttcgctgggaatcg

SEQ ID NO: 115 - DNA, 1223 bp, H. influenzae
  misc_feature (100)..(100): n is a, c, g, or t
  misc_feature (1160)..(1160): n is a, c, g, or t
  misc_feature (1197)..(1197): n is a, c, g, or t
gccagacttggcatgcctggcaggtcgactcttaaaggatccccaattgaagcacctgcacatgaatataaatcattaaaagaagtaattgaagctaccntatgagcatgaaaaattaattaccagtaaaatcaatgaattagtaggtaaaacctttgaagaaaaagactactctgcatttaatttcttacaatggtatgtggaagaacaacatgaagaagaaaaattatttagtagtattttagataaattaaattttcttggagaagatggcaaaggcttgttcctaattgataaggatttaggtaatctctctactaaagcctaattatagattatcaaatctggcagatcttttatttaaaataatgtgtctgccagattattttattccaaattttccaaaatattttctattgcatattttgagttaatcaaggtattataaaaatgaaaaggatttatactgatgaaccaaccaaccaaccaaccaaccaaccaaccaaccaaccaaccaaccaaccaaccaaccaaccaaccaaaataataaaaccgttgcggtagtaacttcaacaataggtcgtccagaattatctttggctattaaaagcgtacaaaatcaaacttatccatgtaagcattatgtatttgttgatggcaatattttctgggataaagccaaatctatattggaacaatttcctgatgtaattcctatttatttgccaatgaatacaggaaaaaatggaatacttaacggtgcaattaacgcagtagcagcttttcttgttgaagaagacattatttgttatttagatgatgacaatcagctacgagaagatcacgtggaaagcttagtaaacgtgattgagcaaggtgctgattttgcttattccttgcgatctttttacgattcaaatcatcaatttatttgcaatgatgattttgactctctcggaaattggaatacaaaaagcgatattttcgtagatgttaaaatagaagatattcagaaacaaatacattttacttttaatgaagttaatggacatattgatactaattgttacgccgtacctcgtgagattgcacaaaaaacttcatatagttggaacacaccattaattggtgatcgcagctttttatctgccttaaaaagnttggggttaataggtcaaacttcaggaaatataccgntaaatacagagctgattcattaacta

SEQ ID NO: 116 - DNA, 1099 bp, H. influenzae
ttcacaaataccaatttcactattgaagaattaccgaattaaggaaaagctatgtctgaaatgactcctcgcgaaatagtttctgaattagatcaacatattattggtcaagccgatgcaaaacgtgctgtggcgattgcgttgcgtaaccgttggcgtcgtatgcagcttcaagaacctctgcgtcacgaagtaaccccaaaaaatatcctgatgattggcccaactggtgtgggtaaaactgaaattgcgcgccgtttagcaaaattagctaatgcgccatttatcaaagtggaagcaacgaaatttaccgaagtgggttacgtggggaaagaggtggattccattattcgtgatttaacggatagtgcgatgaaacttgttcgccaacaagaaattgcgaagaacagagcaagagctgaagacgcggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtgtctatgggggttgaaattatggctcctccaggcatggaagaaatgacaaatcaactgcaatcattgttccaaaatttgggttcagacaaaaacgaaaaaacgcaaaatgaaaattaaagatgcgttgaaaacgttgattgatgatgaagcagcgaaattaattaccctgaagacttaaacaaaagccattgatgctgtggacaaatggtatcgtctttatcgatgaaatcgacaaaatttgtaagaaaaggtgatacaggggtgcttgatgtattcggtgaaggtgtgccacgggatttactttccttaggggaaggctcgacagttacaccaacccccggaaggttaaaccgacctattttatttatggctctggggcttccaaggtcgtcgcctctaaatttaatcctgaatacagggcgtttggcgattcggtgaacttacccataaggggggggatttcggcgattttaaaaacttccgctttttaccgaataaaaagctt

SEQ ID NO: 117 - DNA, 905 bp, H. influenzae
  misc_feature (826)..(826): n is a, c, g, or t
atctaacctacatttggtagtgttcaactttctaccgcagaacaacaggcatttctgtcgcacttgttcttgctttacaatctgttggtggggcaatggggaatatggtatgtataaataacattgtagcggtaagttcagtgttaaatatttcaaaccaagaaggcacaattattaagaaaaccattatacctatgatcatttacggtatcattgccgcacttggcgcgctattcttagtacctttattttataatctataaaatttacgccaaaaatgaccgcacttttgcggtcatttcctatttttctcttttatgtttctactatcaaaaatgagctttaacccattaaagtgcggttaatttagcgaataaatttgtccatttcgcaaaaatcaacctttctttttctctatcttctaaacgtgtttcctctctaaaaaattaatttttttcattatttttttaggtattttcattaaatttattaaatcattccttgaaatccctcttataaaatggataatcgtaatatttctcaaaaataaataggaactataatgaagaaagctataaaattaaatttaattacacttggcctaattaatacaatcggtatgacgattacacaagctcaagccgaagaaacattaggacaaattgatgtagtggaaaaagttatatcaaacgataaaaaacctttcactgaagccaaagccaaaagtacacgtgaaaatgtctttaaggaaacacaaaccattgaccaagtgattcggagcattcctggggcatttactcaacaagataaaggctcgggtggtcgnttctggtaatattcgtggcgaaaatggattatgtcgtgtcatacgatgggtgatggggtaccccaacctctattctcag

SEQ ID NO: 118 - DNA, 1247 bp, H. influenzae
tctctgcacagagaaaaggcgtttcaatgcgtaagttgtacgcgaaaattcagccaaagtgattgccaaaacactcaagctcaaaccaaacgaattggacgccctttgccaacgctaccaatgccaagccgacgagctggcagactttggctattacgccaccggcaaagcaggcgaatatatcctatatgaaacgagcagcgacttgcgcgacagcgaatccataccgctcaaacaaaatatccacgactatttcaaagccgaagtgcaagcgcacatcagcgaagcatggctgaatatggaaagcgtaaaaatcggctatgaaatcagcttcaacaaatacttctaccgccacaaaccattacgcagccttgcagaagttgcccaagatattttggcgttagaaaaacaggctgacggcttgattagtgaaattctagaggcttaataaaaaacaaactattaagcaagttttaataggtcttaagtaaggaaattcaaaatatataacacattgaaaaataatgaattttaccttttaagcaagatttggcatgaaataagcaaggaataataatgacagaaccgctttctaaaattaacggcattatcacaaaaaattatttagagatgcagccggaaaaccaatattttgagcgcaaaggactaggagaaaaagacatcaagccaactaaaatagctgaagaattagttggaatgctcaatgctgatggcggagttttggcttttggtgtggcagataatggcgaaatccaagacttgaatagccttggcgataaattagatgattatcggaaattggttttcgattttattgcaccgccttgtcggattggactggaagaaattctggttgatggaaaattagttttcttattccacgtagagcaagatttagagcgtatttattgtcgcaaagacaatgaaaatgtgttcttacgtgtagcagatagtaatcgaggccctctcaccagagaacaaatcaaaaatcttgaatatgataaaaatatccgtctatttgaagatgaaatagttcctgattttaatgaagaagatttagatcaagaattattagagctatataaaaagaaagttaattttacctccgatatatcttagatttattataccagccaaatttattacccaaaaggaagtcggtattcagtttaaaaatcagccatttaactttttctacctgccgggacgttacattccttcaaatc

SEQ ID NO: 119 - DNA, 1716 bp, H. influenzae
  misc_feature (1448)..(1448): n is a, c, g, or t
  misc_feature (1576)..(1576): n is a, c, g, or t
  misc_feature (1605)..(1605): n is a, c, g, or t
  misc_feature (1614)..(1614): n is a, c, g, or t
agaaaaggggggagggagaacggcaaggcgaaaggaaaagagcggaaggggaaagaggaggaggcgaaagaggggagcagaaaaaagaaaagggacgggaggcggaggacagaagagtgaagaaggaatgggggaaattaacgccaagttccgaggaaagaagaggggagtaaaacagaagagcgggtgggtcaaccgagggatgaaaaccgaaccgatcggatgagtaaaaggagatcttcatcagggtaaccgacatcggcaaacgccgtgatgattaacgttctttttcatccgccacaattaacatcgcttataacttgcgaagtgcgcgatctgtacgccaatctttcgctaattccaccgcactttttagcaaatgcccttgatgcatttcaagtttacgttcaaataattcaaaaagtgtaaatgcatctgccgttccacccgcaaaaccagcaagtaccttaccattatataaacggcgtactttacgagcattacctttcattacggtattgcctaaagaaacttgtccatcaccgcctacgacgacttgcccattgcgacgtacgcttacaatcgttgtcattgttctgtcctttataaagtgaaaagttgttcgttatatggcgacaaattgattaaattcaagagggaaatttatattgtagatttattcttcactcataaataaaaaatgtgaagttgatcatattttgagatggcaaacgattgccaattattgaatataagctaaaaaaatgtatgatctgagcggtttttaaatcaacgtttgtgaggaaaggcaatgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcanactctacttatcaaccaatgccaactttaggcggctatggcgaagaagtgttaatcaattcaagctattaattgaccgcaagttgggatttatcttcccccaaaaagttagattgatttagttcaggnactgagttctgtcattcacagggctcagnccttttagnttccctgaatgtgatcatgggttgtataatgaatatactcatgaagttgtttttcaagtgtttgaacgtctcaaatcgtttgtcgtaatacaattcagttta

SEQ ID NO: 120 - DNA, 1331 bp, H. influenzae
tgcatcatatgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgtgctgctcgtcaagcaggtttaggcggtgagatcatctgttatgtagcttaatagagaggtaggaaaatgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgagccttatgaaggtataggggtacgttattcttatgatgtgttacatttcacaaatgcttcgaagaaacactctaccttatccttttccgataacgtaactttcttctgcttccctgtccgttctttctccgtctcttattttcttttcattggtttatttcgcgcatttttctctgtttcagttgtgttactttcaccccctcctcagtcgatttttctctctcgcaggctttttcctcctctcctctttttgttttttattttttgcgactgtcgttcacttctttgcttttgcttttttcattctcgcctctcctctcattccttcctttcatctcctactcttagtcttttcctccctccccgccccccttcctcccctcggctattagtcggctcctctcattttttttctcttccttcatcttttctcccttccccttcctctcttgcttctttcttcgtcttacctccttgactatctttcactttcgtcctcttctttttcctctgcccccctcattttccg

SEQ ID NO: 121 - DNA, 1283 bp, H. influenzae
  misc_feature (802)..(802): n is a, c, g, or t
  misc_feature (969)..(969): n is a, c, g, or t
  misc_feature (1069)..(1069): n is a, c, g, or t
  misc_feature (1092)..(1092): n is a, c, g, or t
  misc_feature (1099)..(1099): n is a, c, g, or t
agctaggccgtactgtttttcattactaggattaagtacaacgagtatatttttaaatttcataatagcctccaaaattgaggcataggataaaaaagaatagcaaaaatggcaaggtacaagattaatttggataaatttatttttatcaagcacaaaaaggcgtgatattcacgccttaaatttatttaactaatgtaatttttgttttattcgtaccagttaattcaattaaaccatttaaatcattgattgtaatatatttgccttgcacgctaatcacgccgagtttttgaaagcggcctaataagcggctgatggtttctactgttaaacctacataattaccaatatcgccacgtgccattgttaaacgaaattctcttgctgaaaaacctcgagcagaatagcgtttagaaagattatgaataaaagcagccaaacgttcttctgcattcattttagatagcaataaaatcatctcttgatcacttttaatttcactgctcatcaaacgtaaaatttgctggcgtagttttggcatttttcctgccaaatcatctaaaatatcaaaaggaatttcacataccatagccgtttctagagcttgtgcaaaactagggtgttgcatttgagtaatggcatcaaaaccaactaggtcaccgggcaaatgaaatgaagtaatttgttcttcgccagattcactaatcgtatagctttttattgtgccagaacgaatagcataaattgaattgagagaatctcctgctttaaacaatacttgagacttttgaatcggttnttttctctctatgatattatcaagctgatctaattcttgttcatttaaggtaaaaggaatacaaagctgactaatactgcaatcctgacaatgaatcgcacaaccgcctgattgaattttgcgccctgattgagctcctgcaacgaaatttttcatgtacgtctcanatattgaaaaaaatagtgtaaaattgatctaacgcaaatattctaccactaattagtcagattaagaagagtaaagcattatggcagctgaaaattacanaaaaacgttagctcaatttaatnatggtgngcattttattatggcatttgttgggcgaatttttagaaacagaaattctgcttattttaaacaagggatattccaataatttgctgtcacatctattatcgataatcacccatagccgggggcaaaatggaacccacggatcaatccgcgtgaaaacggggggtcgatccacctagcccatcaa

SEQ ID NO: 122 - DNA, 1487 bp, H. influenzae
  misc_feature (1436)..(1436): n is a, c, g, or t
  misc_feature (1459)..(1459): n is a, c, g, or t
tgtatacgattcggactcggtacccgcactattaattttacgccttttgaagcgttggagtgttgctcaaccgtgttcgcttggaaggaaagaaaacaaaagcggatattgtgctaggtttagataacttttttttggaacaagctgaaaaaacaggtatttttgcaccaaataacgtggatttaactcagcttgatttaccaacaaaatggacaaataagaccttcttacctttcgatttcggtaattatgcttttgtgtacgataaaaccaaattacaaaatccgccgaaaagtttgaaagaattagttgaacgccaagatcttcgtgtgatttatcaagatcctcgcaccagcagtgtgggacgtggtttattggtttggatgaatgtaatttatcctgaagataaaattcaatctgcttggaaaaatttagataagcatacggtaacagtgggtaaaggctggtcagatacttacggtgcattcttaaaaggcgaagcggatttagtattaagttacagcacatcgccactttatcatcaactttttgagaaaaaagataattatgcggcgacagattttgcggaagggcatattactcaagtggaattagcggcgcgagttgccaaccatccaaatcaatgtgcggatgattttatggcatttttaatttcgcctacagcacaaaaacatattgtgacagccaatattatgttgccagttattcaaggcgaaattgaaccgcactttgatgcgctgaaagttcaacaaaaaactcaaacgccaattaatccaacagtgaatgctgagcagttaaaaaattggatcagcacttggcaaactacattaacaaaataatttgatgttgtcgttatttcatcatccacaacttcgccctcgtcattatgcgggcggggttgttgtcattagtttcattattcttttttatggcagtgccttaagttcgatctttacattgggcgatgaattgcaatggcgagcttggttcactgatgattacctacagcatctgattcttttcagttttgggcaagctttactttctaccgctttatctatcttctttggtttactcctcgctcgggcattattttattagcccatttttggaaaaaagtggggtgtcaaaattaccgccgctaacttttggccttacctgctttactggccacttttggttttgaccgggatttatggcttcacgtggggtgtgcagtctgggtttacctatctttttctcaattgtccgtctggtgcgtttttatggatctgagggttattaaatttgtcgcattttattttctaattcctacaacatcacatcttttttcacacactctttataccatcccttataaatcctcttctgctagatcatctctaactccccacggtaattctttattgttttangctgttgtatcatcttttgtttnattaatctgcatgacatatttactctcc

SEQ ID NO: 123 - DNA, 1494 bp, H. influenzae
  misc_feature (1442)..(1442): n is a, c, g, or t
atccccatcatgtaatcttaaggttttcaaataggaggggctgcggttcataaaaaacaagcattagtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacgtaattttataataattgaactttcaattgataaaatctgtcttattgacaaattagttcaataagatagcttattgtgctataactaagtacattgattggcaaaagccaaaataaagaagggaaacgatggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccatgttgcacgtggctattctggctatggtttgccacaagctgacttaatccaagagggcaatatcggtttaatgaaagcggtcaaacgttttaaccctgaagttggtgtacgcttggtgtcattcgccgtgcattggattaaagctgagatccacgaatatgctcttcgtaactggcgtatcgtaaaagtcgcaaccacgaaagctcaccgtaaattatttttcaacctacgtaaaactacacaacgttttaggttggttcaatgaaaatgaagttgatatggtcgcaaatgaattgggtgtttccaaagaagatgtgatcgaaatggagtctcgaatgagcggtgcggatgtcggttttgatttacctactgatgatgcagaaacagagacctattctccagccctttatttggaagataaaagttctaatttcgcagcagagcttgaaaatgaaaactttgaaagccaagcaaccgagcaattaggtgcagcgttacaaagtctagatgcacgtagtcaggatattatcaaagctcgttggttagatgataacaaagccacattgcacgatttggcagcaaaatataatgtctctgcggaacgtattcgtcaattagaaactaatgcactgaaaaaattaaaaagtgcggtgaatttttaaataatttagaaaaagaaaacctgctgattagcaggttttttatttctcatttaaccgtaatttcaaatcttcagcagtttggcaggtcttaatcttatcaaacacttggttcgcctcgtcatattccttattcaaataacgtaaccactgtttaattcgtgccacatggtaaaaaccgctgtcatattcattttcgaccattagcatatttttgcaagattttttgaatctcataccaaggcatntggatgctgccctagcaacgccagggtaccgagtccgatattcgtataacag

SEQ ID NO: 124 - DNA, 1872 bp, H. influenzae
  misc_feature (1495)..(1495): n is a, c, g, or t
  misc_feature (1514)..(1515): n is a, c, g, or t
  misc_feature (1547)..(1547): n is a, c, g, or t
  misc_feature (1591)..(1591): n is a, c, g, or t
  misc_feature (1620)..(1621): n is a, c, g, or t
  misc_feature (1630)..(1630): n is a, c, g, or t
  misc_feature (1653)..(1653): n is a, c, g, or t
  misc_feature (1666)..(1666): n is a, c, g, or t
  misc_feature (1676)..(1676): n is a, c, g, or t
  misc_feature (1696)..(1696): n is a, c, g, or t
  misc_feature (1700)..(1701): n is a, c, g, or t
  misc_feature (1825)..(1825): n is a, c, g, or t
  misc_feature (1847)..(1847): n is a, c, g, or t
actctaggagatcccctttgcacaacgtttaaatttaccagtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggtttttggttttcctgcggcacttggtgtgaaattagctcatcctgaaggaactgttgtttgcgttactggcgatggtagtattcaaatgaatattcaagagctttctaccgcaacgcagtatggtattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggagcaatgaatgaaatgattttaagtaaacctcaagaggagacaaactaatgcgtagaattttatctgttttactcgaaaatgagtctggtgctttatcgcgtgttgttggtttattctcacaacgtgcctttaatattgaaagtttgacggttgcaccaacggatgatccaacgctttctcgaatgaccattgaagctgtgggcgatgctcaggcattggagcaaatcgaaaaacaacttcataaattagtggatgtgtttaaagtggttaatttaagtgagcaggaacatatagaacgagaaattgttttagcgaaagtaagagcagtggggtcatctcgcgatgaaattaaacgattagcagatattttccgcggtcaaattgtagatgtcacaccaaagtcttacacaattcaattaagcggtacaaatgataaagttgatgcgtttatttctgcattgaaagaagaaactacattgttagaaatntgttcgttctggattgatnntagtgtgtctcgtgggagaaaagaatattctnttaagtagggggcgtaaagtgcggaaatattttaaatagaattntaccgcactttattagaatataaaattgnntttttaagntttttttataaaaaaaattgtgnaccaagttcacanatctaaaatnatgtatttgcataactgaancggnnattctttatttctgaaccactaaaaacaagtgctatcttaatagccgcatctatttgctttccccgagagtgcccatggggcacttttttattagtaacaatataaaatcctttctgaaaaggngatttatatctaatacattttntacggttatacgggacgtaactgtt

SEQ ID NO: 125 - DNA, 1618 bp, H. influenzae
  misc_feature (1574)..(1574): n is a, c, g, or t
gaaaaataaagccctttttttaattcagggcatgacgataaaatcttgttcaagaaaaaattggtggagtgccggagcaaattccggtaaaccatgaatggtagtcaatcaattcgggaagaagttggcgtacaaagggattctagaaccccttgcataggcgcaagaataacacgcactatttccagccttttgctttacaaattaaatcgtaagcggcttgaatctgttgagtttttcttttgccatttccatcatttctggcggtaaacctttcgccacaagtttatctggatgatgttcattcattaaacgacgataagcacgcttaaccgtgctttgctcgtcggactcagtcacacccaatactttataggcatcatttaaagttgggccagaagcatgttggtaaccaccactattttgttgttgatattggtagccaccttgatatgcaccttgttgatattgctgataaaaaccgccttgagtaaaagctcgagcagccatttccatcgcaatcatttgttcaaattgcatacgagaaagcccaagttcttcagcgatcacataaagcacttctttctcattttcgtgaagttctgaatcggcaaaagccgcttgaacttgcacttgtaagaacattcgcaataaatcagcacgttgcccacaaccaatgcgaaattcacggataacttgacgaatcgggaaatcagattctttaccacgacgaaacgcatcttgcgctaatttacgcccagcatcatccagtttaagctgaatcattaattgattagctaattgaatatcttcttctgttacacgccctttcgatttacttaaatgtcctaacaccgcaaaggtggtttgcataaacaagtcttgacgtgttgttttctttttaaagaaactagaacttaccgagccaagctcatacaattttttatctgcaatagagcctaaaatgagaccagcaatcgcaccaaaaaatccaccaactttccaacctaaaaatacgcctataattttcccaataaatcccattctttcccctgttaagtcaaagtgcggttatttttataatgttatttataatgatgataaaaatttatttctcaagttttatacgccaaattcggcacgataagcacgcatttctggcaaatggctactgtatcgaggatcttgttcgataaattgcatcaaatcatctaaatcaatgattgatagcacttggcattgataatcacgttctacttcttgaattgcagaaagctcgccttttcctcgttccttacggtttagagcgatcaataccgccgcaagctctgccttatttgcactgattaattccatagattcacgaattgcagtgccagccgtaatcacgtcatccacaagcaaaatttttccttgcaatgggctaccaattaaattgccgccctctccgtgatctttcacttctttgcgattaaaacacacggtttatcaataccataacgattaaataacgccaccgaaactgaagtgccaattgggatgcccttgttagcagggcccaaaaccacatcaanatctaccgcacttgcttgaattgccgcagcatagaactcgccta

SEQ ID NO: 126 - DNA, 1254 bp, H. influenzae
cgatattttacaatatcttcagcaataaaatgaccaccactttttactcttgccttaatccgtgcaagatttatttcaatgcgattaataccaatataatttaaatgtacatagaaaccattttctttagcgttctttattctctgaataattgaattgcccgaaagcgttgattccatagaaaaatcaatatgtagcttaatagcaaaacgaaatagccctatcgcttttctgcctgcatcaatatcagcaagtcttggattttgaggattaatctgcattgcaatatgatcagaatcaatcacaatttgcacagcatcttggttaaaagaacgtaaagtactttttcccgaaccatttttccacaataaaaaatcgctttattttgcataacccacaattttttccgaaccatccagataatgctcgactatcttgccatcagttttttgaaagataaccacctcgtgattcattttctctttcatccaaactgaaaataacgctttaagttgtttctgttgttgaataattttctcacgttcagtcatcaattatcctctttaattaattcaaaacctactgctcaatactcaaaattgaaagcgttgataaaaggcaatatcgttcatttattaacccacgttttcagtagaaagattccaaccttgcagacgtaattgtttataacgttctcgagcttgtgtttttaacgcatcatctttcggcacaaaatcaataatttgggtaaaactatggctaaaatctgggatttcttgttgcaaattgattaacaaatcgcggtgttgtaaatttcgttttccaagccacgaaatctcaatcggtgtgggatattgtgttgcctcacctgataaattatgcggaacaaattcattgggatctcgttgccacaaaagttcatcaatttctaatgcttggctctcactttcgcaactaattagtacttttttccctgaacgccatattgaagcagcaagattacaggctatttcttcgacagttaaagtacaattttccgtaagaatataaaattgtgcagtttttgccattttagccccgttattttctcaatcttgccccatataaaactgaggattttaacgaaaaaaccttagaagataaatacttaaatagatattattaaaaataattcattgtaattgattagataacagggtggtttgatgcggatagacatcaaagcacagcgagtatcttttccgccaatggaaa

SEQ ID NO: 127 - DNA, 1341 bp, H. influenzae
  misc_feature (1304)..(1304): n is a, c, g, or t
cgcaaaacacaaagaggccttaagcctcatatactttatgcaacaggtacaacagggcatattttagaacgagaaacaggtttaagcattcaatctttattaagtggtccgatgggaggtgaccaacaacttggtggattaatcgcagaaaagaaaatcgacatgatgatcttcttttgggatccaatgaatgctgcaccacatgatcctgatgtgaaagcccttatgcgtattgcaacagtgtggaatatccctgttgcgattaatcaaagctctgcagattttcttttaacttcagttttatttgaacaagatgtggaaattgacgtaccagattatgaagggtatttaaaagagcggttagcttaaactgcaacgaaaatttaccgcactttatagttgtagggtgggctttagcccaccaattaaccataaaaaatagaataaaaacggtgggctgaagcccaccctacgatacttttaattaaatacaaaacagggcgacaatttatcgccctgtttcagttatctcccaaatccccccattacaagtataaagagtaccactttcaactgttcttctgggattggcttgccgtttagtttcaagtcgttattttctagagcaagcgttaatgttacggttttgtccgtgtttacgataatgtcattcacttcaccttcggtaactaattcattcaatcggcgaacgaaatcttgcttttggttttctggtacaaatttagataacaatgaaatcgcagtttctttgttcacatcaaaattgattgaaaaatctttgaattgtttgtataagccactgcgcattaaatcaaatttaggatttggcactaaagcaatatttagatccaatgccactttgcctttttcatcagaaatagacagaggggtacaattaatttgaggctgattattcgcaatgatcaggcctgcttggtgaaacttttgcacccaggttctacattaaagcatatctgaggtcgcttctgccattggcaacaaaattattgaaagtttctcggactcgcgcggccatcagttcggttgaattcaactttgcggggcactttccctacgggtggaccggtggttagattgaatcccaaattcgctttacgccgcaatcgccctggctcccctctacttggtattttatattgttggtgtattttctcctgactagatattctcggtccgtcccgcccgatgttttttggattgttttactctttttcaccctccgttgtttctcttacgctcagtgcccccttcgtctcgtccgntggtgccgttgcggacagccccttgttgcttcccgac

SEQ ID NO: 128 - DNA, 1204 bp, H. influenzae
  misc_feature (1086)..(1086): n is a, c, g, or t
  misc_feature (1139)..(1139): n is a, c, g, or t
aacgatttgactgcctttatacgcatagagtgcaagcgaaccgccaattaccacaacgaggtaagccaaaatatacaaaccacgagttggatccgatgcaaatgcgtgaactgaaactaagataccagaacgaactaagaaggtgccgagcagacaaagtgaaaaggctaaaatcgcaagtaataccgtccaagctttgaaagaacctcgtttttctgtcacagaaagagagtgaatcaatgcagtaccagcaagccacggcataaacgatgagttttctactggatcccagaaccaccagcccccccagccaagctcataataagcccaccaagaacctagtacgatacctaaagttaaaaacacccaagcagcaagcgtccaaggacgtgaccaacgcgcccaagctgaatctaattttccagtcattaaggatgctatcgcaaacgcaaatgccaccgaaaaacccacatagcccatataaagtaatggagggtggaaaatcaagcctacatcttgcaacattggattaagttcttttccatctactgggaaatcagggaaagtacgcgtgaaaggatttgaggtaaacaagacgaacaatacaaaaccgacgctaataatccccataataccaagcacgcgagcaaccgcttcttggggtaaatgtttactcaataaagcaacggcaaatgaccaaaccgccagtaaccaaatccacagtaacaaagagccttcatgggaaccccataccgcagataaacgataataaatgggtaaagtagtattagaattatttacaatatattgcacgctaaaatcattgactgcgaataaataaaatagcgcagcaaaagcaatgcttaggcttgcaaataaaccataagtcattgggcgagctaatgccattaattgtacattgcccttttccgccccccacaaagggaaaatcgccaacataagcgatacagctaaacttaaagccagcacataatttcctaattcagcaatcattttgcgccttctttttcttgacgatcacgctcactttcgccttttaaatctgctgccttaatccccattggnttatgtactttttgcattttttcgcctaattctgcggcacataatttcatcgngtttagcaatacttctgtcgcgcttaaaccgctgactgaggtatacgccttgagccaccatcccg

SEQ ID NO: 129 - DNA, 982 bp, H. influenzae
ttttggcccagacttggcatgccctgcaggtcgactcttagggaatccccattttatattgaataccaacagcatctaataatgaacataattgttcaaaatgcgcacggctttcatcatctaaataatcaagtaatttaggcgcgttatctaatactttttgtaattctggattttttgtatccaaaatacgaagcggatttcttactaaacgctctttttcttcatcgctcattaaatcttgatggttttctaagaatccaactaaagctgaacgataatttgctcgagcttctaaagaaccaattgagttaagttgaagtgtaacatgttgatcgatacctaacgctttccataaacgataggtaagcatgattaattcggcatcgatttctggattcgcaataccgaatacctcaacacctacttgatggaattgacggtaacgccctttttgtggacgttcgtgacggaacattggcccgatataccataagcgttgttcattattatagatccaaccgtgttcaatggctgctcgcacacaacctgctgtgccttcagggcgtaaggttaattgttcatcgttatcccaaaaggtgtacatttcttttgagacaacatcagttacttcgccgattgcacgcgcaaacaatggcgtactttctacaattggcatacgcacttccgaatagccataactatttaatacattgcgtacttgtgcttcaatccattgccataatggagattctgttggggcgcaatcgttcataccacgaattgcttgaattgtttttgccacgcgctttcctttaataattctggtttttggaccctggcgtgcgactttcgcacgaattttcgcttctaatgggtaactatactttcggtaacaaacgcttttttttgggtttgtgccccagataatacccgttttttttgttaccgccgttccccctaacaccgcccacatgccctc

SEQ ID NO: 130 - DNA, 1715 bp, H. influenzae
caagaggaatgcgagactacgtggagtgaataaaagaccagagcagtaaatacgaagagaggtcccctgggagcgccggcgcgacccgcgggagagaagggaaggccaacggcgcggcggaacacagacccaaaacaggcaagaatcgaatcaaacaacaaacgaaaagaacgaacgcaaagataatgaaccaataacaatgattcagaaccacaaagagagaagcgcgcgcgacaagacacaacagaaactgaaacagataaaaaggaacaacaaaccaaaagaaggaccaaaaggagcgccccagagccccgagagggcagcgcgccccgcaagagcacacaccgtcccagcaagactccgaagcgcgcagacaagaagtcaatgaatagaagcacagcaagcggacaggatgttcccgcatatactcacctggccacaaaattaatcgcgaatcgagcgcctgaacggtagaggtcggcagaatcacaagcgtagtttataatcactggcaagaagtaaagggcttccccgatatcaacaaccgccctacccatttgctatttaatatggcaacaggtgcaggcaaaacgatgatgatggcagcgttgattttgtattattttgaaaaagggtatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgctgacgtgcaacaaaagtacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaatatcaaaaaccaatgtgattattaccaactccgagagcaacaaaaccaaaccgaaaaaccgacagcgaaaccgaaaattgctaaataatttggaaagcggcgataatccgaccgggcatttttacgggggaagataaccgaggtgtggacgtctgaa

SEQ ID NO: 131 - DNA, 1394 bp, H. influenzae
aataaatttatttaataatctcaatcacttctctgactaatcgtccaatttcatcccaatttttggattgaatcaattttttctccacaaaccaagagcctccacaagcaacaatattaggaatagcaagataatcccttatgttatgaagccctataccaccagtcggcattatctgtaattgagcataaggaccgagcaatgctttaatcattttcactccgcctgaagcctctgcagggaaaaattttaccgccgaaattcccatttctaatgcaatttcaattgccataggattattcacccctggtgttattggaaaatttaaatcttgacataatttcacaatttttggattaaatcctggtgttaccacaaaatccgccccactacttttagctaaaactacttgttccgcagttaaaactgtaccggcagcaattaaaaagtcaggtctatttgcacgcaacaaacggatcgcatctgccgctgcttcagagcgaaaagtaatctctgccacaggtaaaccatttttagccaacgtatctgctagcggcaaaatatcgtctgcattatccaacgcaattacaggcacaattttgagttcacgaagtttttcaataatttgttgagttgtgtatgacataattttccctatttaaaataattttttgcattgttgaaacaaatatcttcaatcattttacccagtaatgaaatgtcatttggagcttcacctttttcaacccatccaccaatcatttcacacaaaatacggcggaaatactcatggcgagtgtaagataaaaaactacgtgaatcagttagcattccaacaaattgactgagtaaccctaattgagaaagctgttgtaactgacgttccattccgtctttttgatcgttaaaccaccatccagaaccaaactgtattttccctgcaataccatcgccttgaaagtttccgatcatactagcgatcatttcattatctcgaggatttaagcaatataaaatagttttaggcagttgattttccttatccattgcatctaacaaacgagagaggggatatgcataagttcgatcaccaatggaatcaaagccactatctgcaccgagtaaagcaaacattcgactattattgttacgtattgcaccaatatgcatttgcattacccagtgacgtttacaatattccgaagccaaccagactaaaattgcagtactaaattgagcaacttcttcttccaagagcggttgattttgcaaacgtttttgtaaaatactattcaatactgattcatctggaatagctgaaaaacggacaatttccataccatgatcagcagatttacaacctgagcagggtaccgagtccgaattcgaaacca

SEQ ID NO: 132 - DNA, 1477 bp, H. influenzae
  misc_feature (1308)..(1308): n is a, c, g, or t
atgctttgtagggtttctttacctaaatgagtacgataaaatttgcagaatctacgccattttctgtttccttttcccattgctgtaaacgtaagttaagtaatcgagtggtaatttgctgaattaattcttgtttatagctcgctaatgtattggtttcaattgtattttcaaaaaaacttaattcaatacttggaattgttgtgccttgttcagaaatagaatctaatcgccatttgttgataagaggaatattaaaatcaattttttccaatgttgttttagtaattgggttttcttgggataggttttgttttaatagttttactacttgttttgtatcaatatcgcctacaataattactgacatattatctggtcgataccatttgtggtaaaaatcagcgacgcgtttagctgaaattgttttaataatatccatatctccaataggatcacgtaatacataacgagaacccgccatttcaatagcacttttcttattgccaatacgtaacattgggcttaaacgtcttcgccattcttcttgtactacaccacgttcgccatccacatctttaggcaaaaaagtaatattattcatccattcattgataacatcaaaagccaattctaatttttgctgattattgctatctaaatttaaagtatagactgtattttcaaaatcggtaaaagcattaatatctcgtgcaaacttcattccaagtttttctaacgcattaataatttgattttctggatatttctttgagccattaaatgccatatgttcaactaaatgggcaatgcctttttgatcatcatcttcgtgcattgagcctgcattaattactaatcgaatataaacgcgttctttgggttcagtattttttaatacaaagtattgcaaaccgtttgatagtttaccgtgctgaatatttggatcaaaaggtaaatcattattgggcgatagttccaatgattgacaagcaattagtgaaaagataagtaaaaaaagtgcggttgtttttttcattatttttacctagaaaaaagaaaactctacgctaagtaaaactagcgtagagtagggctggtggacatttcaaaaacccataagccctatacattgaagaaaattagaattgatagccaacttctagccaaaattcacgcccaggcgtatagacaccatattcatcgctggtagaaatagcagtagcgactttatttttacgtgttttattaagtacatttaaaatatctacttgcaaataaacgctatgcttacctctaatggttggntgccaacgaatgctgctatcccattgtgtggtgtctgccatagtgatagctacgatagcgtggaatggcatcatcgttatcgctggtaatcaaatcataacaacgaattggggctttcataacactttatttgaccaagaatatcgtaattggggatcgcatatcaaaa

SEQ ID NO: 133 - DNA, 1707 bp, H. influenzae
  misc_feature (1594)..(1594): n is a, c, g, or t
tgatggattttgtgaatcgcattgatgtgcgataatttagccgtttagacggctaaaatttcttgacaagctaatcgacttactgatagtttaaacgccattctgattattacgataggttttcaatgtctgtgcaaaatgtagtgctttttgacacacagcctttaactctgatgcttggcggcaaactttcccatattaatgtcgcgtatcaaacttatggcacactcaatgccgaaaaaaataatgcggtattaatttgccatgctttgactggcgatgctgagccttatttcgatgatggtcgagatggctggtggcagaattttatgggagcaggtttagcattggatacggatcgttatttttttattagctcgaacgtattaggtgggtgtaagggaacaactgggccttcatcaattaatccgcaaacgggtaaaccttatggcagccaatttcctaatattgttgtgcaagatattgttaaagtacaaaaagccttgcttgaacatcttggtattagccatttaaaagccattattggtggatcttttggcggtatgcaagcgaatcaatgggcgattgattatcctgattttatggataatatcgtgaatctttgctcatccatttattttagtgctgaagccataggctttaaccatgttatgcgtcaagcggtaattaatgatcccaattttaacggcggcgattattatgaggggacaccgccagatcaagggttatctattgcgcgtatgctaggtatgctgacttaccgcaccgatttacaactagccaaagcctttgggcgtgctacaaaatcagatggcagcttttggggcgattactttcaagtggaatcctatctttcttaccaaggcaaaaaattcttagaacgttttgatgccaatagttatttgcatttgttacgtgcgttggatatgtatgatccaagtttggggtatgagaatgtcaaagaggcattatcacgtattaaagcacgctatacgttggtttctgtgacaacggatcaactttttaaacccattgatctttataaaagtaaacagcttttagagcaaagtggagtcgatctacatttttatgaattcccatcagattacggacacgatgcgtttttagtggattatgatcagtttgaaaaacgaattcgagatggtttggcaggtaattaattagtcataaaaaagtgcggtgaaatttcaccgcacttcttcttttataaccagttattcttcagaactgctttcttccaaagaatcttcttcatctgcatcacaaacacgttctaaacttactacgtgttcatcatcggcagtacgaattaagcgaacaccttgcgtgttacgccctacaatgctcacttcgcttacgcgtgtgcgaacaagcgttcctgcatcagtgatcaacataatttgggtctgtttcttctacttgagttgcagcaacgactttaccattgcgttcactcactttaatcgaaatcacaccttttgtattacgtgatttagttgggtattcacttaattgtgtgcggttttccgtagccgttttgtggtgctggtanaaattcccctttaccttttgcacaacgagagaaccactttatcgatatttagcctatgatgctttagcggtgtatcaaaatatcttcaattctaccgcctttctcgtcagaat

SEQ ID NO: 134 - DNA, 1411 bp, H. influenzae
  misc_feature (1094)..(1094): n is a, c, g, or t
gagaccccctccacgttgatgtgaacttctcggatctttatactggattgattgatgtgaatatgtcttcaatgcaagacaggatttccacggaaacacaaaaagccttattagatttagctgaaagtgtggattatccaatttcagaaaaattgagtggcagcggcgatttaggacaagttttaagtgatgccatcgaacaatatgatgtggatttattagtgacgggacatcatcaggatttttggagtaagttaatgtcttcaacacgtcaagtgatgaatacgattaaaattgatatgttggttgttccgcttagagatgaataattaacaagaaattgttttttgaataatctgaaataacttaaattttaaccgcacttctcaaatagcgtcgtgaagtgcggttttattttggggttttggcaaaaagcctttttataaatttcaaaaatatgcaaaaatagggcgatttagtttttattttattatgggtaacaaggattctttttaatgaaaacaacagcagaaataagacaatcattccttgattttttccatagcaaaggtcaccaagtagttgagagtagctcacttgtgccggaaaatgatccgactttgcttttcacgaacgctgggatgaaccaatttaaggatgtattccttggaatggataaacgcccttattctcgagccaccaccgcacaacgttgcgtgcgtgctggtggtaagcataacgacttagaaaatgttggttataccgcgcgtcaccatactttctttgaaatgctcggtaacttcagttttggtgattactttaaacaggatgcgattaattttgcttgggaatatttaacttctccacaatggcttggtttacctaaagaaaaactctgggtaaccgtgtatgaaactgacgacgaagcctataatatttggaataaagatgttggtgttcctgctgaacgcattattcgcattggtgacaataaaggctcaccttacgcatcagacaacttctgggcaatgggcgacacaggtccttgcggtccttgtactgaaattttctacgatcacggcgatcatatttgnggcggacctccaggctcaccagaagaagatggcgaccgttatattgaaatctggaacgttgtgtttatgcagttcaaccgtttagcagatggcacaatggaaaaattaccttgtccgtctgttgataccaggatggggattagagcggtatttcggtgtggtgcaacatgtgaacttccactacgagattggttttttccaaacattaatccccaaaacgggggaaattggagggccacagattcaactacaaatcactccggttatgctggcctatccgcctttggcatataacgccgatgggttctcccacaaag

SEQ ID NO: 135 - DNA, 2349 bp, H. influenzae
  misc_feature (553)..(553): n is a, c, g, or t
  misc_feature (2238)..(2238): n is a, c, g, or t
ccgaaaaagtttgcagtcaatcgtgattattatttaatatggcctatgcaaaagcacaaattttttaaaccggatgttcagctaaatgatgaaaaaacaaaagtttaatgtaaccattgatgtaaatgaaggtttacagtatgactttcgtagtgcacgcattataggtaatctgggaggtatgtctgccgagcttgaacctttactttcagcattacatttaaatgatactttccgccgtagtgatattgcagatgtagaaaatgcaattaaagcaaaacttggagaacgcggttacggtagcgcaacggtaaattcagtacctgattttgatgatgcaaataaaacattagcgataacccttgttgttgatgctggacgacgtttaactgttcgccaacttcgctttgaaggaaataccgtttctgctgatagcactttacgtcaggaaatgcgccaacaagaaggaacttggtataattcacaattagttgagttaggaaaaattcgcttagatcgtacaggtttcttcgaaacagtcgaaaaccgaatngatcctatcaatggtagcaatgatgaagtggatgtcgtatataaagtcaaagaacgtaacacgggtagtatcaactttggtattggttacggtacagagagtggtattagttatcaagcaagtgttaaacaagataatttcttaggaacaggggctgcagtaagtatagctggtacgaaaaatgattatggtacgagtgtcaatttgggttataccgagccctattttactaaagatggtgtaagtcttggtggaaatgttttctttgaaaactacgataactctaaaagtgatacatcctctaactataagcgtacgacttatggaagtaatgttactttaggtttccctgtaaatgaaaatacctcctattatgtaggattaggccatacctataataaaattagtaactttgctctagaatatacccgtaatttatatattcaatcaatgaaatttaaaggtaatggcattaaaacaaatgactttgatttttcttttggttggaactataacagccttaatagaggctatttcccaactaaaggggttaaagcaagtcttggtggacgagttactattccaggttctgataacaaatactacaaactaagtgcagatgtacagggtttctacccattagacagagatcacctctgggttgtatctgcaaaagcatctgcaggatatgcaaatggttttggaaacaagcgtttaccgttctatcaaacttatacagcgggtggcatcggttcattacgtggttttgcttatggtagtattggacctaacgcaatttatgccgctcaaaatggtaatagtaatagtaatagtaatggtacttttaataagataagttctgatgtgattggtggtaatgcaatcacaactgcgagtgcagaacttattgtaccaacaccgtttgtgagcgataagagccaaaatacggtccgaacttccctatttgttgatgcggcaagtgtttggaatactaagtggaaatcggataagagtgggttagataacaatgtattaaaaagcttacccgattatggcaaatcaagccgtattcgcgcctctacaggtgtcggattccaatggcaatctcctattgggccattggtattctcttatgccaaaccaattaaaaaatatgaaaatgatgatgtcgaacagttccaatttagtattggaggttctttctaataaattgaacttttttcttcatcagaactcaaaaacaacgttctctgcctaatttaattgggcagagaaaatattaaacccatcatttaattaaggatatttatcaaatgaaaaacatcgcaaaagtaaccgcacttgctttaggtattgcacttgcttcaggctatgcttccgctgaagaaaaaattgctttcattaatgcaggttatatttttcaacatcacccagatcgccaagcagtagcagataaacttgatgctgaatttaaacctgtagctgagaaattagcagcaagcaaaaaagaagttgatgataaaattgctgctgctcgtaaaaaagtagaagcaaaagttgcggctttagaaaaagatgcacctcgcttacgtcaagctgatattcaaaaaccgccacagggaattaataaattagggtgcggctgaagatgcctgattacaaaaactaatgcaggaacaagatanaaagtttcagattccaagctcaaaatgaaaacgtccagcctgaaaacgtgggaaatattaaaatgcattcaaactgcacaataatttagcaaagcaaaggtttttttatgt

SEQ ID NO: 136 - DNA, 2007 bp, H. influenzae
  misc_feature (1996)..(1996): n is a, c, g, or t
ctagggggatccccaaccaaaaccaatcatagcttgcccttgaactgacattaccgttcttacatcagcgaagtccacgttaattaaaccaggagaggtaatcatatctgaaattcccattacagaattacgcaatacgtcgtttgcagcagcaaaagcatcaattaatttagcatttttagggagaactttttggatttgttgattcggaataataatcattgaatcaacatattgggataaatctttaataccaagctctgcaaattgcatacgttttttgccttcaaaggcaaaaggtttagtcactacagcaacagtcaaaatacccagttctttagcaattttagcaacaacaggtgccgcacccgtacctgtgccgccacccatacctgctgcaataaagaccatatcggcaccttcaagcattttacggatttcatcctgatcatcttcagctgccttacgaccaatattcggatttgccccagcacctaaacctttggttgtttctccaccaatttgtacggtctgttgaacttgacttttacgcaatgcttgagcatcagtattgacggcataaaatactatgcgaccgtgttcctctgatgttaatgaactttcgccaacaaaggttccgcccatttcttgttttaccatattcattaccatatggtttacggcattgccaccgccaccgcctacacctacgactttgatcagtgcgccggattcgttaaaattatcgtactcagggtactctgggtatagcattgatgttctccgttactgccagataagctgactaaatatataaaatataaattccctttattgtagatgaaaaattaaaataatcaaaattctgaccgcactttattgacaattttttttactccttgccaaatagattcaaagaaagttccttcagaatcatcacttcctgaaattaaatcatcatcactattactgtgattatattgcaataatcccaccaccgttgaatattgtggacgattcacgtaatcagtcaaaccagtaatatttaatggactcgcaatacgcacctgacaatggaaaacatttgaagcacattctttaagatcttcaatctgcgctccaccaccagttattaccacacctgcaattaattcaaatttaatatgttttgcttctaattcagcttttaacttatctaattcatcttttaccacgcctaaaagctccgtataacgagctgatgtaattaaagataaatcactttttgttaatgaacgaggcgcacgaccgccaatacttgccacctcaatttttttatctccgtgcaaacgagctgggtaaaatgcactagcatagttcactttgatccgttctgcttctgctcgcgaaattgtacaagcgtgcgcaatatcatttgtcacaatatttcctgcgtaaggaattaccttgctaaaacgtaatgcgccattcgtataaaccatcacgttcattgtgccagcaccaaaatcaattaaacacacgccgagatctttttcatcctcagttagcacagaatgtgttgctgcaaaaccagagaaaaccactttatccacttgcaatccacaacgttcaacggctttttttaagttattttgccaatcttgatgacaagcgatcaaatgtacttgtgcttttaaacgcacgccttgtaatcccaatggatttttaatgttcatctgacgatcaacagcgtattcttgtggaataacatgcaataaagataagccttctggcaattttattgagcttgctgtatgaagtgcggaatcgatttcctcttgtgttacttcactttctgctatcggcacaaaaccactttcattgaggctttgaatatgctctccagtatagctaaagtcacactcataatctgacaatcaggcatagattctgccgcttcatagcacgttgaatcgaaccacctacgcatcaagatagtgatgctgccacgatcatnccttttgaaga

SEQ ID NO: 137 - DNA, 1529 bp, H. influenzae
  misc_feature (1335)..(1335): n is a, c, g, or t
cggcaattttatctaggtatcttccatattcgcggtgaaatcgtaattcattaattcgccaaaagactcattgaggcgatcagtcacaatttcgcccatcttttctgcatagaaacgacgattttcagtgcgaacataaccacgttcttgaatagtggaaataattgccgcataagtggaaggtctgccaataccacgtttttccaattcttttactaaagccgcttcagtaaaacgagcaggtggtttggtaaagtgttgtgttggttgcacttcttttaaagcaagtttttctgacacagtaactgaaggcaattcttgatcttcaggatttttacctatctgtggcaatacttttgtccaaccatcaaaacgtaaaattctgccttttgctttcaaggtataatcgcctgcggaaacggtcagcgtgctactatcatattgtgcaggtggcatttgacatgctaaaaattgacgccaaattaaatcataaaggcgcaccgcatctttttccattccctctaaggattcaggcaatgctcgaatatccgatggacgaatagcctcatgtgcctcttgtgcattttctttactagaataaaaatttggtttttctggtaaatattgtgcaccaaaatgattttcaatatagctacgcgccatattcagcgcatcttgactcaaattggttgaatccgtacgcatataagtaatgtaacccgcttcatataaacgttgggctaacatcattgtcttcttaacgccaaatcccaagcgagtacttgccgtttgttgaagtgttgatgtaataaatggtgctcgagggcgagaacttgttggcttagtttccaaatctgtgacaacgtaatctgaaacattcagaaaatctaccgcactttgtgcttctttttgattttttggatcaaatttcttgcctttataatccgtaacatccaagcgtatagcttgtttattttgattattcgtaaggacggcaacttcccaatattcttcaggctggaacgctttaatttcacgctcgcgttcgactaataatttaaccgcaaccgattgaactcgaccagcagaaagcccgcgtgccacttttttccaaagtaatggtgacaccataaagcccactactctatctaaaaaacgacgagtttgttgggcattaactcgatccatatttaattgttcaggcttttcaaaagcctgtttaatggcatttttagtgatttcgttaaacaccacgcgactaaaacgatcattgttaccaccaatcacttcacgtaaatgccatgcaatcgcttccccttctctatccaagtcggntgcgagataaatgtgatctgcttttttagcaagcgactttaactcggaaaccactttttctttacaggcaaatctgataattgctttccaatcgtgaataaggacatccccatcgtttactaaggcgtacgttcctttttgcctaatttttgcttttcttcgcatcatacttttgtggaatggttaacctttcc

SEQ ID NO: 138 - DNA, 1083 bp, H. influenzae
  misc_feature (1055)..(1055): n is a, c, g, or t
gttttcgaatatcgactcggtacccatgccgtgatatctaaatgctccgtgctgatatggcgacccgagcgcaatagactatctaccgctggaatattggatttgcaatcgccacagcgagttttggggaaattacatcttgaaggttgtctgtcataggttatttctcaatatctaatgctttattgtattcacattcatgaaaaaagtgattgaaatctactatatcggttgcaggaaattctaaacttatttcatttctgatatgttctaatatcttgcttcccactaaatatgcagatttcccgcgcaatgctttatcgtaccattttattagatctgcctcagtgataatactctgaatcttagaacgccaaccaatttgatttaataaagacaaaataagtttttcttcactctctttacatacaataactattcggtcagatgaaactgaagatacaatgttttcagctaattcttcagttaatgataaatgttttatttgaattgccataccaaaattagcccacatatccaaaccccgatctgaagcatttgttacaccaactctattaatttttgcattaagttccaaactagtattctcactatcaagagaaataatttgacgagtaaaatcttcaaactcctttaacaaatcaatattcgataaatctaaatcaatttttactttaacgcctaaagcctctattaaagatgaaaacaacgcataaacaactatttcataaactttatcaatacttcgttttaaaccgggttctaaccaaaaaagagcaagaaattcacttagatgaaaattatctggagtacgagaataactatactctaaggctgatgacatctgattaaagcgttcaaaaaactttttataaatataactttctactccaccatttgtttttctattcatttctcctaatatatttaaatgtttgggaggcatagcgttatcattaaataaatcgtcttgatatttagctgacgatgttgatactcttcctaaaaaacggatacaaataacaggggtctcntagagtcgaccgcaggcagcaagctggc

SEQ ID NO: 139 - DNA, 1163 bp, H. influenzae
  misc_feature (882)..(882): n is a, c, g, or t
atatccatacgtcccacggctttcttgtggtggtgtttctgtttcagttgttggcgtgagagagggagatgatgtttcgccacagaaattctgaccattatttagccaaacaggaattgttcgataactctcacaatcccagtcaccgtattgatttatccccacccatttcactgttgtagggggagtaattgctaatttttcaatatttgtacggtttaaataatctttataaatttgcaatgcgccagaagcaccagtcagttttgtttcgccattatcatcgcgaccaagccagacggtgctgatattttttccgtcaattcccacaaaccacgtatcgcgtgattcattggttgtgcctgttttgcctgctaaatgtaaatcagcgtaatccttttgcaaactgcgagctgtaccacgttcaacagtttgttgcattgcaaataaggtttggaatgccgcttcttgtggcaccacttgttttgcacttttatcgtgttgaaaaattaggttaccttgacgatctgcaatactatcgacggttgtaagcgcaattctcccaccttgattggcaagggtttgataaagttttgtgacatcataaggcgaaatgctataagaaccgagcaacatcgcaggcactttaggaatttccacgttgtcccagcccatcgctttttgcgtgtcaatgactttgctcaagccaactttcataccaatatttacagtgggaatatttaaagaacgggctaaggcatccattaacattactgaatcactatattttttgtcatagttgcgtggctgccacggcgggctacctttgacattaattgttattggttgggttataattggggggatatcaaacgggaactngttctgggttagaaaggtgcgggcaaataataaaaaggttttactaaagaaccaatctgacgttttgccattaatgcacgattaaagcctgcataattgcgtttgtaaaccgccaactactgcacgaatttcgcctgtgcgataatccgttataatcatcgctcctctatgggggggattttcattttcagttggaattgcaaaacggttttgaccattgcattttctgcttgacctggggggttaaaaaccattggggaaaaaatactccgccagtaaaa

SEQ ID NO: 140 - DNA, 1005 bp, H. influenzae
caacaacctataattaggtgctgtaaattgcaccttttttataaaatcatataccgtgcaaaattgcaccctactcgaagcattagataatgaaaaacgaaattgatattaaaaaactccgtaacatcgccattattgcgcacgtagaccatggtaaaaccactcttgtagataaacttcttcaacaatctggtacttttgaatctgctcgtggtgatgtggatgaacgagttatggactcaaacgatcttgaaaaagaacgtggcattaccattcttgcaaaaaataccgcgattaactggaatgactaccgcattaacatcgtagatactccagggcacgcagacttcggtggcgaagttgaacgtgtactttctatggtggattctgttctattagttgttgatgcgtttgatggcccaatgccacaaacgcgtttcgtgacacaaaaagcattcgctcatggtttaaaacctattgtcgtaattaataaagttgatcgccctggtgcgcgtccagactgggttgtggatcaagtatttgacttatttgtcaatcttggtgcaagcgatgaacaattagacttcccaattatctatgcttcagcgctaaatggtgttgcaggtcttgaacacgaagatttagcggaagatatgacgccattatttgaagccattgtgaaatatgtagaatcgcccaaagtagaacttgatgcgccattccaaatgcaaatttcacaattagactacaacaactatgtaggcgttattggtattggtcgtattaagcgcggttcgattaaaccaaaccaacctgttactatcatcaatagtgaaggaaaaactcgtcaaggtcgtatcggtcaagtacttggacatcttggtttacaacgttatgaaagagacgttgcctatgcttgcgatattgttgctatcactggttcaggagaattaatatttctgataccatttgtgatatcaacgcagttgaagcactgtcattttt

SEQ ID NO: 141 - DNA, 938 bp, H. influenzae
tgttttcgaatatcagactcggtacccgtcttggttacgatggccgtaaaaactctgacgtttttgcccgtgacaccgctgaaatatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttgggctgtttcttagggtggtatttggcaaaacaatatcaaggcaaacaaggtacattggcttgctcacttgtttcttccccagctcttgctgaaattgcgaaaaaatacgggttccaatcagaagaaaccttaactgggttcaaatacattggtaaagtatctggcttattggtcggttttgaagaggcatgggctatctagtggacccagaca

SEQ ID NO: 142 - DNA, 1323 bp, H. influenzae
  misc_feature (1024)..(1024): n is a, c, g, or t
  misc_feature (1050)..(1050): n is a, c, g, or t
  misc_feature (1104)..(1104): n is a, c, g, or t
  misc_feature (1163)..(1163): n is a, c, g, or t
  misc_feature (1250)..(1250): n is a, c, g, or t
  misc_feature (1259)..(1259): n is a, c, g, or t
  misc_feature (1264)..(1264): n is a, c, g, or t
  misc_feature (1267)..(1268): n is a, c, g, or t
  misc_feature (1303)..(1304): n is a, c, g, or t
  misc_feature (1311)..(1311): n is a, c, g, or t
  misc_feature (1318)..(1318): n is a, c, g, or t
tttttctggttctggctctttttgacattttctggctcaggctctggctctttttgtacatcttctggctctggagcaggttcttccaacaccatgccctgtaatagttccatagaaatacttgtagatatatcgccttgtgcgctatttgcactatcacttggctcattccaattccataagataaatcctataataataccgtgtgcgatcaaagaaataagcaaacccaatagcgaacgttttgtttgctgcataattattccttacggcgtagttggtacagattgggaaggagtagattcttgagaattttcacccgcactttttcccttatctttcatagaaacaattgccacatttttgatttcatttttagaaagcatatctgtaatcgtcacaaaatcttggaaagaggcttcggcatcaatttttaaagttactttctgatctttattccattgagcaatttctgcctctagagcttcttgagaaataggtttatcattaaaatagagttgtttatccgctgtcactgtcaataatttagctagctcgtcagatttaaatgcgaccgctgtactagcttttggtacatttacttgaattttaccttgagagataaaagatgcagtaataagcaccacagtaagtagcaccaacataatatcaatgaaagggataatgttgatttcatcgaattttttcacgaattattccttatctttttgttcgcttaatactttccattttaaacgattaacttcaactttacgccccaaaccgttataaaacaccatagagggaatagccactagaatacctaatgcagttgcttttaatgctaaagataagtgcaacataattacacttggatcaatgtcgccaccgccgtgaccgatttgatagaaagttaataaaatcccgataactgtaccaagtaatccaacataaggcgcatttgcaccgatggtagaatcactggcatattacgggttaaatcaatatctaatgcctgaatagnagaataatggggcccgcttacccttnctaaaaaaagatacggtccattaccctccgcagcctaataaggctcatcggaanaattaacccgtgataacataatcctggcctgtgggcaaatccaaagcgggccccttctntcccctgcattcgggacaatccttgagactaaccggcaggcagttctttctcgggggctcctgccgatccgccaacgcggaactttnagtatattnccganatnnacccacccaccgcccgtgttcgatctttcccccannctggccncgccacnacctg

SEQ ID NO: 143 - DNA, 1305 bp, H. influenzae
  misc_feature (1282)..(1282): n is a, c, g, or t
gagacccctggttgttgcttggagtagatatttccgcatatcaaggcaaacgccaccgtattaatatcagcttgcctgaataccttatcaaacgtattgatagccgtgttgcaagcaatccaatctacaaagaccgcagccactttttagcgattgcctcacaaaaagagctacggcaataattacccaaaaaacgcatacaactgatttaacgtattttcatcggttgtatcgttaaaaatatgcttgattgctgcactaattaacgctttgtaacagctttcaaactctgcttgctccatattcccataactcaaggattgcgcctcaatccgcaaatcccctttaatgttgtatgtagattcgtaaaatcccgccaataccgttagatgtttacgaaaggtgtcaaattgcttgcgctcatcaaagtgttcccattctgttttatctgcagcccaatggttaaaacagaatttaaaaaaggcgaacaccttacgatggaaagcgggattgcgtgtacggatgatttcaatttcatactgctcgccattttttaatgatttcaattcttctgattccagttcatcaagtggcgcaagcacaccgccttgtaacttaatcatctgaatttttaaccgcccttcagttcgtttcccgtgtgcttttttaatatcatcaacactacaagccattaacctatttctccatgcggatatacccactaacctttttaataaaatcaaggctaattgaacgtgtgacaaagtcttccattgttggatcaaagactacgaccatttgccctttgctattccccttgatttcttttcctgttacagggttgataaatgcaattcgaccacctgtaatatcaatcacttcatttgccacgccttgaatatggttttgataccattgagtagatttatcattgttgagtaacatcacgactaaataaccagcatcacataattctttcgcacgttgtagatatggtgtaacgttggaataaggtggattcacatagattcttaacggagccgaacaacgttctgcgacttcatccaacaatacatctaacatttgctcaatcggcattagaaagtcatctgcgattgattgatgctcatcattatctgagttaggctcgccgatatagtgacatgtcagggcgttgttggctgtagcgcaaccatcaagatcgaaccacccgaaacgttgaagaagcccttcaaatacataacacgggtggttgccatgtatttttatatcaaatggtggncctgcatttgcatgcccccttta

SEQ ID NO: 144 - DNA, 1265 bp, H. influenzae
  misc_feature (1153)..(1153): n is a, c, g, or t
  misc_feature (1168)..(1169): n is a, c, g, or t
  misc_feature (1173)..(1173): n is a, c, g, or t
  misc_feature (1179)..(1180): n is a, c, g, or t
  misc_feature (1195)..(1196): n is a, c, g, or t
  misc_feature (1208)..(1209): n is a, c, g, or t
  misc_feature (1213)..(1213): n is a, c, g, or t
  misc_feature (1230)..(1230): n is a, c, g, or t
  misc_feature (1250)..(1250): n is a, c, g, or t
  misc_feature (1255)..(1255): n is a, c, g, or t
gaaatccccttcaaccccattaagcctgggtggcgaaattggtagacgcagcggattcaaaatccgccgttgaataaacgtgtcggttcgagtccgaccctaggcaccacatacaaacccttgatcgttggtcaggggtttttcttttatgcatttcaaccagtaaaatcaataagttacgttcatatccgctataaattcatcaccaatcccaacctcaaatattgccatttttaagtatttttatgcatcgattacgccaaaattacgccaatgcaacatgaaatggggtgcggaagaggaaaagaaaatagaattgcaagcgcaaggattgcaacctgatacattattttctatttgaacgaaattacgccaacaaagcgtggagaaaagcacgaatttaatcggctgaatcgctttttacgccatccagttacggataaatatatatctgatgttagtcggataggggatgaggaattgtgttttgatattaagtctagtgtgcttgatgcaacattccgaaaactcaaaaaacttgccgagcgagaatatttgcattttcacgacacacggcgtgaggcattgactagactatctaaaaaagtagatgtgatgacattagccaaaatatctgggcataaagatatttcgattttacaaaatgtctattatgcccctgatatggcggaggtggcggaattactcgattagctaatatgtttagcattgatccgccccaacgaacaacttcgcctgcgatatagcgtgggcgagaattttgttgatcgactgtaacgggttttgggaaattaggcagttttgaaataatcttggcaacggtttgatagtgtcgcccaaaatatattgcgatatcctcaagcgtaattaaattttggcttttctcggtcaaattagataacgccgccatttttgccgcattcacaatttcttcttcggctttctgcgaaagtttaattggttccatatttcctccaataaaaaaccgcccataagagcggtggtttgttaatattgttgtgtctgttcggcatgacagattttgccgtcacagtcttgattaagatttagggcgtgcgccatatacaccacaaatgcacacacgagcgtaatgattaatttgttcattttnctgttccattttgtnncggnattttnnagagtgtgaagaatnnccgccgcatggnncttnaaaaaaaagtgcgggtncgggggtaaccgagatctgnaattncggataacat

SEQ ID NO: 145 - DNA, 1056 bp, H. influenzae
ggccagacttggctagccctgcaggtcgactcttaggggatcccccatctaccacgataaatccttcgccgccatttggcacttgggctgcatgaagaacttgtagttcaccttgattgttatgatcgtgataacttgcgatacaaacggtttcaatatgacgaagacccaattctctagccaatacagccgctggaaacaaaccaccgcgactcaccgcaataatacctttccattgggaagctggaagtaaacgttctgataatctgcgggcatgcatttgaaacatatcccaagttaccacatatttttcgctcataattgcaccttagtttaaatttatcgagaaataaaaaattgcgtaaggataacccgaaatggcgttttatgctattatttcgtaaatattttcagtaaaaaggagcaactatgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtggggaatattctcattcgtaaacccgcgacgaaaggaatggaaaatcacacgcctgttgtgctacaagcccatctagatatggtgccacaggctaatgaaggcaatccacatgattttaccaaagatccaattcaaccttatattgatggagaatgggtgaaagcacgaggtaccacattaggagctgacaatggtatcggtttagcctctactttagcggtgttagaaagcaatgatttagcccatccacctcttgaagtgcttttaacaatgacagaagaaacaggcatggatggcgcaaaaggcttacgtcatagctggttacaatctgaaattttaatcaatacagataccgaagaaattggcgaaatttacattgggttgtgcgggcgggattaacgcaaactttgaaattcccgttcaatatgaaaccaatacgtttgagcgcagcgcacaaatcacccttaaggg

SEQ ID NO: 146 - DNA, 1742 bp, H. influenzae
  misc_feature (1645)..(1646): n is a, c, g, or t
  misc_feature (1648)..(1648): n is a, c, g, or t
  misc_feature (1652)..(1653): n is a, c, g, or t
  misc_feature (1655)..(1655): n is a, c, g, or t
  misc_feature (1660)..(1660): n is a, c, g, or t
  misc_feature (1665)..(1665): n is a, c, g, or t
  misc_feature (1671)..(1671): n is a, c, g, or t
  misc_feature (1680)..(1680): n is a, c, g, or t
  misc_feature (1682)..(1686): n is a, c, g, or t
  misc_feature (1694)..(1699): n is a, c, g, or t
  misc_feature (1710)..(1710): n is a, c, g, or t
  misc_feature (1722)..(1722): n is a, c, g, or t
cgagacctcggtacccaatatatatgaaaagtacttgattacaggattattggttttagctggcacagcacaagctcatgaagtttgggttcaagcaccgacgaaattaacatctggttctgtattaaaagcagaattagcttatggggattacccttatgtagaaaaaattcctgaagcacgtttaaaaatttttgcaccaatggaaattattcgtcaagatggagaaaaacaaaccttaatccaaaaaggcgaaaactatcaatatcaatcagagaaagcattgtccgatggttcttattgggtaacagcgacttataaacctactttttggtcacaaaatgctgaaggttggaaaatggataatttgaaagaattagaaaatcccacttattgtgaacaaactcaaatgtttggcaaaagtcttgttaccgttggtaaaaaaccattaaatgcagaaatggcaatgacaagagttggtttaccactggaaattgttcctttgcgtgatcctagcaaagcgaaatcaggcgaaccgttccctgttcaaattttctaccaagatcagccattagcaggcgaaactgtcatcgcaaccgctgatactattatcgtgaaagatcttgaagcaagtacaggtcatcgtgaaccaccaggtttttcaggtaaaacagatagtcaaggacgtgtgaatatcattccattaattgatggtattttggaaaattaaagttattcataaaacaccatttgcagatcaacaaatttgtcagcaatctgcaagctatagcacattaattttaccggttggtaaaggattagctaaactacctccaaaaccagaacaccatcatcactaattttaaaagtgcggtaaaatttcaccgcacttttacatcctaattaaataaaaaatacagaaatagtctgtctaaattctaagttattcatttgcatatccagattttggcagagctttcccatctagatatgccaaattatctttaagtcttaatcgcccttcggtaaaccatttaatcacaagcggataaatttgatattcttgctcacgggttttagcctccacttcttcgatgctatcttcagggaagattggcactttcgcctgtaagacaatcgcaccaccatctacttcttcattgacaaaatgaacggttgtaccgtgttcattgtcgcctgcttcaatcgcacgttggtaggtgtttaagcctgcgtatttaggaagaagagaaggatggatatttaaaattttccctgcaaaacgttgggtaaattttggggtaagaattttcatataaccagcaaggacgatcaaatctacggctaggctttgcaaataatcgccaatggcgtcgtccatttcgaggttattgggaaaatttttgcgaagaaagaccgcttgcggaatctgtgcttgtttggctcgaactaagccgtaagcatcagctttggtacttacccccaccagcaattttgggcggggaaatttgccttaatgggcaggctacaaaaaaagggttgggaaaatttggccctttgcccaaaaaaaagagacggcggaatttttttcacattttctccttcctaaaaaaaaaaaccccccacaggaggggggggggttttnncnaccnntntgccngccgngttttntttttttcncnnnnngttctttnnnnnnccccccccccngcctgtgcgccnccgcgccccccgcccccccg

SEQ ID NO: 147 - DNA, 1423 bp, H. influenzae
ttgcagagattggggtttggactcctgtgcggacatcaacaacaaccaatgccccttcccaaccagcaaaaaagcgagacccttcataagaaaaatccacgtgtcctggggtatcgataaaggttaaattataaagttcgccatcttgggcttaatattttaaagtcacacttgtgctttgatggtaatcccacgctcacgctcaagatccattgaatctagcacttgcgcttccatttcacgatccgaaagtccaccacaagtttgaatcaaacggtcagaaagtgtcgatttaccgtggtcaatatgggcaataatagaaaagttgcgaatattcttcataaaagatagtttttctcaaaaatcattaaatttaactggcggattgtacctgaaaagtgcggaaatcgctagagatgaaaaggaaaagtgcggtcaaattttcaaacttttagataaaacaaaaccccgaataacttcggggtttcttttttttcattcaaactgaaattataggctttcagtgaaagtacgagtgataacgtcgcgttgttgttctggtgttaaagagttgaaacgtactgcgtaaccagaaacacggatagttaattgtggatatttatctgggttatttaccgcatcttctaaagtttcacgacgtaatacgttcacgtttaaatgttggccaccttcaacttttacagttggtgctacgtttactggtaattcacggtattcgatttgacctaattcgctcactgcaacaacttggtcttcagcgaattcgccttttgcacataagcaacgcacttcatttttttcgctgtctaataaccagaatgaattaagcaaattgtcatttgccgcttgagtaatttgaatacctttaatcataatagcctcctaattggcacgaaaataataataaaactgtacaaattttatcaaatcattttaaaatctcaaattattttagatttatttgataaagagcaggttatttttttaattaatttttataaatttgatctaaattaaaatttattaatttttaaataaaacttatatcaataatttaacattaatttaactttttattgaatgagtgtttttgtttataatgaataaaaacttattaataggatagaataatgaaaaactggacagacgttatcggaaaagaaaaagaacaaccttactttcaacacgctctacaacaagttcatcttgcaagagcaaacgggaaaacaatttatccaccacaagaagaggtatttaatgcattcaaatataccgcttttgaagatgtaaaagtggtaattttaggtcaagatccttatcacgggtgcaaaccaagcgcacggtttggctttttcagtaaaacctgaagtagccattcccccttcctattaaaatgtataac

SEQ ID NO: 148 - DNA, 1288 bp, H. influenzae
  misc_feature (1280)..(1280): n is a, c, g, or t
tgtatacgattcggactcggtacccctttggtagagtgggaaattctctaccttacaacccaataaaacctcgcgtaatgtgtcatttactggcactttacaagaaagccaagttgcgccccaatccagaaattgaacacgcatcccattttcattttgtagggttataagctgataaggtgcaccatcaggcgcattaaaagtggtttgttctaacatcattttctcttaaatcactcgcacaccttgtgatgcggtacacacataaaaagtttcttttaaaccagtcgttttctcgtaattatccgcaataattttacgaactgcatcgactttatcatgcggcgtaagtgcgacaatacagccaccaaaaccgccgcccgtcatacgtgcaccgccacttttgccaataacaagttgagccaattcaactaaataatcaatttgtggcacggtgatttcaaaatcatcacgcattgaatcgtgagatgcttccattagtttacctaaacaagtcaaatcattgttcttcaatgcttctaccgcatcaagtactcgttgattttctgttacgacatgacgagcacgttttgctgctaacggagaaagtgcggtcaattctgcttctcttttttggaattgctcaactgaaacatctcgtaatgctttcgcgccaaaaaattttactgcctcttcacattgctgacggcgagtattgtattcgcctgttactaaatcgtgcgggtacgtttgaattcacaataatcacggcgacatcttgtggcactggtgttgaaatagtttcaagactacgacaatcgatcatcagtaagtgattttcctgcccaagcgcagaaattaactgatccatattgccacatttatctttgtcaaattggttttcagccttttgcccattcaatgcaatatccgtgtgagagagcggtaaatcgccaagttgtcggcagaatttacccaccgcaacttctaacgctgcagaagaacttaatccagaagaaagcggcacattaccagaaatcactaaatttgcaccttgttgaaagtgcgggtaacgttcttggataaattttaccaccccacgcacataattagcccatttgtgttcactcttaggaatttcaacattgagagaaaattcatcagtttcatcaagagcgctagctaaacatccaaccagatctctcgttttgtaccagaaacggccgggggatcctataagagttgacgtgcagcgacagtcaagtctgtcaagcttcgtngctagcaa

SEQ ID NO: 149 - DNA, 1102 bp, H. influenzae
tgttatcgaatatcgactcggtaccctgtatattagcaaggcttcgtaaccagatgcttcgccataaccataataaatatcgctaacagtaaataaacgctgcattggcacccgaccgaatggtgtatattggctattttccgtaatcatcaaacggattttatccccaatattcacgcccagtttttgcgccagttgatcaccaatgaccagtttaaactcccctctaggcaaaatttcattaaatttagtctgatcaaaagattcaaccaaaggatcatcagaaaatgattgaatacctataatttgtcctgcacttacgccttttgccgtttgataaatcacatttgttgtattgatcggcacggctttttggacaaagtgcggtaaatttttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaaccttggtgttgttcttccacatcaatagttacttgttcgtatggctcttgttttttaccatcaatatcacgatagattactttagggcgagaaacggcaagctcataaccttcacgacgcatattttcgattaacacggaaagatgtaattcgccacgaccagatacacggaattcatctgggtttggggtttcttctacgcgtaatgccacgttgtgaaccaattctttatttaaacgttcaagaatttgacgtgatgtgacatattgggtaccgagtcgatatcgtataaat

SEQ ID NO: 150 - DNA, 1152 bp, H. influenzae
  misc_feature (148)..(148): n is a, c, g, or t
acccctatgtggaaaagatgaaaatttaatcatctgaaatattaaacatcctaaatcgaaagaagattaccagcctgaagaaaccaaaattgagtattcaatttcaacaataaaaaccaatattgattggcttaatgatctattgtgngaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatttaaatcctttaacttttgaatagcaatcaaaatccctaattacattaaaaatgagagactatagattttgcacttcatctttattataatagtctttcaatgtaatactaaggagaaaaattatggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaatatcctcccccaaatatagaaacccttacagctattgatgaattatatagtggtaacgcacagagctcctttattgagctagtgaaaatattctgccgaaaaatctacaatccattcttaatgttggcaatatgccaaaaaaatcccttaaattagctttccaaaaattcgaagagataactgttt

SEQ ID NO: 151 - DNA, 1143 bp, H. influenzae
  misc_feature (1116)..(1116): n is a, c, g, or t
gagacccctagcgttcttcaatgctaaagcgagtttcagatggttttccttgctcgctgacacgcacaatacgctctccgctagataattcatttttcaaaagaggggcttgaataacttttatatgggattgccattgcccacgtactaacgctaaataatctttttgaacggttttgacgcgaagttgttcgtgcaaattgcgtaatgctgaacgttttttggcaattaataaaatgcctgatgtatcgcgatctaaacgatgaaccagttctaaaaagcgtgcttctgggcgtaatgctcgtaaggcttcaatcacaccaaaatttaaaccacttccgccgtgcaccgcgattcctgagggtttatttaaaataatcaagcaatcatcttcaaacaaaatttggttttcaagtgcggcaactttattgagattttttgaaatcggcgcatcatttttttctgcgacacgcacaggtggaatgcgtacaacatcgcctgtttgcagtttatattctggtttaattctgcctttgtttactcgcacttcgcctttacgcacaatgcgataaattaaacttttaggtacgcctttgagttttgctaataaataattatcaattcgttgtccactttcatcttcactaattgtcagcatttttacggatgaattaatgattttttcattttgttttgtcattttttttccttttgaaaatcggtgcaaatcatatcataaaggcactataaacgtaatatgaacatcactctatgaacgcaaattcgccttgctaattaatcgttttctatggataatagaacgtctttttgcgcctaagaatttgcgtaaaaaaggataagttttgttggtaaaaactcaatgcagcactcggcataagacattgataatcaacatttttcttaaaataaattagccgcttgcaacgcgtgcggaatatcgcgttgttttatcaagcgaatatttatgcttaataacgttatcaatgcacccagcaacatacagtcgtgagattgactggcgcgagaaacacgaggtcgataatgaagcaaagtgcggtttattttgaggttttttaaattttataaggggtctcntagagtcgactgcaggcagcaagctgc

SEQ ID NO: 152 - DNA, 1526 bp, H. influenzae
  misc_feature (629)..(629): n is a, c, g, or t
tgctgctcacaatgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactatnttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgcccgaattactgggtgtgactgatcgcattttagtatgagtaccggtaattagcaggtatcgtgaaagcgcaaaacattcgcagaaaaaatttgcactcgcggcaaatatttataacctaggaatgaatttgagggccttaaaaaaacaatctttgtctttt

SEQ ID NO: 153 - DNA, 1648 bp, H. influenzae
gccagacttgctgcctgcagttcgactctatgaaatccccctgccacataaacatggattcaattaacattaccggcgggcttgacttttccataacatcccataatcgcaatagtaatgcttttgaaatcaaaaaagacttaactataaatgcaactaattcaaaatttagtcttaaacaaacgaaagatttatttgaaaatcaatacacaggagacgccattaattcaactcgtaatctaactattcttggcggcaatgtcactctgggcggggagaattcaagcagtaacattacaggaaatatcaccatcgctgccgaagcaaatgtcacattacaagcttacgccgacaatagcatcaaaggtcataagaaaaaaactctaactcttggtaatgtgtccacctctggaaacttaagcttaactggctcaaaggtggaggtaaaaggcgatcttgccgttttaaacggtgccacttttaaaggagaaaccaatgacagcctaaacattaccggcacctttaccaacaacggtaccgccgacattaatataaaacgaggggtggtaaacatccaaggtgatattaccaataaaggtggtttaaacattaccactaatgcccaaaaaaatcaaaaaaccattattaacggaaatataaccaacaaaaaaggcaacttaaatattacgaataatggtaatgatactgaaatccaaattggcggcaatatctcacaaaaagaggcaatctcacaatttcttctgacaaagtaaatatcaccaagcagataacaattaaagcaggcgttgatgagaaggattctagttcaagcacagcaagtgatgccaatctaaccattaaaaccaaagagttaaaattggtagaagacctaaacatttcaggctttaataaagcagaaattacagctaaagatggtagtgatttaactattggtaacaccaatagtgctgatggtactaatgccaaaaaagtaacctttaaccaggttaaagattcaaaaatctctgctaacgatcacaatgtgacactaaatagcaaagtggaaacatctggtaatactgacaacactggagacggcagtggcaataatgccggcttaactattgccgcgaaaaatgtagaagtaaaaaacaacattacttctaacaaaacagtaaatatcaccgcgtcagaaaaacttaccaccaaagcggatgcaaccattaatgcaaccactggcaacgtagaagtgacagccaaaacaggtgatattaaaggtgaagtcaaattcacttccggtaatgtaaatattacagcaaacggcgacacgcttaatgtatgtaatgctccaggcaatgctgttaccatcactgcagataatggcatattaaccacccaagatagctctacgattagcggaactgaaagtgtacccacctcagccatcaggcgatattggcggggcaatttctggtacacggtaagcgttaaagcaaccattgatttatttacccaagcaaattcaaaaattgagtcaaaacacgcgaaggctatgtatcagtgccacatgttaattggcggccaatctttgcaatactgaatgttacagcatatctggaagtatatatttagggggggcaaagttttg

SEQ ID NO: 154 - DNA, 1607 bp, H. influenzae
  misc_feature (1230)..(1230): n is a, c, g, or t
  misc_feature (1274)..(1274): n is a, c, g, or t
  misc_feature (1320)..(1321): n is a, c, g, or t
  misc_feature (1333)..(1333): n is a, c, g, or t
acctgaaacaattttaccgccttcatttacaatagagaccactgcagaaagagggccaattgcattggctacgtcattagaaccgtgcgcaaatgccatcgcacaagcggttaataacattaaaatactgaagactttttctacggcaccaaaagtgcctttgtttgctgattgagtgaagattttgcttttaaaatagaaatggaagaaaaacattccgataagactgatggcaagtgaaatgattaaagtttcactgtttgaaagatttaagcctacgtgttttaagccttttttcatcgtcacgatacaaagtacaaacacggttatccccatataataagggccatatttttgtgcattttttaatggctgttcagtatcaaaaataagtttttgcgtacttgcaaagattgcataagccaaaatacccgagatgacaggcgtgataaaccagctaccaacgatgctgccaatatttgaccaatctacagaactagggccaatcgtaatacaggcaaatccaataattgcaccaataatagtgtgtataccagaaactggccaacccattttggttacaataaataaccaagcacctgatgcaaataaggttgaaagcatacctaaggctaaaatatcgggtgtatcaacaaattgtattgggtcgattacgccactttttatggtttgtgttacttcgccaccagctaaatatgcacctgcagattcaaaaattaacgcaataataattgcttgtttggctgttacagtaccagatcctacggatgtacccattgagtttgagacatcatttgctccaattccgaacgccataaaaaagccaaaggctgctgtgatccacaccaaccaagaaccatattgactaataatttccatagttaatttcctatgttttgttgattatgaacgcgccagcattaattcaatgcgcgaaccgactcgttgtgcttggtcagccaaaacgccaacccattcaataattttatataagaacattacatcaattggattataacggctttcgatggtgtaaagcattttacgcaatttgatctgcatttggtctgtatcatcttcaattgaatcaagttcttgaatcatatcattgactaatttgagttcacgacctttaaaacccgtttctaatagcttatccatttcttcgattactcggtgggcttgatgaattgcatctaaactacgttntacgtaatgtaagatttcttcctgcatttcttcaggaataccanattgacgaccaatcatacggcctgcaatatctttggcataattggnncagttatcttgntgcgtgactaattctaaagatcagtacgatcgataggtaagaataaacacgtggcaatttaaccgattttcgcgtttaaactactgccccacgttcgcatgagaaatcttaacggttttctttcgcttgttcccaatctttagaaagcggttggaaaaaggatacaaagaacgttcattcggcacttttcaaaaaggtttttgtaccgcttgaaaggcgattggcaataaatccgagaattattcatgcctaaggggatactccaccttagggt

SEQ ID NO: 155 - DNA, 1358 bp, H. influenzae
agttaaaaaagacttggtttcggtttattattaaaacgctatacaaacaatgttgttgatgcgacagaagaacaaattaaacaagccgctcgtgatactattccaaatgtaggccctaatttttgggcatttcgtgcaatgattgcagctggtggtttaattgctttacttacattcggcgcatttgttcaaaatttacgtaataaagtcactcaaattccattattgttaaaagttcttttatggggcttgccattaccttggattgccattgagtgcggttggttcttagcagaatatggtcgtcagccttgggctatttacgagatcttacctgttggcgtatccgcttctaatttaagtacaggcgatttatggttctccattggtttaatttgtgcgctttatcttgcgttcattattgttgagatgtatttgatgtttaaatatgcgcgtttgggtccaagtgcgttaaaaaccggcaaatactactttgaacaatcagctaaataagtaggagataaattatgattgattatgaatttctacgttttatttggtgggtgttagttattgtattatttgattggcttctctgtaactgatggatttgatatgggcgtgactgcacttttacctgtaataggtaaaaaagaagtggaacgccgtattatgatcaacactattgctccccattgggatggtaaccaagtttggttattaactgcaggtggtgcaatatttgcagcttggccaattgtatatgcagtatctttctcaggtttttacattgcattagtattaggcttggcagcgctattcttacgtccattgggttttgaatatcgcgcaaaaattgatactccaacttggggcacagtttgagactggccatttttcctaggtgggtctgaccacgattaattatgggggccgctcttgaaacttcatacaatgcgctaccttgccttcacactacgactgcactctttcatcgcctacattcccctaatccatctgctcctatctgttcctcctctcttaccaccccaaacaatccatttctcctcctcctttttgttctcctgatccctcctttgcacccctccccctcgcgcacgtttcactgttattgtccgctatctatcctcagctgcagcaattagcgccatcacctctataccacccgctttcttcattcccccagccctgccccaccccgtccactccacactatctgcctgtccatactctttccatctatctatcacacgttctacctactgcaccagcgactccctacaagcggtacttaacttgtctccttctcctttcaccatccctcacaactcatcacc

SEQ ID NO: 156 - DNA, 1246 bp, H. influenzae
ttattttacccgtatagccacgtagcgatgatgtgacaacacaccactgtgataactagctcgtgaaatcacttcgtatcgctcgccgtcaaatagcactactgcgacattgtgtgcattttctccagccaccgttagtttttgatcggtgtaaatttttaccgcacttgaaacgcgccgcccctgcattgataccactaggcgatccatttcagcactgcttaacggctgaatggatgccattaacgtctgctcgatttcgccgtcgtttacccacttgcctttcacatactctccgtcagaacgcacaagtattttataaggcttgcgaaaagaagattgagaagaaaatatctgcatcagatttcaaccttataacgaattgaattgactaattgcgaggtatctacgagcggtttactacttttcttgcgcctacgcgtagatggtgcattcggtgtccaaggataagacgttagggtctttttctgcttgtcttgataccattgcccaagttttgaaagctcttgcaccaaatcatcccctttcgccacattctcgaccacacgccctaagtattgcgccaatgcctgttggttgtcttcaaaggtttgacgaataaaaggacgagacgggatatgtgccgtgccatattcattccaaataccgatatccaccaagctttcgcctgattcagaatgaatgcctgcatccgcttgaacgcctacttttacgcgtgctttgccgattttgtttatcaactcaagttctttttcaagccctttattgttgatttttaccttaaccacgctagacacaatgactccctacggtaatcgcaccaaggcgcacgcaaatattgtttagctcgttatactttgccaaaaagcgttcagcgttgccgcctttatcgctgcttgaaaaaattcacgttctaaacggcctcacgttcacgttggaatccctgccgcatttaccccgcttttcatcggactgaggccaacaaataagccgcataccacggccaccgccttcattttgctttctatcagataaacagtctggaacgtttatttatcaagccacgcttaacacctttattttccatatcttcaagactttggttggcttacgggggcacaaaaaacaacgaacgagtctgcccctcatttattacttctgcgttttatcttttggcgcttttttctccatctcccgcttctggggttccttaatatatcgctcg

SEQ ID NO: 157 - DNA, 1438 bp, H. influenzae
caaagctccggtacctccgattttatggaacagcatagtaaatagagggactgaattattgtttgataaagattatcacctattgcccagataataagaattggtcataggttagataggcttggttgtttagctaattatcctgaagcattagtgaaatatagactacatggaaaccaaacatcatcagtgttataatcataagcaaaatgaggtatctaaaaagataaagggggaaaatattacatattaccttaataagataggtatagatataaaagtaattaatagtgtgtcgttgctagaaatatatcatgtggataaaagtaataaagtgttgaaaagtatactttatgatatgtatatgagcttagataaatatactataacttcactcttacattttattaaatatcatcttaaattatttgatttaaagcaaaattttaagattataaaaaaatttatcagaaaaataaatgttatgttttagatggagtgttcagaaaggggaggaacaaattccaagtttgtctaggactaaattctaatttagtcctttaaatttatcttagataaacgataaatatatattttaaatgagtttaattataaaaaatcagtgccttactaagttaaggcactgattaatcatattagactttaatgctattagttatagcacagaaacatttaagttcgagccgccaccaacaatacgaactcggcgaccagctacaaaactgctgtcagccttttgaacaacaacgatctcttgaccatcatcttttttaattacaagttcagcaccgtttacttgacttactttctcttcgattttgcttccagctactgcaccaccaatcgcaccaactactgctgcgataacttgaccacgaccaccgccaattgcactacccgcaataccacctaacgcaccgccaccaagcgtaccaattacgccttgattatcagcttggatcttaacaggacgcacagaaacaatcgtaccataagtaattgaacgagcttcctttgcttgagatgcactatacacatcgccactaaaaatatctgtattcgtacatccagccacactaaaaatagttaagatagctaatgctagtgttttctttttcatatctatatccttaatttaagaattaaaatggatttcttggcgaaaatgatgaaatattctttacttggctattattagacaccgtcacacaagccccaatagcaagagttgaatcatacttatgcacaataataacttcctctcctttctgctggttaccagaacaatcatttttacgaatagttaatttaagattttcgccttccatttggctaaaaacgatttgacctttaagcattttcatcttttttgaaaagaagaacaagcactcagggtaccgagtcgatatcgtataaa

SEQ ID NO: 158 - DNA, 1676 bp, H. influenzae
  misc_feature (1581)..(1581): n is a, c, g, or t
agcgagcatttttgattatctgaaaaattcaattatcgtctaacacggaattttttctgtgccttatcaactttcaacaaataattgcgtgcttgtgatgatgggtgaactgtcgttagaatgcgataaacttgttctggatacatttgattgattttgtaaatcgccgtatccttatcattatcaaaaacacgtaacactgcgcctgcaccactattatatgcagaaatcatggcgaaacgttttgaggttggattcgtaattccatctaaatattgattttgtaaaatccataaataagacacaccagcatcaatattattcgcaggatcatataaataacgcgttgatggctgcccacctttgcctttcattgcaaatacatctcgacctgctgtatgaggcacaacttgcattaatccaatagcatttgcgtagctaatcgcatatgggttaaaacttgattctgtttgcataatgcccaaaatcaaactttcatcaatgccataacgttgtgcagctttacgcaatcaatggtaaatattttcgtgcacgcacttctacgtggtttgcaatcataggaacagaaacaaattgcacggtatgcccgttttgtaatcgacgtgtttgcaatttattttgaatcaaataagtggcgaaattacttgcgataacttgattagcaatttgttgcccttgatgatctacaacctgccccaaaagaaatggacgagagctaatcggcacatcgccagaagtaaataaatcaataccttttgcatccgctcccattaacaaggtatgaacaatagcattatgtaatcgatttaaatcttgctgggtttcaataacgatattaccttcatcaaaactcacatggctacgcgtataaaaagaatctgtatatttcacataatctttacggcttgccactaacaattcattgacgccccaaattcggtcaatattatgcgagaactgccctgtgagaatatctaacccttgcgtgtctttagcaaaggcttcatcatagttaataccttgattcgatgaattactacaagcatacaaaaaaggcaataatgccaataataaatattttttcattgtaggatagataactaatttgatggtggaacataaccttcaatatgaacatctttaccttcaaacaaaaaattaaccatttcttgttctaataatttacggtgctctgcattcatcatattaagttttttttcattcacaagcatcgtttgtttcttaatccattcaccccaagcctgtttacttactgaatcaaaaatacgcttccccaactctccaggataaagttgaaaatctaagccttccgcttcttttttgagatattcacaaaatactgttcttgccataatgattcccttacaaattgtataaaagatttttcacaggcctgagcccagcccgatcggttcaggattttgggggatcataccaatatttgaccgcacttgataagggttgattgggacttcttttgggctttccatcactttttcggccaggctaaatatagccggctctacgcattaagggctnctccatttcaacatatattggagtgaaatctaaaagaaaagggctaaatgcttggccgaaaaccgggccattttggataaggcccggctttttct

SEQ ID NO: 159 - DNA, 1318 bp, H. influenzae
cgaaaacttggccagaataaaaagcgtatggccttgagactgccaagttttggccgctctttttatttcccccaccttattttttaagcagattattaaaaatctcctcaaatatctggcggagattgctcttgatttccacgattttgattgttattccatccattattattggatgaatttcccggctgttggtcgttgctttgccctggtttactccaaggatcgcgatctgaaccgttctgtgacatttcattctccatttgtcaaaaaattgttaagagtttagctaaataaatggggcacgtctatgaaaatataaggctttttaggcaataaaaaatccttgattttatataaggatttttttgattaattcacttcataaagaacatatttttcaagttcttttatctgtaaactttctctattccattcataaaagtgcggtaatttttcttgatgattgacaaaagcggctaaataaataggaagttcatcagtaaaccacaactgcccctgcggacaataatctgaaaaaattttttgttgttcaggaaaatgacgaacattggataattttacgatcccaaatccttgagatttcaataccgcctctcgcaaacaccaacaacgataaaaagcgttcaaagaatcctgctgatgatgaaaccaatcaatttcttcttttggtgcaatatgctccatcaacgctgtaaaatttcttattttaggaaattcaatatcaattcccaccgcacttttttcttcttttctaatatctaatattaccgccacccaatcaccagaatggctaatattaaaatctattcgctcatcaagaaaataaggtctgccactttcagtacgatgaatttgagataaaagtgcggtggattttcctgctatttttagaagttggaaaagtaataaatgcgcaagccgacgacactgatgacgctgaaaaacacgggagctatccgtttcaatttgatatagattttctggaatcagttcatcgggtaaggattccaaagaaaaaggttgatttatattgccgtaggcgatgtaggttgtcataaaataaaagcaccattcaaaggtgcttttatattaaaaggatttagtttgtgtgtaaattagcgaatcactaattccgccacagaaacaccgaccaagcaagcaacaacaaccccaattaaacctggcaccataaaactgtggttaaaataatatttaccaatttttgttgtacccgttacgtcaaagtttactgttgcaatatctgacggataatttggaattgagaaaatagcat

SEQ ID NO: 160 - DNA, 1113 bp, H. influenzae
tatggggaaaattaccgcactttttgtactgctgcgcgtgattggcattggcaagggtgccattttcaaatactttctcctcacaacgttgcgacacgagctgataatccccattcttgtgtgattttagtcgatgatggaaagaatagcgttttgctaactggcgatgctgaagcaaaaaatgagcaaatttttgcccgcactttaggcaaaatcgatgtgttgcaagtggggcatcatgggagtaaaacatcgacaagtgaatacttgctttctcaggttagaccagatgtagcgattatttctagtgggcgttggaatccgtggaaattccctcattattcggttatggaaaggcttcatcgctataaaagtgcggtagaaaataccgctgtttcggggcaagtgcgggtaaatttttttcaagaccgattagaaatccagcaagctcgcacaaaattttccccttggtatgcgcgtgtaattggattatcaaaggaataaaaggtacaatgcgtgcaatttttactattagatagcgattatgcaagagcaaaaattacaagaaaatgatttttcaaccttacaaacttttaaacgtttgtggccaatgattaaaccttttaaagcagggcttattgcttcaggtattgcgttagtttttaatgcattggctgattcaggcttgatttatttgttaaaaccgttgttggacgatggttttggcaaggcaaaccattcatttttgaaaataatggcttttgttgttgtgggaatgattattttacgtggcgtgactaactttatttctaattattgcttggcgtgggtatcaggcaaagttgtcatgacaatgcgtcgccgtttatttaaacatttaatggttatgccagggagtttctttgacagaaattcaacggggaaattactttctcgtatcacttatgattctgagatgattgccagtttcttcttcaggatcttttgataccattgtgcgagagagagcatatataatttccctattggcaaggatgtttatacaagctggggattacccctcgtttaatttgtaaccggcccattattgcagggtggtacccatcgcccaaa

SEQ ID NO: 161 - DNA, 1505 bp, H. influenzae
  misc_feature (1458)..(1458): n is a, c, g, or t
  misc_feature (1460)..(1460): n is a, c, g, or t
  misc_feature (1469)..(1469): n is a, c, g, or t
  misc_feature (1472)..(1472): n is a, c, g, or t
ctggtatacgaatatcggcctcggtaccctggctttagctggctgttcaaatctacttggtagcaatttcacgcaaaccttacaaaaaaatgcaaatgcaagttctgaattttatataaacaaattagggcaaacgcaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtcccaagatatcattgcgcaagcaaaacaagcggggattaaaaccttagtcggcccattactaaaacaaaatcttgatgtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaatncnccggggatnccntagagtcaaccgcgaggcatgcaagtaaaaggc

SEQ ID NO: 162 - DNA, 1496 bp, H. influenzae
  misc_feature (1392)..(1392): n is a, c, g, or t
aatatataagtgctgaaagcatctaagcacgaaacttgccaagagtatgagtcatccctgactttaagtcagtaagggttgttgtagactacgacgtatataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcgaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttaggtaatctatgatttggatattttttgtcatcgcactttccttggtacctggattgactctatatgccaatccgttattaaagcagtttaaagctcacaaggaattggatgctaaagctaagaatactgggntatacgattaaagagagcttgatttattgctcgtgcatgcagactggagaatgtaattttctgaagcggaatcgccttacaagccataaggctttttaaagaat

SEQ ID NO: 163 - DNA, 2238 bp, H. influenzae
  misc_feature (1728)..(1728): n is a, c, g, or t
  misc_feature (1749)..(1749): n is a, c, g, or t
  misc_feature (1846)..(1846): n is a, c, g, or t
  misc_feature (1997)..(1997): n is a, c, g, or t
  misc_feature (2038)..(2038): n is a, c, g, or t
  misc_feature (2072)..(2072): n is a, c, g, or t
  misc_feature (2127)..(2127): n is a, c, g, or t
  misc_feature (2204)..(2204): n is a, c, g, or t
  misc_feature (2209)..(2209): n is a, c, g, or t
  misc_feature (2211)..(2211): n is a, c, g, or t
gccttcttgctgcctgcggtcgactctatgagacccccttatgttttaggctattattacactgctttaaatttaattgagcattttattcattcttatattgcttggtgtgtatggtggttagtacgtaatacgatttaccgtggtattacggtttcttctcgtcgtttagcacatcgccgtttatcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaataagggggaaattatggcaggtaatacaattggacaactttttcgtgtgacgacctttggggagtcacatgggattgcattaggctgtatcgttgatggggtaccgccaaatcttgaattatctgagcaagatattcagccagatttagatcgtcgtaaacctgggacatcacgatataccacgccgcgtcgtgaagacgatgaagttcaaattttatctggtgtgtttgaaggaaaaactacaggcacaagtattgggatgatcattaaaaatgctgatcagcgttctcaagattatggcgagattaaagatcgttttcgccctggtcatgcagactttacctatcagcaaaaatatggcatccgtgattaccgtggcggtgggcgttcttcagcgcgtgaaacagcgatgcgagttgcagcgggagcgattgcaaaaaaatatttacgcgaacattntggtattgaagtccgtggttntttaagtcaaatcggtcatgtgaaaatttcgccacagatcatcggagatattgattgggaaaaggtaaacagcaatccattcttttgccctgatganagtgcggtagataaattcgatgaattgatccgtgaacttaaaaaagaagagattctattggtgcaaaacttactgttattgcagaaaatgtacctgtaggattgggcgagccagtatttgaccgttagatgcagatcttgctcacgcattnatgggaattaatgcagtaaaggcgtcgaaattgtgatggtnttgcagtgggtgacaacgtggttcggaacatcgngatgaaatgacacctaatggctttgaaagtatcacgcaggcggcttttaggcggnatagtttaggacagccattattcgccgattgcgtaaaacaactcagtatacatttctggcgttcaataatctatgcnagcantnaaagtgggcaaagtcgtccgatcttgg

SEQ ID NO: 164 - DNA, 1297 bp, H. influenzae
  misc_feature (528)..(528): n is a, c, g, or t
  misc_feature (530)..(532): n is a, c, g, or t
  misc_feature (538)..(538): n is a, c, g, or t
  misc_feature (541)..(541): n is a, c, g, or t
  misc_feature (543)..(543): n is a, c, g, or t
gcctgcttgctgcctgcggtttgctctaggagatccccgctacaaaaagctgcgggaaaaacgcccaagtaaatttcaagctgttctacaccttctgatgccacttgaataatgcttgaggtggattgttgattcacttggttaagcggcatagaagccaatttacgatagataaggctacgcaattcatgcttcacttttgtgctggcaaaataagacgcctgcacagattttttccctgcaaaagcacgcaatgccaatgctgcaatcaaaacgatgcccaaaatgaccgcacttaacaggctcaatttgtgaaaataagccgcctgtaaaatataagaaaacacgacggcactaataatcccgccaactaacgccacccaattccacaacaccgtgacgccaatccattttttgctgtcagccaccgtgttaattaggcgtttatctatcatcataatgattactcctaaaataaaaagaagtacgcatagaaagaattatacgtacttaatgtagggtgggctncnnnaccccnacncnccctcccccccctcccatccagcctttgtcttaagctacccccactgccgccgcgcccccagcctcgcgcgcgcgggctaccctcctcggcgccctcctctcccgcgctcgcccttctgatcattcccccgacctcccgtttcaccctttcccactcgtcctcccgcttccgctccattcccccctatcccccccccttccatgctactccgtccgtctaccgccgtcttcccccctccccgatcccgctcggcgcctcccaccccctacttcccgtcccctgcactctcccccacccaatcctctttcccctcccgcctctcccctcgtccccctctcccgcatcctcctttccccccctgttcctccccccccccctctcccccgtcctgcgtcgcccatccttacacccctcccctcgcccccgaccccccccgcatgctccccccccctctcctcccccctcgtccctcccccgccccctttcccccctcccttcccttcccctttccctcctcccgcccccccttgtcccccccatttccccccccccgcctctttttcccccgcccccttcccccgtaaccccacctcctcccctccccgctcccccgtccccgcctttctctccttcccgccccccctttttcccctctcccttatccccgttccccttccccccgtccgccccctttttcgccttccctccccttctccccccctctcttccccctctttcccgccccctcccccc

SEQ ID NO: 165 - DNA, 1640 bp, H. influenzae
ctggtatacgaatatcggactcggtacccattgcttggattattaaaagtaaaggtcgtaatttaagtgatacctatttagtagagcatagttttcattttgatgaagagcagaaaatgttcccttttatggatgagcttagtttaggggattattctttcacgacattacaatattctgcacaagcgattcagtttaatgaagatgacgaaccttatttcttggtaaaattagagcaagaaatttcattagaaaatagcgaaatttttgaacaagtagaacgttttgaaaaattggctgaacaattttcgggagagtatatcggttgggaatgtgattctttactggatagcaataagccattgaattaggtgtttgaaacattcataaatcataaaaaagagagagttatctctcttttttaatgtaatttaacttttctgcgtattttgcgcattaataaaaatacccacggccatagtaaaccagaagcgaatgcgcctaagatggcttgccaatgaaaaaaggcagtatggagtgaaaattcaactaagaaaataagtaatcttataatgaagacgaaaagtacaaccaataaactttggaaccaaagtgataaatttcgcagaattaaatagtttttggcaatgatgtacatgctcgtagaaagtacgagagcgtgaacgcctaatgtagagcctaatattaaatcccaagttaatccgagtaaaaatgaccagcctatacttactttattgggaatagctaatacccaataaagtaatacaagtacaagccacgcaggctttagcatttggaaaccaactggccaaggtgcaagttctaatacaaaggcaataacaaagaagcttaaaatagtgaaccattgtaaaataaatcgtgtttgcattagtcttctatcctttcttcttgctgttctatgggaagatcttcttcattttgaagaaaatctgttggaatatctggttcaataatggttttttcttcattttctagaaagtctttttctgttaagggtgtttttttcactctataatttgcttcattagcttggctttctaaacgtttttgcaccagattgcgaacttcttctggcgacattgattttacttttgatatatctaggttacttggccaaagtaaaagtacataacgtaaacgttctaataaagctaaaggtttagctttaactattgcaaagtaattagagctatcacgcgaaacgctttgtacaacagctacgggatagccttcaagaaaacgtccaccaagcccagaggttacgagaagatcgcctttttctatatcaacggaacgaggcacgttatcgaggcttagttcatcggtatgcccagtcccactcgcaataccacgaacatcatttcgtagaacttgcactggaattgagtgtgttacgcctgcgaagagcagtactcggttagtattcttgcccacggaaataattggccaatgacgccttttttatccctgacaggctggcactacacaagccccgtcttttttcgctctgtttacaacaatcttgtgggcgaataaacccgcgctctgccccagacctcctgtcactttctgtgtccatccgcccccacgcgcgatcg

SEQ ID NO: 166 - DNA, 1567 bp, H. influenzae
gcctgcttgctgcctgcggtcgactctatgagacccctgcgtaacttgaacgcgtgggcgctgaggcaatcaagataacgccatttttaaccgcacttttctcttaatgcagccgaaatcgatttgacggcgaccgcgttgcggaatctgacagattaagcgcattatcacattaaagcgcggttaaaaatggtacacaaacaaggagccaactatggcaactatcatcgtaaagcgtgatgcaggttcacgcaaattcaccgaaaaaggcgaaattttacaacgtggtaaagcgggcagattagaaagaatgttcgataaacaacgtcgcattaatgccgcgtttgaaaaaatggtggtaaaagaaagtgcggcggatcgcgcaattaaatttgcagccaaccgccaaaaagagcaatttatcgacatagccaactaccactgctgcaaaggtaaacctgctggtacaaacaccgtgcacgcagtgcagaagcgcagactaggggtaagagaattaatacgatagcctcggcttgagccttacaagcataaagaaaggcactctattctagacaaaatcagcatagactgattgcactactccactgaccgctcgaaggggcggttttttaagggtatttaaaatgaaaaataaaatcacagacttaaacaatcatttattttcccagttagaaaaactgcttgatgaagacttaaccgatgaagaacttaatcgagaaattaaacgtgccaatgccgtatcaggcattgcggcaaatattatcgcaagcaatgcgatttcgcttaaagcaatgacattgtttgaaaatcgtcaaattgataagagaatcccctgattttctaagaatatctaaggcgcaaggcgatgacctctaatgcggaacgatttaaattcaccgatgaacatattgcgtttattcgcttacattgggataaaaagccatctgatctaattaaattgtttcagcaacagtttgatttattaataaatcgtaatgttttctataaattaaaaaagaaacacaatattccaagccttaagcatgctaatcgttacagcaaagaagaacttgcgttcattaaagcgaattgcacgttaaatgaaagaatcttggctcaaaaaatggaagtttatttcaataaaccatttaatccacacgcgttaaaggttttgcgcgtgaagagacaatggctaaccggacgaagaggtcgatttgagaaaggtgaaaatttcaaaccgattggctttgagcgatattgtaaaaatgcaaaatgttggttaataaaagcaagcattaaacgttatgaacggaaatcgcattatctttggcgcaaatccggtataaacattcgcgttgacatattattgattaccaagacggcaatttaagaaattgcccccttggaaaatttcgaattaatttcacgggttgaaaaggctttggccaaagaaattacggttcccccactccatgattgaaaaaaaccccctttttccgcttttggaaaactacagaaggcctaaattcaccgcaataagaaaaat

SEQ ID NO: 167 - DNA, 995 bp, H. influenzae
  misc_feature (873)..(873): n is a, c, g, or t
  misc_feature (885)..(885): n is a, c, g, or t
  misc_feature (893)..(893): n is a, c, g, or t
  misc_feature (986)..(986): n is a, c, g, or t
cccctttgcgattcttaaaaatagattattgattatttacgtcagaaagggcggtttgttttagaaagtgaacttgaagatgaagataccaataattcattttttgatgaaaaggggcattggaaaccagaatattacccgagtgaattacaaggcgaagaagaaactgtgtattccgatgaattttggctgatttttgaaacttgtttgacttgtttacccgccaaacaggcaaaagtttttatgatgcgagaatttttagatctttcatctgaagaaatttgtcaagaaacgcatttaacttcgtctaatttacataccaccctttatcgggctcgtttacagttgcaaaactgtctttcaaaaaaactttaggagaaaattatgcgttgtcgccaagccactcgaatgatttccgaatcgcacgaacgttcattagatatacaagaaaaagtagggctaaaagtgcatttagctatgtgctcgcgttgtcgtcgttttcaaagaaattgcaaaaccttaagtatgatgatgaagaaatttaaagattcacattaagagtgatgaaagtattaaaaaatccgctattttgaccgcactttatagcggtatttctaacttatccatacggcattttgtaatctcaaaggttttatttcttcagcttcgccaataaactcactgcgcccacaattataactgcaccgagccaaaaatagagggtaaggcgtatgatgccaaaagagccagtcgaaaacgctagagaaaaccacgccagtgaaagcaaaagggagtatgatttgggcgggtgcgtatttaaaagcgcgcgtgagtataatggaaatcaatccgaaccgccaccatagtatagcnagctcgataatnaggatttncattggtataagaagatgtacatgacgtccatcgagaataaacgatttttggggtggggattggtaatcttgagcataagcatccgctaacgnacgaatcaa

SEQ ID NO: 168 - DNA, 1056 bp, H. influenzae
  misc_feature (1029)..(1029): n is a, c, g, or t
gattcggctcgtccccacactgatgagtcattgaagatgctggatttgacgccacagagtaaaaaatttcaattcagattggtgggatggcctgccaatcttgtgccaatcgcattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcacattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcgcattcatcaataaaacaactaacaaggagtaaaaatgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagagtaaaaaatttcaattcagattggtgggatggcctgccaatcttgtgccaatcacattcatcaataaaacaactaacaaggagtaaaatggggtctcntagagtcgaccgcaggcagcaagctgc

SEQ ID NO: 169 - DNA, 1445 bp, H. influenzae
  misc_feature (1337)..(1337): n is a, c, g, or t
ccgttttttttgattcgtttgaagataaacgataacgacctacaccagagtgcgtatccaaataaaaaaagcctttttctttaagtttaaggttttccaaaataagcattaagacgatatgttttaagacatcagcatgattgcctgcgtgaaatgagtgacgataactcagcataatatatcctttgttttataacgaaggcgagccaattgactcgcccgatttcacactaaagtgcggtcatttttagaagagttcttgtggttgcgtcgctggcgtattgccttcattatttaagcgttgctgtaactctgtaggaacgtaataaccacgctcttgcatttccgaaagataggtacgtgtcggttctgttcccacaataaaatattctttgcgcccaccgtttggagaaagcaaacctgtcaaagtatcaatgtttttttccacaatttttggcggcagtggcaatttacgttcaggtttatcactcaaagccattttcatataagtgatccaagctggcatggctgttttcgcacccgcttctccacgcccaagtactcgtttgttatcatcaaacccaacataagttgtagtgactaagtttgcaccaaatcccgcataccaagccacttttgaactgttggtagtacctgttttaccgcctatatcgctacgtttaatactttgtgcaatgcgccagctggtgcctttccagtctaaaccttgttcgccataaattgccgtatttaaggcactacgaatgagaaaagcaagttcgccactaatgacacgtggcgcatattctattttcgacgaggcattttttgcagcagccattaaatcaatcgcatcttctttaagtgcggtgaaatttgattgtaattctggcagttcaggcacagtttcaggttgttgatctaattcttcgccattggtgctgtcatctgttggttttaaggcactctcgcctaaaggaatattggcaaagccgttgattttgtctttggtttcgccataaattacaggtatatcattacattcaatgcaagcaattttagggtttgcaataaataagtctttacccgtgttatcttgaattttttcaatgatataaggttcaatgaggaaaccgccattatcaaacaccgcataagctcgcgccatttctaatggtgtgaaagaggctgcgccaagtgctaaggcttcgctagcaaaatattgatcacgtttaaaaccaaaacgttgtaaaaattctgctgtgaaatcaatacctgctgtttggatcgcacgaatagcaatcatattttttggattgacctaatcctacgcgtanacgcatcgggccatcataacgatcaggcgagttttttcggtgccacatttttgtcccggtttttgaatgaaaacgggctggcttgtatacctaaaagccgtaagcctt

SEQ ID NO: 170 - DNA, 1187 bp, H. influenzae
  misc_feature (1020)..(1020): n is a, c, g, or t
ccccacacaattattacggaagaacaggcgcaattgaaggcaaagaaggcaaagatagcgatgtacaatggattattgatccgctagatggtactcgtaattttatgacagggcttccccacttttctgtgtctatcgcagttcgtgtaaaaaatcgcactgaagtcggggttgtttacgatccaatccgcaatgaattatttactgctgtgcgtggcgaaggtgcaaaattaaatgaagtacgtttacgtgtagatagtaaacgtgaacttcaaggttcaattttagccactggttttccattcaaacaaccaaaattaatgccagctcaatttgcaatgatgaatgccttaattgaagatgccgctgatttccgtcgtacgggttctgccgcattagatttatgctatgtggcgtcaaaccgtattgatggttattttgaaatgggcttaaaagcatgggattgtgctgctggcgatttaatcgtgcgtgaagcaggtggtttagtttgcgattttgatgctggtaacggctacttacgcagtggcaatatcattgctgcaccatcacgcgtaattaaagaaatgttaaataaaattcgcccttgtttaggtgctgaatttaatcattaatttttataagcacaatagcacctatcaaggtgctatttttaattttattaatgaaacatacttgattagcgactttatctgcgcatcaacgaaaaaaacgacgacattatgcttccagaacttggctttttccttcttttactcgcaacagctagcgcgttttttcttgcgttagtgcctcaatttgggttgttcaaaaaaaattcgactttaattaatgctgcttggccgcttagttatatttttacccttgcgacgacgttctcaatttggtttgcttacttattctttctgcggggatgatttcaccccttgatatgtagcggcacattccaactctcaatacctacattttttaaagtggctgccacttggggagacatgaagntccatgttggttttggtatttcattgagttatggctgctgctttgcttttttatcaaaaatgacgacttttcgctcatcttatctttatgggatagatgcctttggtttcggggttatttatttattccatcctttgacccttttcctgctcccaaaggggcgattc

SEQ ID NO: 171 - DNA, 1279 bp, H. influenzae
  misc_feature (1063)..(1063): n is a, c, g, or t
  misc_feature (1248)..(1248): n is a, c, g, or t
aagaaaaacttgccatcaccattagaattaatccccatttcagttcttttgctgaaattgcgcctttttgaatgccacgtaatggcccaatacgttcttcagtatctgaacctttttgatgatccccataatcattggcaaaattagaaagcacctgcaataaaattgtcgtgagtaaacaaagcaccattacaagcccattaaaaccttgtggattcgcccaataacctaatgccgaacccgtgaaaatcgatgccaacgctaagggcaaagttttcggtcgagccgtttcccaccacattttcaatttttcatttatcattttttttgaccgcacttttgattacaataagccgcgtattctacactaagacacccaatttatgaatgatttaaccttatcgcctatcgccattatccacacgccttataaagaaaaattctccgtaccacgccaacctaagttagttgaagacggagtaggcattgtagaactcttaccgccttataattcgcctgaagccgtgagaggattagaacaattcagtcatctttggttaatttttcaattcgaccaaatccaacaagggaaatggcaacccaccgtacgccctcctcggttaggcggtaatcaacgaattggagtgtttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcacaatcgagctttgctcaagaaaaaccaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggaacaagtttgtacgaatttaatgtgaaatggcgaattaaagcgggtacggnaaattgtgtagaatggattgaaatagaaaaagacaaattgtgtattatgtatataggcagggaatccctcgccctacggcattcataggcctattctacgaaatccggctttttttttgttttgtatgttcccccacttattgcctctctcccttttctcaccccggttgtatttattccgtttnaccatttgctctattagctggtcatttgtta

SEQ ID NO: 172 - DNA, 1517 bp, H. influenzae
acgtatcgcgatcttcattatcttcagccataaaattatgtttacgtgctgcttcaattaattctgaacgttctgctgacaagggatctaagcctacatattcttggaaaacaaattggtagcttaaactttctgcaggtggacaatctaaaatttgttggagcaaatcatctacttcattaattaaacgatgcatatgaaagtgcggtcgataccattccaacatagtaaattctggattatggcgatttccagcttcttcattgcgaaacactttactgatttggaatatcggcccactccctgctgcaagcaagcgtttcatatgatattcagggcttgtagaaagccaaagtgttttggattgttcaccgaaaggcgcaagaaattccgtgctaaaggtggagagatgtaaatcagtgacgccaaattcacttagaacaggggtctctacttcaagcaaaccgcgttctgtaaaaaattgacgaatttcagcaataatttttgcccgtttaagaagattttttatatcggcagaaggttgccaatgattaagtgcggtcatttttaatcctgttttaaaaattttgcacattgtaaacgagagctactctcaactcaatcttagcttttttgaggtagatcacaaaatacgatcttttccatctttagacataaaaaacgttattaatttgtaacaaaaaatggcacaatgcccacacaatattacccttttaggggatttatttttactttctattgattggaggatatcgtgcaaacagttaatgtcgatattgcgattgttggtgctggtggcggtggtttacgtgcagcgattgccgcagcagaagcaaatcctaacttaaaaattgcattagtttctaaagtatacccgatgcgtagccatactgtagcagcagaaggtggtgcagcggcagttatcaaagaagaagattcttacgataaacacttccaagataccgttgctggtggggactggctttgtgagcaagatgtagtggaatatttcgtgcaacattcccctgtagaaatgactcaattagaacgttggggatgtccttggagccgtaaagctgatggcgatgtaaacgtacgccgtttcggtggaatgaaaattgagcgcacttggttcgctgcagataaaacaggtttccacttattacacacgcttttccaaacttctattcaatatccacaaatccaacgttttgatgaacacttcgtattagatattcttgttgatgatgaccatgctcgtggtatggttgcaatgaacatgatggaaggttcgcttgtgcaaattaatgccaatgcggttgttattgcaactggtggtgggttgtcgtgcatttaaatttaataccaatggcggcattgtaacaggtgacggcttatctatggcatatcgtcacggtgtaccacttcgtgatatgggagtttgttcaatatcatccaacaggcttacctaatacgggtattttaatgaccgaagg

SEQ ID NO: 173 - DNA, 1569 bp, H. influenzae
  misc_feature (1310)..(1310): n is a, c, g, or t
tcataccaattaaaaaacgtgttttacttgcaccaatggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattggtataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatgggataaggcgatattcttttattaacaaaaagattgaatgtttttcattctattntaaaaattagccccaagtaatttgaatttggggctaatttattattacaatttaagatcttcgatgtgcatttttcataatgcgatcttttgttactttccattcccgttccttaatatcaatcacgttatcctgttggtttttacctttggctaaacggattttgactcttgcccccccctttttcattaacgacaagggcctctttgtgacaccgctctgcttgcttccgccgatcggttgcttcccgccccgtttt

SEQ ID NO: 174 - DNA, 2021 bp, H. influenzae
  misc_feature (1545)..(1545): n is a, c, g, or t
  misc_feature (1551)..(1551): n is a, c, g, or t
  misc_feature (1874)..(1874): n is a, c, g, or t
  misc_feature (1884)..(1884): n is a, c, g, or t
  misc_feature (1901)..(1901): n is a, c, g, or t
  misc_feature (1911)..(1911): n is a, c, g, or t
  misc_feature (1926)..(1926): n is a, c, g, or t
  misc_feature (1931)..(1931): n is a, c, g, or t
  misc_feature (1933)..(1933): n is a, c, g, or t
  misc_feature (1952)..(1952): n is a, c, g, or t
  misc_feature (1958)..(1958): n is a, c, g, or t
  misc_feature (1966)..(1967): n is a, c, g, or t
  misc_feature (1971)..(1971): n is a, c, g, or t
  misc_feature (1974)..(1975): n is a, c, g, or t
  misc_feature (1978)..(1978): n is a, c, g, or t
  misc_feature (1982)..(1982): n is a, c, g, or t
  misc_feature (1986)..(1986): n is a, c, g, or t
  misc_feature (1992)..(1992): n is a, c, g, or t
  misc_feature (1994)..(1995): n is a, c, g, or t
  misc_feature (1997)..(2001): n is a, c, g, or t
  misc_feature (2003)..(2003): n is a, c, g, or t
  misc_feature (2007)..(2007): n is a, c, g, or t
  misc_feature (2016)..(2016): n is a, c, g, or t
tgataaaacttgacgaacaccgctttcaagcgtaacattcgcccgattttttaacgagaaggacacacactttggacagtcatagtcgataccgaatatcgctctagacgctcgccttttattatcggcgtgcgttcgccggtaaatttaccgttgtttcggcatctcttaacgaaaactttgcgattttttaccgcactttcgtttcttctttaatttgttcactgttagctgttcataatcctataaggagtatgaaatgatcaatgcgtttgctatcaatgattcccgcttggttcgtattgacgaagaccaaactgatctcaatactgccatttggcttgatttacttgagccgacaggcgaagaacgtgaaatactacaagaaggcttaggtcagagcctagcatcttttctagaactggaagatatcgaagcttccgcccgtttctttgaagatgaagatggtttacaccttcactcatttttttattgcgaagatgaagacaattatgctgatttagcgagcgttgcttttactattcgtgatggtcgtttatttacgttgcgtgatcgcgagctacccgcattccgtttataccgtatgcgttcacgtagccagcgtttgttagaatgcaattcctatgaagttttactggatttatttgaaacgaaaattgagcaattagcggacgtgattgaaaatatttatgcagatttggaagagttaagtcgcgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcactgagaaatcttacgagatattgaatctttgcaaccgcataatgaatcattattccaaaaagtaaactttttaatgcaagctgcattggtttacatcaatattgaacagaacaaaattatgaatatcttctcggttgcttctgtgatgttcctttctgcaacattacccgcgcttacttatggcatgaactttgattttatgcctgagttacattttaaatatggctatccaatggcaattggattaatgatcgcagccgcactgacaccatatatttattttagaagaaaaggatggttatgatggaattatcccaaaccgcattatttatcggatcaattattaatctttacgcacttgtagtaatcttacgagcttggttgcagtttgctcgtgtggattattacagtcctgtttcaacatttgcagtcaaaatgactgatccaatattaaaacctctgcgtaaaattgcgcctactgtgaaaaatatcgatacttccgcattactgcttgtatttattattggtatgttaaaaggtattatttattttggcttatcagtaaatgtactcttagtattgggcgtattaactgtattgaaaagcattggtttagctattttctatgtgctttttattgnggctgntttaagttggtttaatcgaggtattaattttataagttatgccttttatcaactctccgaaccccttttaaaacctatccgtcgattcttacctacattaggcctgattgatttttctccgagggccgttggatttaaccttaatacttctaaataaatccatcccgggatcttctagggggacttttggctttttgcctgcttataaatttttatgcccctatctgaccatcggccttttataaattttttttatattttttcttgggctatactcttctttttttatctcctcccttttttatttcctgtttttctaggcncttgggttcntccttgtctttcggctnccttttttgncctcgtttttttctnctttntnttttgtctttcgtctcttntgtccncttttttnncttntcnntcngccncccnctgccncnncnnnnncngccncccctctcncccgg

SEQ ID NO: 175 - DNA, 1591 bp, H. influenzae
  misc_feature (1534)..(1534): n is a, c, g, or t
  misc_feature (1551)..(1551): n is a, c, g, or t
cgatgtccaagtggcatagccttctaaaccaagaccaaagtgcggtgctaattctgatttaaattcggcgaaagttaaataacggcgtaaacgcagttctaaataatcgctttcgatgggttcaatatcgtggcgcatttggcaatagccgtttaaggttgctaagttttctactgaataacgttctgccagttcagtttgattttgttcattggctaaatttgccattaagaaatggtgtgcgttctctaagaattttttatcaaaaccgctgtgggtgttgaaaatgcctgtttttgcctgttcgtgtaaaaattgtgcggcgcagatgttggcaataatcattgcttcttccacaatttgattggcaatgcggcgatattctgctttgatttcttgcactttgccgttttctgccagcacaaaggcataatcgggtttttctttaaagagtaaggaatgggttttgtgccattgaatgcgggctttggtaaattgatgtagccagtgaatttgttgtgctgtttctggcgtttctggctgccatgcattgtctgcctgttctaaataatccgacactttgttataagccagtttggctttagattgtacataagcggaaacaaaatgcggtttggctgtgatgttgcctgcaagatcggtttcgatataacagacaagtgcggggcgggtttcattggcgattaaggaacataattcatcggataattcacggggtaacattggaatgttaaagcccggtaaataatttgtgaagcaacgctgtttggcttcttgttcaatttgagaatctaaggcgatgtaagcggttgggtcagcaatggcgaccactaatttccagcctgtttgtgtgctgttttgtgctatgggttcgatatataaggcatcgtccatatccattgtgctttcggaatcaatggttacaaaatgaagtgcggtcagattttcgcgtgttttttgatctaacatttcataatgttctgcgccttgcacgggatagcgcgattgttcgtggcgtgccaatgtgacccaccaaggggctaattcatcgtcagctcggcaaataaactgattaattgtggcgtagaaaaagcgatcgtcacgtaatggatgggtttttaaatttgcgacgacccagtcgccctcttgcaattcttcttttaccgatttcgcctgttgtgcaccaatgggttgattaatgcttgggtgatccaccagcacttgtactttcttgtctttattgaaccgcacttttgcgataaaacgtgtgagcattggctcaattaaagcttctggctcggcttgctctttgtcgccttgcttttcaataggggctttgattttgtcgcccgcgcatcactttttttattgaaggcgttgcgaggttaagggttttatatcgccctctaataaaccgaaggctttttctgtacttcctaccacccctcgcccttgtctatgcttttcggggttttgacgttaagtttttccagtgccagacctatccataccnccattttttggtctggnttaatacacccctctttcattctaaaagcccatttttcac

SEQ ID NO: 176 - DNA, 1139 bp, H. influenzae
  misc_feature (1057)..(1057): n is a, c, g, or t
  misc_feature (1071)..(1071): n is a, c, g, or t
  misc_feature (1127)..(1127): n is a, c, g, or t
gcagcttgctgcctgcggtcgactctaggagacccccattactacgcctccaatttttagtggtgcgcgcactttaagtccgccaatattattaaaaattgccgtcacggtataagatttcgtctcagcaaaaccttgtacattagctacgcgtaaacctaaaaaaactaaggcaccaataccaagtaataaaaataacccgacccaaaattcatatttaattgtttgtctcataaaaaatccttaacttgcgccaaacataatagcagtcaaaataaaatctaatcctagaacaacaagtgaagcgtgcacaactgttcgtgttgtagcttggctgataccttctgatgttggcatacaatcataaccattaaaaagtgcaatccaagttacggctacagcaaagaaaaccgctttaataaagccatttaaaatatcatagctccaactcacggaattttgcataacagaccaaaagctgcctgaatcaacacctttccaatccacacctactaaggaactgccccaaataccaatcgcgataaacaagattgacaaaattggcatggaaataacccctgcccaaaaacgaggtgcaatcactcgacgtaaaggatcaacagccatcatttcaagactagaaagttgttcagtggctttcattaagcctatttcagccgtcaatgcagaacctgctcgaccagcaaataaaagtgcggtaacaacaggccctaattctcgcaaaagagaaagtgccaccaactgacctaaacttgtttcagcagaaaaatcaactaatacgacataaccttgtagtcctaataccattccaataaataaaccggacaacaaaataatgagtaacgattggacacctaaaacatgcatttgcttcacaagcaaaggaaaatgcttacgaatttgtggcttgccgatcaatgcaccaaataacataaagcctgctcgccccaatgcacggaaaaagtcgatcacctgttttcctaaagcagaaatataatttgacgatcattcaaacaattccttcatataatcttgncgctgggtacttanagcgcacaggaccatcagattaccttttaagaatgcaccacgcgcgatcttggctntgtaaagcgcca

SEQ ID NO: 177 - DNA, 1586 bp, H. influenzae
tgttttcgaatatcggactcggtaccccatggaaatgaattaattttgacaaaattgtaaatgaaaaaacaatttttaatgataaagatgatgtaaacaaattagaagaaatggcaaaaatatacataaccaatcagaaaattaatagtttataacaggcaacccaaagtgcggtcaatttcaaaaaggtttttaaaattaaccgcactttcattccattctaaaaaaatcctaaataaatattatttataccgttttttcaccgtacttttatcttgctcacgtaatcgttctagtttttccttaatctgaatttccatacctctattcgttggaaaataatattgagtatcttttaattcaggtgggaaataattttcgcctgccgcataagcgttaggttcatcgtgagcataacgatattcagccccatagccaagctctttcattaaattagttggcgcattgcgtaaatgtggtggaacatcgtaatcgggcaaatctttcgcttgctgttttgctgtgttaaatgcagtataaaccgcattactttttggcgctactgcgagatatataatggcttgggcgatggctctctctccttcataagcccccactcgagtaaagcaatcccaagcagccaatgcaacttgcatagcacgaggatctgcatttcccacatcttctgaagcaatggcaagtaatcggcgcgcgacatataaaggatcgccacctgccgttaaaattcttgcataccaatacagtgcagcgtctggagcagaacctcgaacagatttatgtagcgcagaaattaaatcatagaaacgatcaccttgtttatcaaatctcgcttgacgttcgcctaagacttcttttaataaagtgtggccaattgtctttgcattttccatttcatctgccatatccaccattaatccgaggcaattcaaggctaatcgtgcatccccattaacacatgcggaaagcacttgccgcccaaattctcctatagttaaccgttctttaccccatcctcgttcaggatcttttacagcttgttcccccaccttgttgcatgtaccctgctgtgaccgctctccttacatcctctcggcctccagaagggcttcgcactattcatccccccatagctaccttgggcctgttgaccatattagctgtatgttcccgtttcccgctccctccactcccctcccgctgtcttttcttcaaccgcgcccccctgcccattccgcattttttatgacgcccccgaacccattttttacactcccttttttgtggcgcggcccgctgaactatcctgtacccgccgccccccctttttcttaccgctgccccacctcctcctcgtcgcgtcctcctcgtttttacgcggccgtgtatctctgtgttatatctgattatttctctccttctcatcccccctccattctttctctcgccctttcgcctatttttttatcccctcttttgttcctatctctcgcgccgctgttcttctcgcacctcgtccgtagtagttattttcagcctgctagtcgattaccctcccagtcgcttcg

SEQ ID NO: 178 - DNA, 1211 bp, H. influenzae
  misc_feature (16)..(16): n is a, c, g, or t
tggtatacgaatatcngactcggtacccgttttagtttttgcacttcatctacaatttttaatgtggaacttatggtttctttaataggttcggcaagtggcatattgtaggcaaagagcaaggtcgctaaggcaataaatgttttattacgataaaattttatgccaaatttcaccgcacttttgtactgaagaaaaattaaaataggaatggcgaaagcaattaagtaactactcactggaatttgcaatagaaattccttcgtttccaatatatctgtcgcgaaaagcgaggcgatatattgatagcttggagggccaaaatttagccccgtaggtgtataaaaagcatgcagtaacgtaagaggtagcaaaataaaatagaaggattttttactgctgcttaataagagaatagttattgtcgcaagcagaataagatctacagttggttctgtaaacatcccagaaccgattaaaataaaataacccgcgaatgcggcacaaatcaccgcaaaaagtgcgggcaaaatttggcttgtttttttcgtgttcatcattgtcttccctgaaaagaaaatatcgctattatccacctttcactcagaatttccatatttaacttcttcactcttgagcggttattttatagaataagccaatttttttaagccagaaggaaaaaacaatgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcggtgtcgttcttggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaaattaatgtccgctttccaattaaatggtatttgcgatacttataactggtctgaagcaatcaaaatgttacgcgaaaaacgcgtagtcattttctctgcgggaacgggaaatccatttctttaccactgattctaccgcttgtttgcgtggtattgaaattgaagctgatgttgtgttgaaagcgactaaagtgatggggtaccgagtccgatttcggtacca

SEQ ID NO: 179 - DNA, 1865 bp, H. influenzae
  misc_feature (1495)..(1495): n is a, c, g, or t
  misc_feature (1646)..(1646): n is a, c, g, or t
  misc_feature (1677)..(1677): n is a, c, g, or t
  misc_feature (1738)..(1739): n is a, c, g, or t
  misc_feature (1752)..(1752): n is a, c, g, or t
  misc_feature (1754)..(1754): n is a, c, g, or t
  misc_feature (1757)..(1757): n is a, c, g, or t
  misc_feature (1769)..(1769): n is a, c, g, or t
  misc_feature (1772)..(1773): n is a, c, g, or t
  misc_feature (1788)..(1788): n is a, c, g, or t
  misc_feature (1800)..(1801): n is a, c, g, or t
  misc_feature (1803)..(1803): n is a, c, g, or t
  misc_feature (1811)..(1811): n is a, c, g, or t
  misc_feature (1813)..(1813): n is a, c, g, or t
  misc_feature (1827)..(1827): n is a, c, g, or t
  misc_feature (1833)..(1833): n is a, c, g, or t
  misc_feature (1836)..(1836): n is a, c, g, or t
  misc_feature (1839)..(1839): n is a, c, g, or t
  misc_feature (1847)..(1850): n is a, c, g, or t
  misc_feature (1858)..(1862): n is a, c, g, or t
tccccccggtgtccgggtctccaaaaacccccgcaatatatttcagggctttcttgttttttcccgtaatggtttaaccgagtcgcatatcaatggcaccttcgggacataaatagagcagggcccaatcccggctaataaacgttcttctttccccatgaataatattatgtgctccaggccgagtttgtttcactaacgcccgcagcctgttcacttgctgggttttttcaaataaggcaaggggtggtaccccctgatcgacttttcaattcgcgtatcgtcgtttgccacgacaatttcaattttctctttagccatatatcactctcaaactttcaaatgttgtgttttcattatgtagctaatctacacttatttttgtactagtaaactagttcgatatgttttttttagaataaaacctacgaattccctattaaactatctttacaactctcttgcaagctgaataaaacgaaataattaagtaaataaaagataaaaaaataccgcacttttgtgctgtactctcgaaattaatggctacttaatacttgtgcaggttgtaatttagcagctcggcttgctggataaaggcttgccattaaactcaatgcaagtgctgcaactaaaaccatcaaaacatccaaccaatgtaactcgcttggcaagaaatccacaaaatacacatcgcccgataataatttcttaccgataacccactcaataccttgaataaaggttgtaagatttaatgcaagtataatgcctaacacaattccaattaaacaacctttcattcctgcctgtaagccataccaaataaaaatacgtttgataaacgcattattcgccccaagcgtgcgcataatggcaatatcgccctgcttatcttttaccgccataatcagcgtagaaacaatattaaaacacgcaacaccgatcacaagcaccattgcgatatacattacggttctaataagctgaatatcgcgatacatataaccaaatttactaatccaattttgcatatatagcatctgcggataatcattaagcattgataaatccagatttctcgcagaaaaaggatcatctaatttcaattcaacacctgtaatttgatcaggttgataagtcaaaaaggtttgtgcttgagcaagcggcaataaggcataactataatcaagctgaccatctaagcgtaaaatagcggtaacttgcactggctcacgagttggttgagcaaattgttcatcgccgttttgctgagaaataagcaaggtaatccaatcccctacttttacatcaagttctttagcgatacccgctcccaagaccaatccgccttctttctcaaatttgttccaaccttgctcttgtacaaaattgccaattgaacttaccttatcttctgcttgtttttcaacacctttgacctgaaccactttcaattttgagccattttctaccaatgccggaaagctaacanaggagagaatcctttaatttgggggattttggtggagggcgtttttctaaattttggcaatgatgaaatgggggatctttcgcgtgggtgcgcagaaaaaatgtgaatgtgcggggcgacggggcaaatcccgtggttaatcttacggctncatcccttgctcgcccttagggccccatttnagttggggcccccctggcagtccgttgggggagaatttgggtttaccgcgcttaggggatnntttgggggcccgngngcncccgccgcgtcngcnnccggggtgtttgtcngcccctcttgtnngnccttctgntnttctctccgcgcgnaccctnccntcncccctccnnnnggggcttnnnnnggg

SEQ ID NO: 180 - DNA, 1320 bp, H. influenzae
  misc_feature (1205)..(1205): n is a, c, g, or t
  misc_feature (1210)..(1210): n is a, c, g, or t
gagaccccacattgcggttacttcttcatcagttaatccataagatggtttaatttgtattgaagcctgtacttttgtcgatttttccatcgctgtaacgcttaataaaccatctgcatccacttgataagtcactctaatatgggctgcccccgccgccattggcggaatacctcgtagagtaaagcgtcctaaagaacgacaatcatcgactagctctcgttcgccttgtagcacatgaacactcattgccgtttgcccatctttaaaagtagtaaactcttgcgcacgagccacaggaattgttgtattacgtggaataattttttccactaatccgcccatcgtctcaatgcctaaggaaagcgggacaacatcaagtaataacatatcagaatcagttttattcccgactaaaatatctgcttgaattgcagcaccaagtgccacaactttatcaggatcgattgaggttaatggtgttttaccaaaaaactcgccaacttgttctcttacataaggcacgcgagttgaaccaccaaccattactacggcttgtacttcttcggattccacattggcatctttcaatgcccgacgacaagttagcaatgaacgttttacaagcggataaattaattcattgaattgttcccgcgaaatctctactgaaaaatcttgccaagaaataaccgcacttttttcattagtcaaggtaattttagcttggttggcaagggttattagctcacgctgttgatttgctgtttgtggttttagcttagtttgttctattacccaatctgcaattaaatgatcaaaatcatctccacctaatgcagtgtctccccccgttgctaaaacttcaaagataccttttgataaacgtaaaattgaaatatcaaatgtgccaccgcctaaatcataaaccgcaataatgccttcttgcccactatccaatccataagcaagtgcagctgcagtagggttcattcaataaacgtaatacatttagcccagctaaacgcgcagcatctttattgctttgacgctgagcatcatcgaaataagctggaactgtaatcacaaccccagaaagctcacctcaggggcggtgtctgcaatgggatttaagcgcgataaatatctgaagcacttaattggacttttaggcccctgtgcggataaattaagggatccatttnactcngccaattctaggcaactagatacgagatgactcaggagctgcacaatagcgtttatgaatacgatttttggacaggaaggtgctaaagctttaacactttttcttaagct

SEQ ID NO: 181 - DNA, 1827 bp, H. influenzae
atatcagactcggtttctccgtcaacgtaacattgttagcttgcctggatcctcaagtaagccaacttgctttaacgcttgccccgattttacaagaaacgaatctcaatcaagtatttgtcacctctttattgccgacttcttatacggatgcggaaaccgtgacgaaacttgcgggacaaacagcccgtttattaaatggtattccattagacgaagaagaaactcgcttagcctttgatgtttatccgcatcaagcacctaatttatcgaatcaattacaacgaatttttccgcaattagatcgtgctacattccactcaatccaagtgcctgtattttatggattggcacaaaaagtcaccgcactttcagattatgatttcgactatcagcctcaaaatagcgagcttgtcgctttagaagaaaccttaattacgcctgtgcttaatggagaacaagaaaatggcgaagaatcagtaaaacttcatttaagtcaaataagtgcggtagaaaatggcgtagaattttggtctgtggcagatgaacaacgctttaatctcgctttactttcagtgaaattgttggaaggaatttatcagcaaggttattaatgaaattaaggagaatagtatgcaaaatattctatttatatcccatccagccccttatggggaatggaagctgccaaagtattaaatttttaattttctcgatagctaaaagaaaaccccgccacaagtgcgggatcttttttgcttattttgttgcagctttcatcgtttgaacaaattcagctaattcagctaaacatggctcgtgattatctaaatttcgctcaataatttttactgttgccgaacctgaaattgcaccagccgctcccaaagctaaggcttctttaacttgtgcaggctgtgcaatgccgaagccttgtaaaattggcggggcatagtgggctttaagttgttctacaagggtatctaaatttgctgcgtgagcttgattttcagcactggttacgcctgcacgtgagactaaataggtatagccttcgctatttttcgctacgccttgaattgttttctcatccgcatttggcgggcaaataaagacgggttgaatgccgtgttttttggccgcttgtacataatcttcttttgcgagtaacggaatatctgctacaagcacagcatcaacaccaacttctgcacagcgttgataaaaagcatctaaacctttagcaaaaattaaattggcacaaagtaataagctaatcggaatctcgggatattttgaccgcactttttccaatagtttaaagctatcttcactgctatgacctgcagttaaagcacgattattcgcggcttgaataactgggccatcgagtagcggatcggaaaaaggaaaaccgagttctaaagcatctgcaccgttatccacaagtgtgcaaatgatctcaaaagagcagtcgaaagtagggtcgcaaagggtaacgaacggcacgaaagccccttcattttttgcgttaagtgtcgcaaattgcgtttcaaaacggctcattagttcgttcctccatttaaaattttatcaacagtaaaaatatctttatcgcctcgtcctgaaagattaaccactaaaagttgttctttttcaggattttgtttaatcaatttcaaggcataagccaaggcgtgtgagctttctaatgcaggaataatgccttcgtgttttgccaattcttggaatgcgttaagggcttcttcatcggtaatcgatacatatcaggcacgaccatgggtaccgagtccgaatcgtatacca

SEQ ID NO: 182 - DNA, 1910 bp, H. influenzae
acggtttgcgcaaactgtggtgcataagtttctgggaacgcataacctaaactaccgccattcgcacccgataaataatctttagaatattttaaagccgcatcagcaaaagttgttttacctgcaataatatcagaacgaattttagctaattgtttttttgcttgagcatcatttaacaatggattaagttttaacaaaatgtgacgcacttcgtattctttacctgtaactttttgtgcagtgccttgtgattttgcctcatccaacattttttgaccaagtgcaaccacttcttcacgcgttacatcaatactttcttgaatagctttgttacgtacagcccccatcaccatttgattggcaatttgctgacggaatgtatttaatgaaatgccttgataatctaacgcatccaaaaattgaccataagttaagccatttctagctgcagtgtcttccacaacacgatcgatttcacgaggatcaattttcacaccagattcttgaatcgctttttgcactaaaagatcatcaataattttatcaagtgcactttggcgatcgccttttttacccatattggcacgaacttggctttctaaaataggaataccatctactgtcgcgacaacacgttcctccgcttgtgccatagaagtaaaagcaacacaacctaaagtagccaataaaaaagattttagaataaattttttcattttcatctcatcaaaaaagagtccataacgttggttagagtaacaattctattgaaggttcacaatagataagatttatttccctagaatagcaacttcgtaacagccatcttgtttttcagtacgaacttgtacaagttcatcacggcttgttggcacatttttacctacgtaatcagcacgaatgggtaattcacgatggccacgatcaacaaaaatcactaattcaatttttgcagcacgaccaaaatcagtaagcgcatccattgccgctcgaatggttcgaccagtaaacaacacatcatcaaccaaaatgacggttttatcttgaatattcaaatattgtgatgaaccactataaactggcattttatcttcctgatcaaccaaagttaaatcatctcgataaaaggtaatatccagttccattgaaggtaaatttataccacttaactcttcaactcgacgttgtaataattctgcaatttccgcgccacggcgtttaattccaacaataacaagatcatctaaggtttgatgtttttcaataatttcgtgagaaatacgcgaaattgtgcgaagaaaacgatcatgatcaataataattttttccatttttcccagctttatcaatagtatttcaatgcacaaagtataaagaaaatacgcctaaaaagcgacggcatttgcaccatgtttcttgttcgttatactatccaaaacattccatcaaaggaaataaaattatgcactactctattcaagattttattcaactcatcgcccaacttcgcaatccaaatggcggatgcccttgggatttaaaacaaaattatgaatccatgattccttgtttaacggaagaaacttacgaagtaatcgaagccattgagaaaaaagacataccaaatttacgtgaagaattaggggatttattgttgcaagtcgttttcttcagccagcttgcaacggaagataaatactttacttttgacgatgtgttacaagatatcgctgaaaaaattgtacgccgtcatcctcacgtgtttggtgatgcaaaagcgggggacgaaacagaagccctttcccgttggaacgaaatgaaagccaaagaaaaacaaggtaaaagtgaagaaacctctttttagatatggccggggtcctttagatcgactgcaggcagcaagctgc

SEQ ID NO: 183 - DNA, 2143 bp, H. influenzae
  misc_feature (1954)..(1954): n is a, c, g, or t
  misc_feature (1985)..(1985): n is a, c, g, or t
  misc_feature (2101)..(2101): n is a, c, g, or t
  misc_feature (2108)..(2108): n is a, c, g, or t
  misc_feature (2134)..(2134): n is a, c, g, or t
aatagccccgccagatgtacgggatccctaatgctccagggccatattagggaattccttccagccgtaagaaaaaggtcacctccccggcatccaggttcggaacaacgggaaagcaagggaattgggttagccaataaagtcaccgttccaagaataaaattaacaggaataaccgcccaatgatggaatggatgaagcgtatattcttaacttaacccttggaatcctttagattttattgtataaaaaagaattaaaaagaaaccccaaatggacatacccaaagttgcgctaatatctgctgtcggcactgcacgaagataatgaataccgaacaaacctgcaaattgaggtaagaaatcaacaggaattaagtcgatagcattcatgatgaatacccaacagaaaattgttaatgcaagtggcgcaactacgttacgtggaccatgaaaattttctttcacgattccattaacccattccacaacaatttcaactaagcattgcatttttcctggaacgccagttgttgcttttttccctactcgagaaaaaacaaataggaaaataaccgcagcaagaatagaaaagaacaacgtatctatatgaacattccaaaatccatcccctgttttgagaaaggataaatggtggctaatgtattccgatgttgtttgtccagacataatcgatcctttgttctgaagaagaataacccaaagttaaattttattgagaataagtggaataatattattcagcactaatgccaataaaaaaccaacaaaaaacgcaataaaattgataacgaataaccatttgatggcaataatgataaaaaccatcgttaaaataaactttattgcttcagcacgataaagtgcggtcagttttgttgaaaaattttgttttctgtaaaaaatgataaatataaatgtacaaaaaggcaaaaaggcacttaaaaaaccgtagctaaaatctaccgcactttggcgttgccatccataaataagcaaataaaaaactacaagcaaaagactctcaataataatagcttttctgtagttttttttagcgtgagataaaatgcgcgacatcacttttacaaaataattttagcccgccgattatacctttgctggctttagattcaacttaaaaacacataaaaagtgttatataaatcacacttttagaaaataatttatctatttgttactttttaacgtaaaacgattaaatgtcgttcgcctataagttcaggaacagataattcaatcactttttgaatagtatattttttattcaattcattaatttcatcttcctgataaatcccttttaatgcataaaaatatccattttcttttggtaaatgatggcaccaatctgtcatatcttttagtgaagcaaaagcacggcttaatacaccatcaaatttatcttcaggttgatattcttctactcgacttaaaacgggggttacattagttagtctaagctcacgtatagcatttcgaataaaactaatacgcttacctaagctatcaaggaggacaaattgtttggaaggattaataattgccaaaggtaaaccaggcaaaccaggccctgtaccgacatcaataaaacgatcaccttgtaaataaggacttacaacaagactatctaaaatatgtttaactaacatttcttgcggatcacgaactgacgtcaaattataagctttattccatttattgagtaaattgaccagattaatcaactgctgaatttgttgatcacttatttttatatttgcttgcgcaagtaaactgactaatttggctttcatatttattatctctttgaaaaattacgctattttacttaaaagtgcggtaaatttccttaatgtttttagtaatttgatgaattatttaccgaatcaatgtccagttttacaccatanattgaatgcacctccgcataattcatttcanaggctttaattgcttctgttcaagaaccaaagaatgaatgttcgctaaaaaataagtttgttctgcttcaggaatgggaaatggcattaacttgagtaaatcttgatgaatagctnaaacttngtggaaaatgaccgcactttgcattncttcgagct

SEQ ID NO: 184 - DNA, 1908 bp, H. influenzae
  misc_feature (1462)..(1462): n is a, c, g, or t
  misc_feature (1484)..(1484): n is a, c, g, or t
  misc_feature (1897)..(1897): n is a, c, g, or t
tagaaaaacacgggggttatcgcgggaggcgaaagaaaagaagagggagggaagctggcgaggaaaaaacaccccattagaataataggatatggggtgcggcccccccaaatggggaggactctctatgtgggtgctcgaatagaaaataaatcgtttccccggtaaccaaaagggtatcgccgtcctggttcccgatttgtatacattagtattgatcacgattttcccacaaatcatcccatttgtgccaaatctattgataccataataaaaagtgcggttgaaaaacattaaattttttaaccgcacttttatctttctcgtaagttacatctgccgtaccttacaatacaaaaaggtgcaataactgcactttatcaacgcctattcaatgccgtttaatgaatagaaaactgtaaacacaactcaaaatggggtttattatgaaactaaccaaaacagcattatgcaccgcactttttgccacctttactttttcagcgaacgcacaaacttatcctgatttgccagtgggaatcaaaggaggaacaggtgcattaattggcgacaccgtttatgtgggattaggctctggtggcgataaattctataccttagacctaaaagatccttcagcacaatggaaagaaattgctacatttccgggtggcgaacgtaatcaacctgttgcagctgcggtagatggcaaactttatgtattcggtggtttacaaaaaaatgaaaaaggcgaacttcaactcgttaatgatgcttatcgctataacccaagcgataatacttggatgaaacttcctactcgttctcctcgcggtttagtaggatcaagtggtgcatctcacggagataaagtttatattttaggcggctctaacctctctatatttaatggcttcttccaagacaacgttgcagcaggagaagataaagggaaaaaagatgaaatcgttgcagcttacttcgatcaacgtccagaagattatttctttacaacagaattattgagctatgaaccctcaaccaacaaatggcgcaatgaaggtcgcattccattctctggtcgtgctggtgctgcctttacaattcaaggtaatgatctagtggttgtcaatggcgaaattaaacctggacttcgcaccgctgaaacccatcaaggtaaattcactgctaaaggtgtgcaatggaaaaacttacctgacttacctgcgccaaaaggcaaatcacaagatggtttagctggtgcacttgcaggctatagtaacggttattatttagtcactggtggcgcaaattttccaggttcaatcaaacaattcaaagaaggaaaacttcacgcacataaaggtttaagcaaagcttggcataacgaagtttatactttaaataatggtaaatggagcatcgttggggaattaccaatgaatattggctatggtttttnctgtatcttacaataataaagntttactgattggcggcgaaactgatggaggtaaggctttaactagcgtcaaagcaatcagctatgatggtaaaaattaaccgtcgaaatatttatcacagaataatgcataaaaatttataataatcaaaagcgggcgaaatctatcgccgctttatacaaaataaaagtaattaaaagcaaaattacacaaattttgaccgcactttaaatgcgctataaagagctggcatttttattaatagaattaaacgatggtatttattccaccaccactactcttgttattcattgcataacaatggatttttttgccaaagattgctagttatttctgccatttttaaaggatgggttttggaattccccttcattttttgatggctttaccgcgcgtatccattctttattgtnaaaacctctat

SEQ ID NO: 185 - DNA, 1595 bp, H. influenzae
gctcggttcccctttcttgttgcaccgcctgttggcaataaatcaccttgagaagttgagcagccagtcaaaacactgcttgcggctaaaatcacgcccatcatcattaaaactttcattattgctccttaatccaagttagattgtcttgaggcttgtccgtatttcacttttcgagacatgcggtcataatcaatatcaatttgtttttcgatgtgtacagccacttctttacccggtggaacatataccgcatcaaacatttggccataacgctgacggaaccagtctgctgtttctctcaaaccgccacctaacgcttgaccaagaatatacttaccgttattacccgttaccgcaccaattactgcaccgccatcaaccactgttgttgattgagaagatgataagccttgtgcagctgctgaagcccccgttaagaagaagttggtcgttagatattccggagcatttgttctgcgttctccaggaatgcaaggcacaccatgtggatcagataaccagccaattttatcgtcagaattgtctgttgaaacaatgcggccatcgctaaacacaaaagttaagcttttcacatcaccacgaacacaagatagcgtccagtcaccgcttgctgttccagagacaattgcgccttcaatatccggcagttcaatgccatttgcaattaagttatctcgaccaataagcaatttaaacggataaggctcggttaccttattgtcaatcggcacacgcccaacaagcgcagtcatagcaacagaattagttaaagtagagttagctgcaattgtgaaaaatggtgtagcggtattaaatattgcattattacctgtactagattgcaacccatcattagattttcggatgtcattcacattgttatcgaaggttttgggaaaaccgattcctgcaccatttacaccaataccttgtagagcattcccttgtctgtctgtagttggcatatcactagggttcacccaattaattccccctcgagtttcaacctgagggccagttgttgctccgtttattggtagaggagcattgggatttgcctgggcatttccattccctacaacttgattaccagcttgtacaacctgatcttttaacgcattaatctcattaattaacgcccctgtttctgcttgtaccgcctgttgaatttgataatccgtattgtttgcttgattttttaactgctcattctcttttaccaagcgttcattttgtaaaatcacttcatcaaatcgcttattatgctctttcactttacctataagtgttcttaccgtatctttagatgtgtcaccctcaatccccattgctcgtaattcttccggtgataaatctttaaaagagatatctaaagtatcttctttcttggtttctgctgtatttgttgaactactaccggagaaaagaaatccagccatcagcgtcacgacaagagcggtaatcccaccaataacatagaacgctttatttgctttcatttgcattggccgctcccttatttgtttgaagtgcactgtttggggggaccttttttaattttttcggttaac

SEQ ID NO: 186 - DNA, 1271 bp, H. influenzae
tgtttacgattcggactcggtaccccttttacatttcatcaataaaagattgatcaagttttcaggctggtttaaggcggtcattcgatataatctggctttgcttacaccaagttgatcattatgttgctcgtgataagtattaagtgcggttaaaatttgctgcgttttttcttgtatgtaattagtattaaaacaccaatcttgataacgtacggcgtctcgctcgacgagtgctttatctaattgcaaggaagtcagttgttccgtccacattaattggcgtgctgttgtcgcattatgtttaagggtaagcgcaatacgttgcgaagcgttctctgccaatgctaaattcgctaagaaatttaaccgcacttcagtgcgtttatgacgttttggcgagttaatttccaatactcgtgcgccggcaattaaggtttttgtatcgccactgcgtaaaataagtttgtctccaaaagccaagaataatggtgaatccaatatgatttcagctaaagtgcggtcattttttgcggcattttttccctgtaataaagtgagtttacccgtagtgcgacttgcaccgtgataaatatgcactggttggttttcatttaatggtacttcagccaaaatttgtacactgatgcgatctgttggtggaagtggctcattctgcaataaccaatcacctcgtttcattgatgtgcggtctaaatcagcatttaaatttaacgctaaacgttgccccgcaataccttgttcgcttgatgtattttgtgcgtgaatcgcttttatacgaactttctgtccagtggaaaggtaaatttcatcgtttactttcactgttcctgaaaaggctgtgcctgtcacgacggtacccgccccttttacgttgaatactcggtctattgcgtaacggaaaggtttttgggtatcagataattcaggtagattagctaagtaatgacgtaattcattaattccttgtcccgtttctgctgaggtaacgaagtaattagcaccacgtaaaaaactataattttgtttaatttcttggattaacgattctatttgcgctgaatttgcacgatctgcttttgtgataataacaataattccgcggaattgaagttggcgtaatatcgcttaaagtttttttgtttgcgttcgcaccctttcatccgagggaccattaacatgcatatgcacccaccttattctgcccgctttttggcaggaatttttatgcccggcacataataagccca

SEQ ID NO: 187 - DNA, 909 bp, H. influenzae
ctgttttcgaatatcggctcggtactcttcactcaaaacatattaagggaaaacctatgtctgagattttaaaaaatgacattgatccaatcgaaacacaagattggttgcaatcattagattcattaattcgtgaagagggcgttgagcgtgctcaatatattgttgagcaagttattggtcaagcacgtacaagtggtgtttcattgccaacaggagttaccactgattacgtgaatactattcctgtggctgagcaacctgcttatccaggtgatcacgccatcgaacgtcgtattcgttcagcagtacgttggaatgcgatcgcgatggttttacgcagtcagaagaaagatcttgatttaggtgggcatatttccactttccaatctgcagcaacaatgtatgaagtttgctacaaccacttttttaaagctgcaacagagaaaaatggcggcgatttaattttcttccaaggccatgcagcaccaggtatgtatgcgcgtgctttcttagaaggtcgtttaactgaagaacaaatggataacttccgtcaagaagcctttaccgacggtttatcttcatatccacaccctaaattaatgcctgaattctggcaattctctacggtttctatgggtttaggcccctgtgaatgccatctaccaagcgcgtttcttaaaatatctcgataaccgtggtttaaaagataccaaagatcaaaaagtttatgcattcttaggcgatggcgagatggatgaaattgagtctaaaggtgcattaacttttgcggctcgtgagaagttagataacttaatcttcacgtatcagctgtaacttaccacgtttacacggccctgtgaatgggtaatggaaaaatcgttcaagattagaagggctatttactgg

SEQ ID NO: 188 - DNA, 2011 bp, H. influenzae
tgtatacgattcggactcggtacccctttcttctttagcctcaaaaacaggtgtagaatttaccgcactttcagcgatactttcttccactaagttacggcgcggacggcgttgattacgctcacggacattacgaacctgttcttcggttctttctgtttcgttattttcagaacgtggacgacgagaagaacgacgatcctgtgaacggcgttgattacgattaggattgcgcgaagtgcggttatttttcggtttgttttcttcagatttagtcgcaaataaacctttaattttcgcaataattttagctaacaaagagggttcatttgatttacgctcaactggcgttggggctgcttctgaaatagaaagtgcaactactgcactttcaaccgctggttgttcaataacagctgttgtttccacattacgagaaagcagtgattcttcagtattttcatcttgagcgcagtgaattttcgctaagttatagcttaattcatttacttcttcgccatcacgtaaacggaaaacactaaagtgcggtgtttccattgcttcatttggggcaacaataatatcgacattatgacgcttttcaatattactgattgctttgcgtttttcgttaagaagataagaggcaatttgtactggcacaatggtatgtacttgcttggtgttctcttttaatgcttcttcttccagcaaacgtaaaatagataaagaaagagattcattatcacgcactttgcctgttccttgacaacgagggcaaatatggtgcgaagattcgcccaatgatgggcttaaacgctgacgtgacatttctaacaaaccaaaacgagaaattcggctaatttgaatacgggcacgatctggacgaaccgcatcacgaatacgattttctacttcacgttgatggcgaattggtgtcatatcaatgaaatcaatgacaactaatccacctaagtcacgtaagcgtaattgacgcgcgatttcatctgccgcttcaaggttggtatttaatgcggtttcttcaatatcgccaccacgagtagaacgtgcggagttaatatcaatggcggttaatgcttcagttacatcaataacgattgaaccgccagaaggtaaacgcacttcacgttggaatgcggattcaatttgagattcaatttgatagtgactgaaaagtggcacttcgccttgataaagtttcacgcgattgatgaaatcaggacgcacaagtttgatatgctctttcgctttctcaaaaatttttgggctatcaatcaggatctcaccaatatcacgacgcaaataatcgcgaatagcgcgtacaatcacatcgctttcttgatgaattaaaaatggagctggacgactttgtgaagcttgtttgatcgcttcccaatgatgtaataatacttttatatcccattgtaattcttctggcgattttcccacaccagcagtacggacgattaagcctacaccttcaggcacatctaatgaacttaatgcttcttttagttcagaccttcatcgccctcttacggagagaaatcctcctgccccgcgtatattcctctttgcccctttactgtcaccttatatccacagtcgtttggcccgctctctcctcttgttttttcccttctctccctcatcgctcccctgctcgttttctttccccaccctgtttcatttaattcattactccacaatgcaatttataagaagaacgaataccaagttgctgtccgttgcttgcgacgaaccactgaggagtccggctggtgacagctgaggcgcgccagacagacctcccgccgaagtcgcgcccgtccgccctcacgccacggcacacgagcgctgccgcgaccgttcccgcgctcccgtccgctccgaccggtctctaccgccgccctacctctttctagcacactagagtcaccctgcgcgcgcccgcgccgcgaccacccatcgaacaactcccccccaccac

SEQ ID NO: 189 - DNA, 1835 bp, H. influenzae
  misc_feature (1651)..(1651): n is a, c, g, or t
ttaagatatgaaaagcgcttaatatctttggaaacgccccaggtttctcctaactaaatcagaacaggctacgttaacagtaaaccgtgatacatacaggggtgtgcgcaatcagtctatgttcaaaaggcatgtagccccttttacttctgaaacctctgtttccaccataagtaaatcatccaattttgctgccacgcaataatcaatggcgagcgttttgacaacaaatgcgagttgttgttcctctagtaaggtttgttgcgtaaaatttaatgtacgcaaatattctgttcttgctcgttcaaaaaaatgcaaatagcgagcgtgatacactacgccacctgcatcagtatcttcataatacacacgaacaggaaaagaaaagcaattatccaacatattctcacccaattggtcgcaataaaccctgtattctagaaccagtttttgggataagcaagctatctatgaaaaactcaataagattttattcattttaaaacatctaaaatttttaccgcacttttagtctgactagcaaaagataaggtaatgacaaatcatttttaacctttctcattgagcaaaatctattcaaaacataaccgttctttaaaaatagcctctatgtaatcttaagccaccagtatttttattcttgatatttagtgtttctatgcgacaatctttgcggttatttactttaaaaatatgttttactaaatggattacgaaaatcaaattgccaatattttctcactaaatggcgaattaagccaaaatatcaaaggttttcgtcctcgagctgaacaacttgaaatggcacatgctgtaggtaaagcaattcaaaataaatcttctcttgttattgaagctggaacgggtacaggaaaaacctttgcatatctcgcgccagctttagtttttggtaaaaaaaccattatttctacaggatctaaaaatcttcaagatcagctttttaatcgagatcttcctgctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagctgaaagttgtttaggcaccgattgccctaattattcagaatgttatgtagcaagtgcgcgtaaaaaagcattaaatgctgatttggttgtagttaatcatcatttattttttgctgatatggctgtgaaagaaagtggttttggcgaacttattccaaatgcagaagtgattatttttgacgaagctcatcagctgccagatattgccagtcagtattttggtcaatctttaacatcacgccagctttttgatttatgcaaggatattaatattgtctatcgcacagaacttaaagatatgcagcagcttggcacaacatctgataccttactgagagtgggacaagattttcgtttattactgggtaatgggagtaatgtttcgaggaaattggcgtgagctctacaagcanagtgcggggaaaaaatcctttgattattacaagagaaaatggattttttaactgagggattaaaattagcacttggtcgttcccaaactttagacaggatttttgagcgggttgaggtccttacaacccacttaacgtttttctgaaacaacatgggggttattgtttgttctcaaggaaaggc

SEQ ID NO: 190 - DNA, 2428 bp, H. influenzae
tgggtaagggtaaaagggaagggaaataaggcggtgggaaggaggggcaagggaattggggaggggaagggggggaaaaacggttggaaagggagggatagaaaggggagccaataattggggggaaaaaagggcggaaatagtgaacaagcgggtgaaaatgcgggtgtaaaagcaggaaataaaggtgcagaaacagcatggacgcgcttgaaatggatatgttattcaacaaaatggggcggcataaatcatgacagaacaaaaacaagtgaaaaagccttctgctcgtcgtcgtgcgcgtgagtgtactgttcaagccttgtattcttgggcagtatccggcaatactgcagaacaagtggaattagcctttgtgttagatcaagatatggatggggtagataaaccttacttccgtaaattatttcgtcaaacagtagaaaatattgaaaccgttgatttttcaatttcgccttatattgaccgcgcttttgatgagcttgatcctattgaaacggcaattttacgtttggccgtttatgaattgtgcttcgagttagatgtgccatataaagtggttatcaatgaagcgattgaagtggcaaaagtattcggtgcagatgaaagccataaatatatcaatggcgtacttgataaaatcgcaccagcattagggcgtaaataatccttttaaactgagaatggcgcgcgtttttaatgcgtgccttttcttttataagataggtgaaaaatggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaggcacttaggcgatagcgcggcaggtttaacacaaattttatggggcaaaagtgcggttgattctgatgatgtttttttgcaacaacgacatcttagacccacacctagaattgaacttgggcgggcgttaattgatattgctcatgctgccattgatctttccgatgggctaatatctgatttagggcatattcttgaacgaagtcaatgtagtgctgaagttgaactgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataattttttcaagcggtttcgatcattttaaggaatcaaaatgacagaaaataatcctcttaaaaaaatctctcttttaaatcctattcatttgcttgccgttggttttggctcgggtttaatttatccagcacccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtgatgctaaatttaatcattgtgcatttatttggattaatgacgccagggcctgatttcttttatgtaagtcgaatggcggcaagtaactctcgtcgtaataccagtttggggcattttaagcataacgcttggtatcgctttttggggaatgcttctatgttggattggccggggtttgttcttaccattccaccttacatg

SEQ ID NO: 191 - DNA, 1260 bp, H. influenzae
ctttatcgaattcggactcggtacccaaaaatgcttatcaacaaagaacttgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattttaaggttgtaaactaactgttgagttatctctaacattgttaaagtgcatacactatatttttaatattagtttgaaattttttaaaaaatttctgtttcttatttgacgaacgcgcattttatgactagaattgcaccctattttattcactcttaattgtatttaggtaaattaaaatgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgcataatcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatcttaattaagattattcgtctttatcaaattatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagataaaaataaggactgggtaccgagtccgaattcgatacca

SEQ ID NO: 192 - DNA, 1178 bp, H. influenzae
agataagagaatgaacacccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataacgaatttcatgtctatgaatttatgacgcatagcggcaattacctttttatggcattggattccacaacacaaaatataaatacaaaagattggtcaaatttacctattgtcggcaccgtaaccaatacgattcatcaaatgaaacgtcgcaataaaatgaaatgggcagcgtagttaaaagcaaataaaaaagtgcggtgaaaatcaaccgcacttctatctagtatctagattatatttcaattaattactcgtcgctttacgtctagcaataactgcatcagaaagttgttgcaataatctttcagaatcttcccatccaatgcacgcatccgtaatactttgtccataagtctgcgctttgccatcaactaaatcttgacgaccttccactaaatggctttccaccattacgccaaagatttgtttagaaccaaatgcaatctgattacatacgtcttggcaaacatccatttgctttttatattgtttactgctgtttgcatggctaaaatcaaccataacgtgtggaatacgccctgttttttcaatatcagcacaaactttttctacatcttcagcactatagttaggacctttatctccacctcgtaaaataatatggcaatcttcattcccttttgtagaaacaattgcagaatgaccaaatttagtgacagataagaaatagtggggagcttccgccgcaccaattgcatctaaagcgactttcacaccaccattagtggcatttttaaacccaacagcacaagataaacctgaagccaactcacgatgaacttgtgattctgttgttctagccccaatcgccccccagctcataaaatctgccaaatactgaggtgtaatcatatctaaaaactcgcccgctgcaggcaca

SEQ ID NO: 193 - DNA, 2375 bp, H. influenzae
ccgtaatttctggctttggcacccttattaagtatagcaagctagcccagcttacgaggggaaaagagaatgggcctctcaaagccagcatgaagaaaaacgtcgaatgctcgctatcgatacccccctttgggcagaagctggtcgatcggagatatctaacccaagtttcgctcaccaaatggcaatttagtgcccatccttatctacatgttggacagagtgaagtcttgtggaaatatcatgcgactttcaatctgcatttaatggataagcccaatattcgcattggtacccctgtcatattgccagatgccgatacagaaataatcagtgtagcaaatgacaccattcaactttggagttgatatgcgcgacgcgccatcaaaagcatcttacacatcaggaatattcgccttcttagttgcacgcattgccgatatgttctcaaatgtaaattgggctgatgtcgcatcgattacaggtattgtgattggtgtcgccacctgtcttgtaaattggtattacaagaacaaagattttgaattaaaagaaaaagaactcaaacaacggatccatcatcatgattaaacgttccgccaaatacatatgcgccatatccgccgttgttggacatgtgattgcctatcatggaaatgaaattcgaacatccgaaaaaggcttgttactgattggcaatgcagaaggttgtatgaaaaagccctatcaatgccctgccgatgttttaacagtcggcataggcataaccgatgccgttgaaaaaattgaccgcaataaaatttacaccttgcaagaaattgccgaattatacgtaaaaggcattaaacaatcagaaaaatgcgttaatcaatatgccaacgggaaaaccatgccacaaggtgcatttgatgccctcgtctccatcacctttaacgtaggatgcggcaaattaaaaaatagctcactttttaaaatggcacgccaaggctacagcaaagccatgtgcggtcaattcgaacgttggatttatgcagcaggaaaaccgctaaaaggattaattgaacgccgtcaaaaggagaaaaacctatgtttaatttcttaaccgccaaagaacgaggcattttccttatcgggccaatactgcttgtactcctcattgtttttctgggatttaaggctaattattggcgaaaagaaatgctcaaagaagaacagctaaaactgaaatggcaaaacgcttacattgagttaaatcatagcgttcaaaattttgccgaacagcaagcacagctaatccaagccgtaaacaacctcaaagcaaaccaaaatcaacaaacacaggatttaaaaaatgtacttaaatcaaaccaagattgggctaaccgccctttgcctgatgatgttaaacgcgtgctcaactcagcaggaagtcattaaatcaccgattctttgtccacaaaccacagagtgcagtgcgtattcgccacaaattcgcaccaatggcgaattagccgaagcctatttacagacacaacaccaccttgatttgtgcattatcgagaactcaagtttaaaaaaatgcatagatgaatttaataaaaaggaacagccatgacagatcaattcgaccgagcacaacagcttgaagaaatgcaacgcgaaatcgccctcaaaaaacaccgcacttttaaagcagtaagtcgcctttattgtgaagattgtgatgcccccatcccagaaaagcgcagacaaatgattcaaggcgtaacacgttgcgtgacttgccaacaaagatttgaaatacaacaacggaatttcagaaaatgagaagaaccacacttttccttgctatcgctgccgcattgccttgtttagcaaatacctacaccgtgccatttagagatggtccatttgtaaatattcaaattatcctgacggaagaataacagaagtatgcattcatcaagtaggctatttgatgacggacactggacatttgattgttgccgtagataaagacaaccgaccattaatttgcagagatacgcaaaatgaaaaagcccaaccaactgcgcaaaatccttgaacaaagccatcccgattttgtaaaaaatcccgaccatctacaactttatgtgggacgggtggcaaaatcgtcgcaacgggagccgcatcatttagttttgaatatcgttaccactcaaggttgtagtgactgattatgcaggcgatattgccaccttgatgtggcaatgatggcttacctccgcacaaatcaacctgaaatattagaaaaccacaaattcgagagaacgcatttaatccagatgatacacataacacaccgagaattagtttgaatccactactgaccg

SEQ ID NO: 194 - DNA, 1097 bp, H. influenzae
atatcagcctcggttcccatttttgacaaatagagatttttatggcaactccagtcgtcgcccttgttggtcgcccgaatgtgggaaaatccacattatttaatcgccttactcgtacgagagatgcgttagtcgctgattttccaggtttaactcgtgatagaaaatatggtcacgcacatattgctggctatgattttattgttattgatactggcggtattgatggaacggaagagggcgtagaagaaaaaatggcggagcaatctttgcttgctattgatgaagccgacattgttcttttccttgtggatgcgcgagcaggtttaacggcagctgatattggtattgctaattatttacgccaacgtcaaaacaaaattactgtggtggtggcaaataaaaccgatggtattgatgcggattctcattgtgctgaattttatcagttaggtttaggagaaattgagcaaattgcagcctcacaaggtcgtggtgttactcaattaatggaacaagtacttgcgccttttgcggaaaaaatggaaaacgccgatgaaaatgaccgcacttctgaggaagaacaagacgaatgggaacaagaattcgattttgattcagaagaagatacggcattaattgatgatgcgttagacgaagaacttgaagaagaacaagataaaaatatcaaaatagccattgtaggtcgtccaaatgtgggtaaatctactttaaccaatcgtattttaggcgaagatcgtgtagtggtttttgatatgccaggtacgacacgtgacagtatttatattccaatggagcgtgatggacagcaatataccttgattgatacggctggtgtgcgtaagcgtggtaaagggcatttggcaggggaaaattctctgggataaaacttgcagcgattcagatgctaagtggtttgtgactatgacgcagaaagattttctgaacagattatcttgctcgctttatttaaagcggccgtcttggggaccgccgaataagggatggttaaaacaatgggaaaaaccggaacctacctgacccgttaaaattatgtttgctggggctttattaag

SEQ ID NO: 195 - DNA, 1489 bp, H. influenzae
  misc_feature (1441)..(1441): n is a, c, g, or t
aacaggggcggcgcgagaacaaagacgaacagcgcgacccggacgggagagaataagcggacgcgatgagccggtgcaaacaacagcgagagaggcggggacgcgtcaccacacagccgcgaaaggaaagacgcggacggcccgaagaaccacatcgggggggaacgaaaaatcaaaacggcgacaggaattgagaccggcgaaaccgcagacaaaacggaggagaaacgggggcgaaaaaaaaaaaaaacgcgcgaaccgcaaacagcatggaccgcaaagggaggacaaacaagatggggtacggacgcgcgcagtcgggagcaaaaaccgaaaccgggcgccgccagcgagaatgggaaaacattcgggggaaatattgaaaaagttggggaggcataatatgcctgaagctgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgagtaaaattgaaattagcaacgatactcgcgttatccgccatagaaccccagcacgtatcagtcactggatgttggttatttgcttttattatgacgatggttncactggtgttgctttttatgggtaccgagtctgatattcgtataccag

SEQ ID NO: 196 - DNA, 1197 bp, H. influenzae
  misc_feature (1070)..(1070): n is a, c, g, or t
  misc_feature (1105)..(1105): n is a, c, g, or t
  misc_feature (1142)..(1142): n is a, c, g, or t
gccagattgctgcctgcaggtcgactcttggaggaccccgtcgtattattggacttggtttagcaatgctgacaagaattttacttttaatgtcacttgcttggattatgaaacttactgcaccattatttactctgtttaatcaagcaatttctgggcgtgatttgattttattaatcggaggtttattcctgattataaaaagctttggggaaattaaagaggcaataaatcatcaagaacaccataattctgaaagcaaaaacaaagtgagttattttggcgtattaattcaaattgcagtgctagatattgttttttctttagattctgtgattacagcagtaggtatggcaagccaccttcctgtgatgattttggcgattattattgccgttggcgtgatgatgtttgcagcaaaaccaatcggcgctttcgtagatacgcatccaaccttgaaaattctagctttagccttcttggttttagttggaattagtttaattgcagaaagtttagatattcacatcccgaaaggttacatctattttgcaatgggattctctgttgtggtcgaaatgatcaatattcgaatgagaagattgataaaataaattggaagtgcggtcgataaaaataatgttttttatgaccgcactttttcttttacttattgaaatacactttttttagtgccatctctaaaccgcgaaattcagctagaccttttaaccgaccaatggcagagtagccagggttggtttttttacgtaagtcatccaacatttgatgcccatgatctgggcgcattgggattaaacgcgtttctccttgatttaatcgacgatattcttcatttaataaggcttttaccacattaaacatatctacgtctccttctagatgagctgcttcatggaaggttagtggattatcttcacgttgagtagaacgtaaatgtgcgaagtaaatacgatctgcaaattgttctgtcatttttacgagatcattatcggagcgtacgccataagaacccgtacacattgtaaaaccatttgctggtaatgggntgagtttctaccaaccattgcatatcttcaatagntgaaactatgcgcggtaagcctaagattgggcgtggnaggatcatctggatgaatcgccattttgattcctacttcttggggcacaggtacg

SEQ ID NO: 197 - DNA, 1605 bp, H. influenzae
  misc_feature (1578)..(1578): n is a, c, g, or t
ttattcggtaatctcgcttgagacggatgtatcgttaaaaccgctggtgtagatgaatctattttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccaggggattccctagagtncgacctggcaggcatgccaagtctggc

SEQ ID NO: 198 - DNA, 1092 bp, H. influenzae
caggtcgactctagagatccccgtggcagggcaacaggaaaagtcaatgaagaacaaaaaccaagttatgatccaacttgttatctttgtccgagtaataagcgtattacaggggaattaaatccagattatcgtaaaccttatgtatttaaaaatgatttttccgcgcttttagaagatacgccagcccctgaaaaatcctccgatcctcttttccaaagttctcaagctcgtggggaaagtcgagtcatttgtttctctcccgatcatagtaaaacattgccattattgaccgcacttgagattgaagaagtgattaaagtatggcaggaacaacttcgtgaacttggtgcgaaataccaatgggtgcaaatttttgaaaacaaaggggctgcaatggggtgttctaaccctcatccgcatggtcaaatttgggcaaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattgggtcgctttagtaccttattgggctatttggccatttgaaacattgcttctaccaaaaactcatgtaaaacgtttaactgaattaagtgacgaacaatcaaaagatcttgcggttattttgaaaaaattgacgaccaaatacgacaatctctttgaaacctctttcccatattcaatgggatttcatgcggcaccgtttaatggcgaagataacgaacattggcagctacatgctcatttttaccctcctcttttgcgttcagcaactgtgcgtaaatttatggtggggtatgaaatgttaggcgaaaaccaacgcgatttaacggcagaacaggcagcggagcgattacgtgctttgagtgaagttcattataaagaaagaactacctatcttgtccggtcccctttttacctttagcaaagagtggtgcagatccagtatataattaatataagggatggaaatattacccccatcccaaatgcttaccaatttttcatgaacccttac

SEQ ID NO: 199 - DNA, 2461 bp, H. influenzae
  misc_feature (889)..(889): n is a, c, g, or t
ctggtatacgaatatcggcctcggtacccctcaatgagcgtaaacgactagcaagcctaatagagtacattaccagttggggcgtgcaaatggcgtgagatttaacgatagatgggggttttaaatgaaacgcttaaacgatgatgagattttggagttaaaaattgtacttttgattgcggcagtttgggtaatgtttaatatggtgtttggctaatggcgaaagagtataaatgcaaagtttgtggcaaagcgtttgtaaaaacctttagctcaacacaaaaagtttgctcgcctgaatgtgcgattaaattagtccgagaacaatcaagaaaaaggcaaaagaaagcggaaaaacaagaacagatagagcgtaaaaaaagattactagatggtgagagggcattggctaaaagctcttcaaaaagaggtaaataaatttataagattgagagataaaggacaaccttgtattgcttgtggaacggtatggaaacctagttttcaagcgtctcattttattccgcagggaagaagctcatttttaagatttgatgagaggaatatccattctggctgtatcagatgcaatcttttcgtaggtggcggaaatatacatggatatagaccaagactagtcgagaagattggcgagcaagaggttgagtggttggaagaaaatcaacatcgaattaaaaaatgggaaatttctgagcttaaagaaatgctaaaactatacagattgaagaacaaggaattagaaaatgaaatgcaagattgatggttgcaacagagaggctatgtataaagctgattgcgtttgccaaatgcactattttagatttatgagaaacggaacttatgatcttcttccgaaaccaatccgaanatacagaagacacaatggaaagggttatcagttaattttcgaaccaagacaccaattagcaatgagcgatgggtatgtttatgagcatagatttgtgatttatagcatttatcaaaataatttacctaactgcaagctttgtggctgcaagctaacttggagcagttgtcacatcgatcatattgataatgacattaccaacaacacgctagaaaaccttagaccaatttgccgagcttgtaacgtaatgagaagtcacacattaatacctaaatatacacacaaaggtcattctaaaataacttttaatggattaacaatgacagcagctgagtgggctagacaagatggcgtaacagtagctgggaatacaatcttgagaagaattagagatgggtggagcatagaaagagcattatttgagacaagttcaacacatccaaatgcagcagttaagcacactactactaagtataaaaatagatttgaagtgaaatctactggaataagcttagatttaagattgcaaggcgatgattaagcattacaaggcaaaaattaaggagcttacgtgaatattgatgtgatttcagttgaatttggttattgggctacacctcgttatgagactgaatttccacgtgtagccgcagggtttgcagagatgaaatgtgatgctcgttatgctgaaaaatatcgtatgcgtcctataagcgatgaattaggcatggaaattgatggctaccttggtgtaattagaaaagtccccccagaccttatgatgtattcgttctgacttatatcaagagatgggaaaaacaaagaaattggcgatatttacatatttcacggcgtgaatatttcaatcgattgaaaacggtaaaaacatcactttattgctattatcaacagaaggcaagcaatgtttatttattgcctgaaaagtgcggtctattttgaccgcatttatttcaagggtaggtattctttctattcttgtccttcctgaagtgtgagtttggggtgtatcttatctaacatttcataaaaattatctttatctttagatagctttaaaagtgtaacgatagaagataaatgttcacgcaatttagggtgccctacgtcttccgttaaaaactggtgtaattttactttttttgcttgtttacttgccgattttttgagttctggtaataactctggagcgagtcgggcatacacggcgttgtttgtaatatgcccgaagaattgtggaaattgattattatttttcggagggaattgaacgccatataaacgacataattccttgtaatagtctaaaggaaaggttttaacccaaggttgtaattcttttgcgacaaaggcttcaaaaatttttgcgagtgcgtctttggctcgtgcatcttgatagccggtgacttcatccactaatgccacaatgcccactttggctaaagagcggattagaatttctgctttttgggcggtgttttgttgcttaccaaccaacgcccttcttcacgtgctcgtagataaatatcacacacgacaggtaaaatagtcgca

SEQ ID NO: 200 - DNA, 1920 bp, H. influenzae
taatatttggtataaaaacgaggattttgcatctaattgaggattaaaattcatcggtagccagcgtaaatagctattaagaggcgcaacttcgttgccttcttttaccggcactaaattattactgagtaaaaccgttcttaattctcttgagcgaatgcgtagctcttgatcgtctttccctcttacatagaaaaccatgccagcttgataaagcttgtgtccgtcttttaaatattccgttactgtgagggcatcttgttttaaatagatagactcatagttattaccgacagctcgactacttaatttgtctaaatgcgcctgtaatttatcttgaggatgaatgactacagtgatagccataatggttgattccggcaataaatcaaatagtgcattaatattacgacctcgagtgacttcgccatgtcatgtggccaacatccggctgcttacgaatattatcaactacaatgacttcgtgaggttgctcattaaaataccaatagccatttttactttccggtggcgtaaaaaagagattttcactaaaatcttggtcttgtaatggtagagcagattcatccttagagagtgataaaagatcatagcaagctttatcatcgagtccgttaaaatagcgtgatggatttggattaaaccattctaataaccaacgatgaatttgtgtttcattttggcgttccatggttaatccagctgtgataaaagcactttgaacacgatcacaagctgtatttaatttctcgattgtatctgtctcattatttccagcataacgataaataaccatgcgtgttttacgcacttttccagcccatgccgtatttgttacccggtcatcaacaaaaagcccacctggtttacctactgcttttaagtgacgctccatttcaccaagccactgttctgtaaactcactaccgctcgcttcaggtgaagtggttttaatgtactgtctcagattctcaacataaccgcttaaatccttgtcatcctggcaatagaattgtacaacgtaagggttggtatcaagttcatcgaaactatcctgtaaggcatctttaaccaatgtgcgaacgcgattaagatagtcgctgcttcttccctcagttcctataggcttaatatcaaataccgcacctgcacttttagcatcatcaaaaagcattacgccttcttcttccaaatattccgcataaggaagattggagataaaagagggatcgcgcccataaagcattttaacatgttgctctctggtcatttttctattacgcataacaggagtgatttcaatcgtctcttctacgttattggtatcatcctgctgtgcttcttccggtgcaatggatgttaggataggttcctttttaggttgaggcttatcaccttttttagcagggaagaaagcctctaacacgtcttggaataaagccatcggttcttacctcaactagtacatttcttgaacgctcacccggtctgtgcatattgcacaccgtccatattaatggaattacctgagaaattaaccctggtacatggcattttgttctttgaagaatatcatgtaaaggtccggatttaaccctaacctaccttatatcatgggtcttggataaacaaggggataaacatattttaactctcgtgtttctgtgggtcaggtgttaagttttggtggtcaacaatatatgaaatgtaatttgttgcattatttaataacggctttccgtggcctcacaataattaataactgtaatcttacgcgcctcttattgaattcattacaggtgtggcccccctgtgtgaatatacctccttgaatggtgagacacctatactaaatttcggtgttttaaacactctcctcctttatcattttttttgtct

SEQ ID NO: 201 - DNA, 1960 bp, H. influenzae
gttttcggatatcggctcggtacccctaacttggtttcatctccacaaactttagatgaagatggcgatgagttagatgtgttattaatcactcgccaaccattagcaacaggtgtattccttgaggctaaagtaattggtgtcatgaaatttgttgatgatggcgaagtggatgataaaatcgtttgtgttcctgcagatgatcgtgatacaggaaatgcctacaattcattagcagatttaccggcaaacttaattaaacaaattgagttccatttcaataactataaagcgcttaagaaacctggctcaacgaaagtgacccattggggcgatgtagaagaagcgaaagaagtgattcgtgagtctattaaacgttggaatgagcgttaattaaagacgtttgattgtaaaagtccctgattctttgagtcggggattttttatatgagtttcagagatttagataataaaaaaacacctttcggtgcttactttatttttaaagtggtgggtcgtgaaggattcgaaccttcgaccaacggattaaaagtccgctgctctaccgactgagctaacgacccaattagatgattttaaaataaattttcaaatcttttgattggtgtttaaatggtgcccgaagccagacttgaactggcacgcctcgaaaggcgagggattttaaatcccttgtgtctaccgattccaccactcgggcaaattggagcgggaaacgaggctcgaactcgcgaccccgaccttggcaaggtcgtgctctaccaactgagctattcccgcatttatcactaatcagcactgctacgtgacaacggggcgtattttacggatttatatattgctgtcaaacgaaaaaaataaaaaatattttatttgattaaaaataactcaaatatagatggttatcataaaaaataactgtgttttatttaaatttataattgaatattatctagcaagcttccttttgctacttgtaaatattggatcattgaccatatagttaaaatagcggcgatataaagtaagataattgctgctatttccatatagttgttataacgccataataatccgcctagtgctaacatttgcgctgtggttttccattttccccaccaagagactgcgactttgctacgttccccaagctctgccatccattcacgtaatgcggagatgataatttcacgagaaatcataataatggcaggaatggttatccaaaatgtatgttgatgttcgacaattaaaactagtgcagccactaccattactttatcagcaacaggatcaagaaatgcaccaaagcgcgtggtctgtttccatttacgagctagatagccatctagccagtcagtgacacctgcaataaaaaaaatcagtgttgtgatgaaaggagatgattcaatgggtaaataaaatgcaatcacgaaaaaaggaatcaaaatgactcgaaagatcgttaggaaaattgggatattgaatttcatagaaatgaaccgctcttggtgttagagatatgcctattctaaagtatctaagaatataaaaaaagccacattatgtggctttcttgtaaataattacggattaaagtttatcagcgttttgttttaagtattttgcaacaccttcagggttatctttcatcccttctttacctttttcccattgagcagggcaaacttcaccgtgatcttcatgggattgtaatgcatcaaccatacgtaacatttcatcgatattacgacctaatggaagatcgtttactacttggtgacgaacacgccatttttgtcgataagaatggaacgcgaatgcaacgcctgctttggttgttcaataccgatgctggagcaattccggtttaacgctgccctatgcctttgtacttgccgacccaccttttagccgggggggtacccctccattggag

SEQ ID NO: 202 - DNA, 1080 bp, H. influenzae
ttagtgaaccacgccattagctagatgaagtacgtgcaggtaaagaagctgttgttgctaaattaactggcggtttagcaggaatggcaaaagcacgtaaagtgactgttgttgaaggtttagcgacttttaccgattctcacacattagttgcgcgtgatcgcgatggaaacccaacgactgttaaattcgacaatgccattattgcggcaggttctcgtccagttcaattaccctttatcccacacgaagatcctcgtatttgggattcaacagatgcacttaaattaaaagaagtaccgaaaaaactacttattatgggcggtggtatcatcggtttagaaatgggtactgtatacaatgctttaggttctgaagttgaagttgttgaaatgttcgaccaagtgattcccgcagcagataaagatgttgttggtatttacactaaacaagttgagaaaaaattcaagttaatgcttgaaaccaaagtgactgcagttgaagcaaaagatgatggtatctacgtttcaatggaaggcaaagcctgtaatgacaccaaacgttatgatgcagtacttgtcgctatcggtcgtgtgccaaatggtaaattgattgatgcaggtaaagcaggcgttgaagtagatgatcgtggttttattcacgttgataaacaaatgcgtaccaacgtgccacatatctacgcaattggggatattgtaggtcagccaatgttagcacataaaggtgttcacgaaggtcacgttgccgcagaagtcattgcaggacaaaaacactacttcgatcctaaagtaattccatcaatcgcttataccgaaccagaagtggcgtgggtaggtaaaactgagaaagaatgtaaacaagaaggcttaaactacgaagtggcttaaattcccttgggctgcatcaggccgcgcgattgcatctgaatgttcagaaggtatgacgaagttaatctttgataaagatacgcatcgtatactgggcggtgcaatcgtaggttctaatgtggggaattataaggcgaaaatgggtaaccgagcttcgatattcgtataacag

SEQ ID NO: 203 - DNA, 1598 bp, H. influenzae
caaatttggtgttaaattttcaacgaatataacgcaattgaaccatttcataaaaaaagtcctatttttaaataagtttgttcatttccgaaaaacggttttcccgcttaagaaatttggccagatttgggacgcgattaaacctgtttaacatctaatttcgtttcagtctcagcaggtaatcccaccaattcacgtaaataattgacgttttcaagatccatttcttcccagcccccacgaggcaaacctttcatcagtttgatatttccataacgaatacgaatcaagcggctaacttgaatcccttgagattcccacaaacgacgaacctcacggttacgtccttccatcaaggttacgtcataccattggttaatacccacaccgcctgtaaatttaatttctttaaaattagcaggaccatcttcaagctgaacgcctttacgtaaacgcgctaacatcgcatcatcaacttgaccaaatacacgcacagaatattcacgttcaacttcacggcttgggtgcattaaacgatttgctaattcgccatcagtggtaaaaagcaataaacctgatgtattaatatctaaacgccccaccgcaatccaacgagatcccgttaaacgcggcaaacgatcaaacacggtcgcacgcccttctgggtcgctacgtgtacagagttcgccttcaggtttgtaatacattaatacacggcaaatttctttttgtgcgtggctaagattaatgatttgaccatcaatacgcactttcacgccagaatgtacgtcaatacgatcgcctaaagtcgcaattttaccctctacgctcactctgcctgcggcaatcatcgtttcaatttcacgacgagagccttgtccagcacgcgctaaaactttctgtaatttttcgccctctgctttcggttgattcgaggctcttacaacaggtttcgcttttggcttagataaaaatttgttgtcagaattaaccgcactttttttcgtatttgctgtttctatgcgagcagtacgagatactgaacgtctgtcatttttagctgaaaaatcacgtttctttgctgaatctttggaaaagtgcggttgtctttgagtttgtttttgactaggtttcattgttttccttgaataatggaaaggtcgctttcacaagcgtctataggttaaataaaaggagcagtacttccacttccttcgcgtaaaatcactggcgattcttccgttaaatctaccactgttgtaggctcttgccctaaatatccaccatgaataattaaatccacttgatgttccaaacgatcacgaatttcttcaggatcggattgcgtagtatgttcttcattcggcaacattaacgaacaagataaaatcggctcgcctaaggctgaaagcaaatctaaagcaattttattatctggtacgcgtaaaccaatggttttacgtttttgatgtcattaaagggcgagggtaatctttcgttgctgtaagaataaagtataacgccctggcgtattatttttaatcaacgatagcgggattatttaccgtgcatagttgaaagttcgacaaacgctaccc

SEQ ID NO: 204 - DNA, 1282 bp, H. influenzae
  misc_feature (1001)..(1001): n is a, c, g, or t
catttagaatctacaaaacggactaaatcaggtaacatttgattcaagttatgcataaattgttgataggttgcttgtttttgactaatgtctgtgagttgcgattcccaatgagccgtcatatctggttgggtggcaatatctggtaatgcctgaattaaaattcttccagtttctgtactgtgaatatttcgcccttttttagttaaaaaactgcgtttaaaaagtaattcaatgatgccagcacgagtagcctctgtacccaatccatcggtttctcgcaggatttttttgagttctttatcctgcacaaatcgcgcaatgcccgtcattgctgaaagcaaggttgcatcggtgaaaggctttggcggctgagtttttttactcatcacttctcctcgttcacaatgcaaaatttgacctttctttactattggtaataagggttcttgattttctgtgtcgtcttctttgcctaacaattctttccacccagccgtttgtaaatttcgcgcttgggctataaaagtaccgccagcgatatttaatgtgattttacttttacgatattctgcgtcaggacaaaattgcattaaatattggcgagcgataaggctgtaaatattacgttcttcttgtgttagatttactggacgatttttggcagtaggaatgattgcgtggtgagcctctacttttttatcattccaacagcgatttctctgttcagttgaaatgacatttggtaagcgttgataagcttcacaatgggttgaaattgcatttaatacattgtggcgttcggcaaaatgttcttcgggtaaatagcgacaatcagaacgcggataagtaattaaacgatgagtttcatacaggcgttggcatgcatctaatacggcttgagcggacataccgaatcgctttgctgcatcaatttgtaacgcagaaagtgaataaggcaagggcgccgtttctttttcacgaacgtctttgtattcggngacttctgctggttgatttgtaatacgttttacaacgttttctgctaatcctttagagagcaccctgccgtcatcatcttggtaatcctcgcaagctttgctaggttgccataaggcacttgaaagtgcggttgatttttctggagtttttcttctttgctctctgggataacccaagcctgtactttaaagaggcctttggcctggaaagctcaaattctaaatctgacggacattaaacctaacacagggggttgcctccttccacagaaaacccccat

SEQ ID NO: 205 - DNA, 1614 bp, H. influenzae
  misc_feature (1343)..(1343): n is a, c, g, or t
  misc_feature (1579)..(1579): n is a, c, g, or t
atttatacgattcggactcggtacccgctttataattttttcatctggattcctaaatttgtgaattactggcaaactcaacaaaacttacctgtaatcatagaaaatttttaaaaacatcttaaattttgaccgcactttatcacaaagtgcggtcagcttttatgatgaattgattaactaaaatcagccaccaaagtcatctaataaaatgttttcatcttcaacaccaagatctttcaacattttaattacagctgcattcatcactggaggcccacacatatagtattcacagtcttctggtgcttcatgatttttcaagtagttttcataaagtacattgtgaataaagcctgtatagccagtccaattatcttcaggcaatgcatctgaaagtgccacgtgccatacaaagtttggattttcagcttgtaattggtcaaagtcttcttgatagaatatttcacgtttagaacgtgcaccataccagaacgacattttacgtttagaatgtaaacgttttaattggtcgaagatatgtgaacgcattggagccatacccgcaccaccaccgataaataccatttctgcattagtttctttcgcgaagaattcaccaaatggaccagaaattgtgactttatctcctgcttttaatgaccaaatgtaagaagacatttgacctggaggcgcatcaggttggcgtggtggtggagtcgcaatacgaacgttaagcataatgatacctttctcttcagggtatgaagccattgagtaagcacggataatatgctcgtccactttagagacataacgccataaatcgtatttatcccagtcttcgtggtattcttcaggaatatcgaaatctttatagttcaccacatgtggctcagcttcgatttggatataaccacctgcgcggaaaggcacttcctcgccttcagggatcgctaatttaagttctttaataaaagttgctttgttatcgttagaaataacagtacattcccattttttcacgccgaagatttcttctggaagttcaacttccatattaccttttacattaacttgacaagctagacgataaccttcttttgcttcacgtttgttaatgtgagaaagttcggttggaagaatttctccaccgccatttttcactttaacaatacattgaccacaagagccaccgccaccgcaagcagaagacacgaaaatacctttacttgctaaagcccctaataatttgccacctgcaggtaatgtgatcgctttttcaggatcgtcattgatgtcgatagtaatatcaccagaatcgactaattttgatttcgcanataagatgattgccactaacactaatacaataaccgtgaatgcggcaataccgagtggcagaattactggatcgctcattgattacactcctttatattgaataccagagaaagacataaagcctagtgccattaaaccacagagattaagggtatacctaaaccttttatccagcagaatatcagcgtatttcatttttttccgttagccaagcagcgctacaatcgcttacatnccacctaacctgagccgaaccctaccgatagattc

SEQ ID NO: 206 - DNA, 1237 bp, H. influenzae
aaaaaaaaaaatggaagaaaaaaggcaggtggggggcaatataaacatataggtcggaatatagtcatcaaatccatccattggtggttcagcctgaggtgcagattgttgtggagctgggcgagatgattgataactattaccattgttagtttgacgagcttggtaagaagattgtggcgaaccgcccatatcattaccagaaccacttgcgttttgattacgtccaccaagcatttgcattacatcgccttgaatttctgtggcgtaacgatcttgaccgttttgatcttgccatttacgcgtttttaaacgaccctccacatatacttgagaacctttacgtaaatattcgccgcaaatctctgcttgacgacgatagaatacaatgcggtgccattctgttacttcacggcgttcgccagtattacggtcgttccagctttcactggttgctacgctgatatttgcaacggcatcgccgtttggcatagtacgaatttcaggatcattacctaaatgacctacaataatgactttattaattccagccataaaaaacctcattttttatctaaaaaagtgcggttattttgcctgaaattttttaaaagatctatatattttaactggatatttgcacagatattaaaatatgcgataatgatcgcaaaatttacatttatttcatacttttgagttattttatggaaaatatcgatattcgcggggctagaacccataatctgaaaaatattaatttaactattccacgcaataaacttgtggtgattactgggctttcaggttcgggaaaatcctctttagcctttgatacactttatgcggaagggcaacgccgctatgttgaatctctttcggcgtatgcgcgtcaatttttgtctttaatggaaaagcctgatgtggattctattgaagggctttcccctgcaatttccattgaacaaaaatctacctcacacaatccacgttctacagtgggaacaattacggaaatttacgattatttacgtttattgtttgcacgagtaggggagccgcgttgtcccgatcataatgttccattaacggcacaaacaattagtcaaatggtgggataagtattaagtttgccagaagacagtaagaagatgttacttgcgccagttgtcaaaaatcgaaaggcgaacatctcagatttagaaaaattgctgcgccaggtatattcgtgcgcgga

SEQ ID NO: 207 - DNA, 1708 bp, H. influenzae
  misc_feature (1696)..(1696): n is a, c, g, or t
aagatgatgaacctgttatccgcttacttaatcagatttttgaatctgccttacaaaaaaatgcctctgatattcatttagaaaccttggctgatcagtttcaagtgcggtttagaattgatggtgttttacaaccacaacccttaataagcaaaatattcgccaatcgtattatttcacgcttaaaattactggctaaattagatattagtgaaaatcgacttccacaagatggacgatttcaatttaaaaccactttttccgatattcttgattttcgcctttcaaccttaccaacccattggggcgaaaaaatcgtgttgcgagcgcaacaaaataaacctgtagaacttagctttgctgaactgggtatgaccgaaaatcagcaacaagcatttcaacgctcacttagccagccacaaggattaattttagtaaccggccccacaggaagtgggaaaagtatctcgctttacaccgcacttcagtggctaaatacgcctgataaacatattatgaccgctgaagatcccattgaaattgaacttgatggtattattcaaagccaaattaatccgcagattggattagattttagccgtctattgcgtgcttttttacgtcaagatcccgacatcattatgctaggtgaaattcgagatgaagaaagtgcaaggattgcactacgtgccgctcaaacgggacatttggtgctttcaactttacataccaatgatgcaatatctgccatttctcgcttacaacaactcggtattcaacaacatgaaattgaaaacagtttactactcgtcattgcacagcgtcttgtacgaaaaatctgtccaaagtgcggtggaaatttaataaattcttgtgattgccatcaaggttatcgagggcgaatcggcgtgtatcaatttctacattggcaacagaatggctatcaaacggattttgagaatttacgagagagtggtttggaaaaagttagccaaggcataacagatgagaaagaaattgaacgtgtgttaggtaaaaactcatgactaaaaaactcttttattatcaaggtagtaacgcattaaatcagaaacaaaaaggctcaattattgcggatacgaaacaacaagcgcactttcagttaataagccgcgggcttactcacatcaaattacaacaaaactggcaatttggggcaaaacccaaaaattcagaaatcagtgaattactcaatcaattagcgacattgctacagtccgtaattccgttaaaaaacagcctacaaattttgcaacaaaattgtactcaaattatgctcaacaaatggcttgaacgactgcttcaatccattgaatctggcttagcattctcacaagccattgaacaacaaggaaaatatctcacacaacaagaaattcaactgattcaagtgggagaaatgacaggaaaacttgccgtagtttgtaaaaaaatagccacgcaccgtagtcaatctttggctttatcacgcacatacagaaaattatgttatatccctcaatggtattggggaatttctctattattgacactcgcattactgctttttatcgcgcctcaatttgctgaatgtacagtggtcataatgcggagttaccaacaataaccgcaatattgctctcaatatctaatttccttaagcacaatattggcattntgctattgttca

SEQ ID NO: 208 - DNA, 1489 bp, H. influenzae
  misc_feature (1219)..(1219): n is a, c, g, or t
  misc_feature (1312)..(1312): n is a, c, g, or t
atcccctttacgcaatatagattttatctactttgtagtagaatgcggaccttttatttttagaatcaaaaactatgttttcacgcaaagatattattattttaggaatgatgatcttcgccttatttttaggtgcgggtaatatcatttttccgcctatggaaggattttcctcaggacaacattggacgagtgcttccttaggctttgttttaactggcgttttaatgccatttattacgcttgttgtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactaatttttaacttaatcgcgatgggctttatgattagcccaaatacgatcatttcaagcgtgggtaaatttatgacaccagctttattagtgttacttattgctgtggcaattaccgtatttatttcgcctttatctgaaattcaagcaccaagtaatgcttatgaaaatagccattctttattaatcggcttaaccagtggttatcaaaccatggatgtacttgcagccatcgctttcggtggaattgtcgcccgagcattatcagcgaaaaatgtgacaaaaaccaaagatattgtgaaatacaccatttcagccggatttgtttctgtcattttactcgccagtttatatttttcgcttttctatctaggtgcaactagtgctgcagttgcagaaggggcaacgaatggtggacaaattttctctcgttatgtaaatgtcttattcggttcagctgggacttggattatggcgggtattattgtattagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagctttgttattaatttacccagtagctattgtgcttgttttattgcaattcttacgaaaaaaacttccatcaataaaatttacatacaatagtacattgctcgttacggttggtttaanttatgtgacagcttaaataacgttaaaatgttaccagaaagcatcaattcattattgaaacctttcctctttcatctgaaggatgggctgggntggttcccactttaaaatggtagtgcagcaattttatgggaaaagctgctaaaaccattttaatctcaaaagggttattttacacccttgcccgaaaatcgccttagggggaaaatagggcagggtgaaaatttaccgctttttaaaaaaattattacaggccttacctatttttta

SEQ ID NO: 209 - DNA, 1514 bp, H. influenzae
agtctaatgggtagaaaaagattactgcagcttttccagcaatgtgttttttaaagttgaagttatcaacgatttcgccattgcttaatacagcagatgaagtaaaatctggtgcttgacgggttactaataccatagtcataattcctatataaagttaagttaaagttttgccacacaaaatagcggtgcgattctatttgaaacgccgacattttatactcgattttatctattaaagcaattaatcttatctaaaataaggtggaaatatgcaacaacacaatctctcaacaacatttgtccatgcagggcgtcaaaaacgtttttcacaaggatcggtaaaccctgttttacagcgagcttcttcattactatttgacagtattgaagataaaaaacacgctactcaacgtagagcaaaaggcgaattattttatggcagaagagggacgctaacacattttgctttacaagatttaatgtgcgaaatggaggggggggcaggttgttatctttatccttgtggtacagcagcagtaactaattcgattctttcttttgttaaaactggcgaccatgtgttaatgagtggtgcagcttacgagccaacccaatatttctgtaatattgtgctgaaaaaaatgcagatcgatataacttattacgatcctcttattggtgcggatattgcaacgcttattcaaccgaatacaaaagtacttttcttagaagcaccgagttctattacaatggaaattcccgatattccgactattgtgaaggctgcaagaaaggtgaaccctaatattgtgattatgattgataatacttggtcggcaggtgttctatttaaagcgttagagcatgatattgatatttctattcaggcgggtacgaaatatttagtgggtcattcagatattatgattggtactgccgttgcgaatgcgcgaacttgggatcaacttagagaacattcctatttaatggggcaaatggttgatgcagattctgcttatacgactgctcgtggtatccgtacattgggggtacgattaaaacaacatcaggaaagcagtattaaagtggcaaaatggttgagtgagcaaccagaagtaaaaactgtgtaccatccagctttaccaagttgccctggtcatgaattctttttacgtgattttagtggaagcagtggtttattttcttttgaattaacccagcgattaacttcagagcaagtatcaaaatttatggatcattttcaactgttcgctatggcttattcatggggaggatttgagtctctaattctttgtaatcaaccagaagaaattgcacatattcgtccaaatattaaacgtaatcttacaggttcattaattcgtgtgcatattggttttgaaaatgtggatgaactaattgcagatttgaaagctggttttgagcgaattgcttaaaagtgcggataaaaaaatgcctgtttacgggtaccgagtcgatatcgtataaat

SEQ ID NO: 210 - DNA, 1728 bp, H. influenzae
  misc_feature (1395)..(1395): n is a, c, g, or t
aaacctctcctaaagtgtgccacgcgtccattttataaagaaaaaacgcaggttacccttgggataagaagccaccacataaagcggatttaccaagatgtgtatcaaagtgttggatcccaccatcaaaggatgggttccattcctcgccttggggtgccaaatatggtcgctcgtattcggggcagatatcaatttgagttcaattgcaggtacttatccttatgcgggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagccgcaaaagtctatgaaaacgtgcaatcggttcagcctgaagatattgcgaacattgtattatggcttcatcaacaacctgaacacgtaaacattaatcgtattgaagtaatgccaaccgctcaatcttttgcaggaatgagcgtttcaaaagaaaaataaaataataggaaaaaatatgtcagacacacttcttaacccttattttggcgaatttggcggaatgtatgtacccgaaattttagtgcctgttttgaagcaattagaacaagcctttgtggaggctcaaaatgatcctacattccaagcagaatttgctgatttactcaaaaattatgcgggcagaccgaccgcacttactctttgtcgtaacttaaccaaatgcacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaaccgccctagcttgtgctatgttagatatgccgtgtcgtgtttatatgggtgcaaaagatgttgagcgtcaatcaccaaacgtgttccgtatgcgtttaatgggggctgaagtaattcctgtagaaaaaggctcttgttctttaaaagatgcctgttgtgaagcgatgcgtgattggtcagcaaactatgaaaccacccattatttacttggaacggcggcaggccctcaccccttcccgacgattgtgagagaatttcaaaaaatgattggcgaagaaaccaaacgtcaaattctagaacgagaaggtcgtttacctgatgctgtgattgctgcggttggcggtggttctaacgcaattggtatgtttactgattttattgatgaaccaaatgtgcgtttaattggtgttgaacctgcagggaaaggcattgaaagcggtgaacatggcgcaccattaggtcatgcanaagtgggcatttatttcgggatgaaatcccctttaatgcaaaccgaaaatggtcaagtagaggaatcttactctgtttcacctgggctatactccccttttttctggcccgcacatgcttatttatttcagattgggccggcctgttatgcatccattacccgtgttttacccctttattccctcccagcacgcgtattattccacgcttttttccctccccttaaagttccccatcccttccctcacctttttctattcccattcccccccctgttacacattccctttctttcccacccctttttttcccttccccttttcctccttccca

SEQ ID NO: 211 - DNA, 1765 bp, H. influenzae
  misc_feature (389)..(389): n is a, c, g, or t
  misc_feature (457)..(457): n is a, c, g, or t
  misc_feature (468)..(468): n is a, c, g, or t
  misc_feature (1559)..(1559): n is a, c, g, or t
  misc_feature (1574)..(1574): n is a, c, g, or t
  misc_feature (1612)..(1612): n is a, c, g, or t
ctgtatacgatatcgactcggtacccttttcgttggttatcttggtgttggcgcataatcggaagatgctctgcccttcaaaactttctggcactttttgattggctaaatcaaagactgttgaagttaagtcgtgaagataaacaaggttatcatcttcttgatttacacgatcagagtttggatctttgataatcatcggaatgttgtatggctgtttagaaccctatccgccttgtcgttgcagaaaacgctggtttcacttcacattccccttgtagtgccatcagccaatcttgcaccttgtgaaaaggggaaaattggtgacgacgagccactgcagcaaaatcccctggtgtcagcagattaagcgattcaatctgacttanatcctcttccgataacaacggcaatcctaaaatttctgctttggtgtttagcaaaatctcatgcgtgnttgagcgttanataatcaaacttcaattttaaatcaaaacggcgtaaagctgcgtgatcaagaacctcaattaaatttgttgataccaccatcaggccctcaaagcgttcaatttgtgttagcatttcattcacttgcgaacgctcccagcttcgatttgcgccttctctagaaaataagaacgtatctacttcatctagcaccaatattgcattatcggctttcgcttgttcaaaggcttgagcaatattttgttctgtcccgcccacataaggattaagtaaatctgagccttgtcttagcaatagcggcatgtccaactgttccgcaagccacgctgcccaagcagtttttcctgttcccggcgggccatagcaacaaattcgcccttttttcgaccgttttaacccttcactaatacgatgaatattgtcgttacaagccacataatccagttgtagtcggctttgcctaaaacaagcggttcaattttcggtttattttgcgattttaacgtttgattaaacatcatgagcaaagtctcagcaaaatttgatgtattgagttcctttgccacccgaattgtgcggcttaaaatcgccggcgttaatgaccgcactttagcaaaatgctgcacataggccggacttaattttccctcagtcagttgcgtaatcagtgctgacttatttttcaacggcaaatctggcatttctaaaataaaatcaaagcggcgtaaaaaagcaggatctatgcccgaaacagagttagataaccaaatcatcggcacgttattgttttccaataactgatttgtccacgctttatttttttgtgcaacagaacgctccataaacgagccgttaaacacatcttcaatttcatcaaaaattaaaagcgcctgcttgccgttcaatagcgtttgagcaagacgactgtagttcaggcgttgctctgcctccacaacatctccgtcagaatccatgtaagtaatgttatacgccgaaatccccaacgcctgtgcaagcaacccggcgaattctgttttaccagtgccaggcacgccataaattaaaagattcacgccttttcgatgatgttntagggcttggtgcanaataagtaacatcatctctttcatgccgggcatatggncaaaatcatccacgtgcagacctggcactggagccatttccgacaagattttaataggacgcttccctttaaggggtgcgtcccaaatcctcaaatccaaggttcgcccccctctcactagcttgccatttttggggcatactgccgactatc

SEQ ID NO: 212 - DNA, 1676 bp, H. influenzae
atttattaaattacgaataatttttcgtaagactataacctcaacaaaagaaacctataactaagggaaaaaagcaatgaaaaaaactactatcaatatttctaatggcattcagcctaaacgcttttgcacaaactaatttagcggatgtgcaactcaaagatttaaacaatcagccagttactttaagccaatataaaggcaaacctgtgtatgtcaaaatgtgggcatcttggtgtccgatttgcttggctggattagctgaaattgatgatttaagtgcggaaaaagatcgcaattttgaagtgattaccattgtttcgcccgatcacaaaggcgaaaaagacaccgctgattttattgaatggtacaaaggattggaatataaaaatatcacggtgcttttagatgaaaaaggcgaaatcattgacaaagcaagagtgcgtggctatccgttcaatctctttttagatagcgatttaaacctgaaaaaaaccgtaccagggcatttaggtgcagagcaaataaaagtttttgcagggaaataatgatgaaaagcggcttatttttaagccgcttttttatatcctcgtttttacataataaagagataaaatatcctacatagaaagtttgttcattgagcgtttggtagattgataaaaaatatatattataagcggtatgattttattgcttgataatagttttttatttttacgttatcgttactttttccaaataacgtgaaattcgcgatcttcttctcggtgagaaattaagaatttagcaaagacatcatccatttcatcttgtttattgactaagcccacccacacttcagcgtattcttcaggatcaatcagtacaccaatttcttcttcccaatcatgcggcgggttcaacaaattccacaccaccgcgttcttcaaattgtaggttgaataaaagaatataggcaggatctaaattttctccagccatttctaagaaaatatcggaagcaatatcaatggctgtatcgggatcaagctttttaatttctgttgccatagagttttgtcgtaaaggttatggttaatgaaagtgcgggtaaatttttttctcttttgatgcggcctatgccatattgttcggaagcgcagtgggtagaatgttatggaattaatcatccatcaccgtgcccctaccttcatgtgctgactcattttaagccgtttcttaatcggtattgagggcggtaagaaacccatgtttccaagattggacgcaaggtcccttctgctcctctcttctgtgtcttgacgttttccgtttattccatcccgtctttcgtgtccccgtctgttcatcttgcggtctttcctttcggttcctccctcctctcccccttgccccttcacctttagttgtctccgtttcaaccagagcttacttcctattttttcccattttattttgggtctattgtgaggaacccctctagccgtgtgccggttcggaattcactatctatctgtgctcgtcattctattcatgtaccattcacggtacctacggcccccccgttgtttactattattatggccttgtcatccatcttcgttttgttccgccatggtcccacgataccagcccgttgagctccaaacgacacgcatatcattttctctcct

SEQ ID NO: 213 - DNA, 1281 bp, H. influenzae
ttgataacgcgtacgggggtaaagtgaagctagagagggcggtatgttataggaaatgtaacaaagggggcaaaggaagtgtaaccgtgggaaaaagtgtgggcatcggttagtcgggaatgtggatagcggcagtataagaaggggaagaatataacgcggggaagatgatgtccgtgacgccaaaagtaaggcgaatgatgtggaaaatgcgggcgagaatatcaaagtaagggtagggattatggcgtgtttcgggaaaagtctatatttgcacagcatttagatcgtatattagagcgagaaattgaatttttaggttttagtcaatattcaacaaaattgcttgcagatgagctaggtaaatataactttgctgaaagtggcaccttgattttatgtcaatataatttcttagcgacagattatttgtttattgcattgcttgatagccgtcatagtatgttagtcgatgagcatttagatattcgccgtacagaatatttggatattactcagtttgatattgcggcacggataaatttgacggatttgcaagtaaacgcgaactctaatcgttatttaacctttataaaaggccgtgttggtcgcaaaattagtgatttttttatggattttttaggtgccgaagaaggattaaatccacaagttcaaaatcaatgtttattgcaagctgtgagtgattactgcgatcaaggcgaactcaacaaagagcaaactcaagcggtaaaaaaacaagtgtttgaatattgtaaaggtcagctttcaaatggtaacaatattgaattaagggaactttctgattcattacccactctaaacgaacagccttttgtcgtctttacggaagaacagaattatggtttggaagagagtattccaccaatacgttcaacattgaaatcgctaacaaaattctctgggtcaggaaagggcgttaccctaagttttgatgcggaattattgaatacacgtattcaatgggatcctatgacagataccctaaccatcaaaggcttaccaccaaatttaaaagatcaattacaaaaggctttacaatcagagaattaatttggaaatacacccaattttggatattatttgacagaacttttgcacaaattaaggtaaagaaaatgcaagttaaaacacttttaggcgcaacctttttagcattaagcctcgcttcttgttccaccgttgaaaagttgtatatcgaattgatgtaccgcaaggcactatttaaggcgactccgttgg

SEQ ID NO: 214 - DNA, 1288 bp, H. influenzae
ttgttggcaaatggcgtattcttaggcattacggcaattttcgggcaagaagctatgactgaatgggcgtggcggataccgtttttatcttccgttatcttagtggcaattggcttatatgttcgcctaaaactgactgaagccccgattttccttgcggcactcaataaaccgcagccaaaacgcttaccaatgttggaagttgtcactacttatttcaagccgtttttcttggggatgttaatttgtattgcaggctatgtgctgttctacattatgattgcctttagccaaatttacgccaaatctgccccaacggtttcagaggcaggatacgcaatgggattaggactttccccgcaaatttttaccgctttattgatggcaagtgcggtttctttggctattaccatcgccgtttcgggcaaatatatcgacaaaattggtcgccgtatttggctcatttggacaaccgttggcgttgcgatttttggtttatccttgccgttatttctcgaaaacggtacaactaccagtctgttttggtttttattcatcggtatggggttaattggaatgggctatggaccattagcgagttttttacctgaactcttccctactcacgcccgctattcaggtgcttctttaacctataatattgcaggtttattcggggcaagtgttgcagcaatcattgccttaccgctgaatgctcactacggcttaaaaggtgtggggatttatttaaccctaaacgctgtgttgagcttggttggattatggtttatttcagaaacgaaagataaattactatcctaagatttgaggaattaaatacaatctattaagcggttaaattttacataaaattctactaagaatttaaccgcactttcctttacaagccaaatattttctctacaataccccacctaacgatttaccttgagtaaatccctgacctgaaatcagacaaaagagaatattatgacaacccaattcaaaccagaattactttcccctgcaggctctcttaaaaatatgcgctatgcgtttgcttatggtgcagatgcggtttatgcaggacaacctcgttatagcttacgtgtacgcaataatgaatttaatcacgccaatttgaaaatcgggatcgatgaagcccattcccttggcaaaaattctatgtagtgggtaacattgcaccccataattcaactcaaactttattaagattacacctgtcatcattgaaacagagctttattattctgaccagcttatatgc

SEQ ID NO: 215 - DNA, 1738 bp, H. influenzae
  misc_feature (1576)..(1576): n is a, c, g, or t
  misc_feature (1699)..(1699): n is a, c, g, or t
  misc_feature (1701)..(1702): n is a, c, g, or t
  misc_feature (1715)..(1715): n is a, c, g, or t
aggaccccccgtcaaagttcgatggaacacattgcccttgctaactggttcaacacagaagtgcggtcaaattcagacaagattttaaccgcactttctactgcaaaatcacttattgaaaatcaagaaaaagtcttagtcggtgcggaatatacgttatttttaaatgctgatgaagtaatggtgcgcgccaacaatctcgccattgaatcagatgaaattttagaacaagatttccattattatgatgaagaaagccttgctttttgcggtacgcaagattttattcattttctccaatcttatgttgattttattgcttaactcactatgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgcttagaaagtgtgaaaattgccgataatctcgcttttgatgaagtcattcaaattttattagataacgaatatcgccaaactacaatggttgccgcacctggcgatttcaaattagaagatgatagcattgtaatacttcgccgtgcttttcctttccccgataaagcagagcctcagcgagttttgcgcttgcgttttagccataataagttatctcgcattgaagatttagtcacagtcaaaactgttgatgaatttcgtcttgcaccaaagttgattgcgatgttgcaatcagacaacgaagatcgtttagctattcctttacaaaattatccccgtttattaattgatacattaattttaacggaagatcgccgcttttatgaacataatggcattaatccagtggggattttacgcgcattaattgcgaatattcgtgcaggtcaaacggtacagggcggaagtacgctcactcaacaattagtcaaaaatttatttttatcgcgcgaacgcaccattacacgtaaagccaacgaagccttgatgtcattggttttagattggcgttacgataaaaatcgcattctcgaaacctatcttaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccttggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtgaactgggcgaacacaaaatatccagtttacttggcgcacgtattttttccacaatggatttaaaacaacaagctcaagcagcaaaagccaggggtcaataaccggttngcaattacaactgaaaatgaaaaatccccttttaaagggggccgagaatataacgggatattcgcacagcgaaaatccgggcagaattggggggttccaaatcccaatacggcggctttaatngnngcattatggcaanacgttaaaatggcccctttccac

SEQ ID NO: 216 - DNA, 1928 bp, H. influenzae
  misc_feature (1395)..(1395): n is a, c, g, or t
  misc_feature (1399)..(1399): n is a, c, g, or t
  misc_feature (1412)..(1412): n is a, c, g, or t
  misc_feature (1422)..(1422): n is a, c, g, or t
  misc_feature (1429)..(1429): n is a, c, g, or t
  misc_feature (1455)..(1455): n is a, c, g, or t
  misc_feature (1457)..(1457): n is a, c, g, or t
  misc_feature (1486)..(1486): n is a, c, g, or t
  misc_feature (1545)..(1545): n is a, c, g, or t
  misc_feature (1565)..(1565): n is a, c, g, or t
  misc_feature (1582)..(1582): n is a, c, g, or t
  misc_feature (1588)..(1588): n is a, c, g, or t
  misc_feature (1591)..(1591): n is a, c, g, or t
  misc_feature (1602)..(1602): n is a, c, g, or t
  misc_feature (1627)..(1627): n is a, c, g, or t
  misc_feature (1632)..(1633): n is a, c, g, or t
  misc_feature (1635)..(1635): n is a, c, g, or t
  misc_feature (1640)..(1641): n is a, c, g, or t
  misc_feature (1661)..(1661): n is a, c, g, or t
  misc_feature (1687)..(1687): n is a, c, g, or t
  misc_feature (1708)..(1709): n is a, c, g, or t
  misc_feature (1711)..(1712): n is a, c, g, or t
  misc_feature (1730)..(1730): n is a, c, g, or t
  misc_feature (1749)..(1749): n is a, c, g, or t
  misc_feature (1757)..(1757): n is a, c, g, or t
  misc_feature (1773)..(1773): n is a, c, g, or t
  misc_feature (1802)..(1802): n is a, c, g, or t
  misc_feature (1806)..(1806): n is a, c, g, or t
  misc_feature (1851)..(1851): n is a, c, g, or t
atccccggttactttatttatggaaaaatatcgaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatgggcgcgttgtacagaaaatgaaagtgaaggtcgcttcattttctacggtgcaatgattactgaaggggggaattgcattagtatggtgatggggtgggccttgcattctatgaaaatccacaagcgttacaagatgcaatttcagcaggttctccatctaaagttgtgtatgatagttcgttacatttcttatgttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagnatgngcaacttatttgntctacaacanaattggnttcggcttaaattatcagctttctgngnatccttggttaccaccacccatcggttgnatccgattgctctctcccatgcctaaaccattagcgacccgagatgaagataccttaancagcaaccagcgtataaacnggacgaaataagccgtntggagnggnaatcaaccgcntttctatttccagtaaccttacccnctagnngnccacnncctcgttttttaacctgtangttttcttcttgtcctttgcgctttnggtcgtttctcgtctttttgnntnnggggtcggggcgccgggncgggtggggcgttccggcnctatcttngttcggaagtggagangtctggactccacaccgccgcttcgacgnggcncatcgctgcgcgctctcggcgtgcgcgcccggctcacctccctcntccgcgtgagatgcccgagtcgtgcctgcgttcggggtccgcccgtggcgttcccccgccgtccactgctgcccgtg

SEQ ID NO: 217 - DNA, 2358 bp, H. influenzae
  misc_feature (427)..(427): n is a, c, g, or t
  misc_feature (572)..(572): n is a, c, g, or t
  misc_feature (593)..(593): n is a, c, g, or t
  misc_feature (604)..(604): n is a, c, g, or t
  misc_feature (2197)..(2197): n is a, c, g, or t
ctctgcaagtggataatgttcgccgtatgttgttggcaatggtggacgatttccgctgcgtgatcatcaaacttgccgaacgtattactttcttgcgtgatgcagagtatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcagttatttacgtgaaaatatcaagcaagtggaagtctatggccgtccgaaacatatttacagcatttggcgcaaaatgcagaaaaagaatcttgagtncagcggtttatatgatgtaagagcggtcagaattatcgtgcaaaaattgcaagattgttacaccgcacttgggattgtgcatactcaatttaaacacttacccaaagaatttgacgattatgtcgcgaacccgaaaccgaacggntatcaatctattcatactggntgttttagggnaaaggtggcaagcccaattgaagtacaaattcgaacccaacaaatgcatgatgatgcagagttaggtatggcggccactggaaattaaagaaggcaatacaggcagtatgtctgcctatgaagaaaaaatgcgtggttgcgtaaattgttagcttggcaagatgatattacggattcaggcgaagtgctggcagagttgcgtagccaagtgtttgatgaccgtgtatatgtgtttacgccaaagggcgaagtggtggatttgccaacgggatctacaccattagattttgcttacgccattcatagtgaaattggtcatcgctgtatcggggcaaaagttgcggggcgtattgtgccatttacctatcagctacaaatgggtgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatcaatttcttgcaaagtaaattgattaaagtgactgctgaagaagcagatcaagagattttacgtcatgttgctaacaaaagtgcggtcaattctcagcagaaatctgaaaagaacaatggctatgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacgacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataaaaataggaaaatttatgtataaaacgacggggctaacccatttaatcaattccacgaaatattcattacaaggcttaaaaagtgcgtttaaaaatgaaacggcttttcgccacgaatgttttttagcctgcattttaattcctcttactttctttttaggcgaaacaaaaattgaaattattattgatgatttctttctgttttgcttgtgatggcgttagaacttttaaacagtgcggtagaggcagttgttgatcgcattggtacagaacgccacgaactttcaggacgtgcgaaagatcaaggctctgcatcggtatttattgccctttgtattgtcggtatcgtttggngcggaattttattcttctaaccctccaaagtgcggtaatttttaccgcatttttgattatccaatccgtcaaattatttataaaatagggaaatatgaccgacttttaaaatgggctggtgccggttctgacgcgcatcacagcgttttaagtacagggct

SEQ ID NO: 218 - DNA, 1406 bp, H. influenzae
  misc_feature (1372)..(1372): n is a, c, g, or t
aaggggaaaggggggagaagaagactaaagggggcggggacgaacgggggtgggggggtccaataaatgagtggaaaatgggcgtccctaacgaagaatagaaatggagaggtgaacaccagccggtgaagaaaatcaccgggggggggaccgggccaaagccacaggggagaggatgcgagccaaaaagggtacacgcggccggtcacaattggtacaggcccgtgatgggatgggttcggcatatggtggctgaaaaaggtcactctgagcttccgcaaatggtggaacgttcaataaaaggcggcatccaattaggaccgtttgggggtcgcacaatacaacttgatcaaattaatgaagcctgtgagttaatgcacgaaggtaaatcgatccgcacagttattcattactaaggtacgttatgaaactgattgaacaacatcaaatttttggcggttcacagcaagtttgggcgcataatgcccaaatgttgcaatgcgaaatgaaatttgccgtctatttgccaaataatccagaaaatcgaccgcttggcgtgatttattggctttctggcttaacttgtacagaacaaaatttcattaccaaatcaggctttcaacgttatgccgcagaacatcaagtgattgtggttgcccccgatactagccctcgcggagagcaagtgccgaatgatgcggcttacgatttagggcagggagcgggcttttatcttaatgcgaccgagcagccttgggcgacgaattatcaaatgtatgattatatcttgaatgaattgcctgatttgattgaagcaaatttccctactaacggcaaacgttccattatgggacattcaatgggcggacacggtgcattggtattggcactgcgaaatcgggaacgttatcaaagtgtttctgccttttcgcctattttatcgccaagccaggtgccttggggagaaaaagccttttctacctatttaggggaagatcgtgaaaaatggcagcaatatgatgccagctcgctcattcaacaaggctataaagtgcaaggtatgcgcattgagcagggcttggaagatgagtttttgcctacacaattgcgtaccgaagattttatcgaaacctgtcgagtggcaagtcagcctgtcgatgtgcgcttccataaaggctatgatcacagctattacttcatcgccagttttattggcgagcatattgcctatcatgcggaatttttgaagtaagctaaagagcggtcagttttcaaagcagtttgggatagccggctcgagggcggtaaaaagtgccggcaatagtttattcagtctgaactagaagaggcccagctgcaagcggggatcctntaagagtcgaccgcgaggcatgcaagtcataggc

SEQ ID NO: 219 - DNA, 1539 bp, H. influenzae
  misc_feature (1390)..(1390): n is a, c, g, or t
  misc_feature (1474)..(1474): n is a, c, g, or t
atgtatctattggtgcgaacgcagtgattgaagaaggtgttgtactaggtgataacgtgatcattggtgcaaattgctttgttggtaaaaatactaagataggttcaggcactcagctctgggctaatgtcactgtttaccataacgttgagattggagctaattgcttaattcaatcaggaacagttatcggtagtgatggttttggttatgcaaatgatcgtggtcgttggattaaaattccacaagtagggcaagtaataattggtaataacgttgagattggtgcgaatacctgtattgatagaggcgcattagatgccacgattattgaagataacgttattatcgataacctttgtcaaattgcacataatgttcatattggcactggtacagcggttgcgggtggcgttattatggcaggtagcttaactgttggtcgctattgcttaattggtggtgcaagtgtgattaatggtcatatggaaatttgcgataaagtaaccattactggaatgggaatggttatgcgcccaattacagagcctggcgtatattcctctggtattccattgcaaacgaataaagaatggcgtaaaacagcagcactaacgttaggtattgatggaataaataaacgtttaaaagcgttagaaaagaaaatttcttaatttcttctgaggttttattacaaaatccacactttaaaagtttactattaaagtgtggattttttattttactaaacgtaactaaaaaagtttaagcccgttaattaagcagcttatcctataaaacaaataagcccaacttaagttgggcttattaacatatcgttatctttaaagaattacgcgttaccgccagtgatttttgcaacttcagcagcaaaatcttcttcttttttctcaataccttcgcctacttctaaacgaatgaagttagaaacagaagtatttactgattttaagaaatcccctacagatacagaaggatccattacaaatgcttgacctgttaatgaaacttcaccagtgaatttcttcatacgaccttcaaccattttctctgcgatttcttttggtttaccagagttgatcgcaatatcgatttggatttggcgttcgtgttcaaccacttcagcagatacatcttctgggttcacgaattcaggtttagatgcagctacgtgcattgctacttttttcagttcatcagcagaaccttcgcccgcaactaatacgccaatttttgcaccgtgtaagtatttgtgcaattacttgaccatctaggtaagcaacacgacgaataattcatgttctcaccgattttagcaactaatgcagcacgtttttttcttcaaattgcgctttgtaatgcttcgatnagtggaaccctttggtttgctgctgcgaaatcagctactttcgtttgctaaacctaagaaacctgcatcttttgcttacgaagncagtttccccaggttcatttcaactaatacaccgaaaccattttctacacgagcaaggatacacc

SEQ ID NO: 220 - DNA, 1328 bp, H. influenzae
  misc_feature (12)..(12): n is a, c, g, or t
  misc_feature (31)..(31): n is a, c, g, or t
  misc_feature (36)..(36): n is a, c, g, or t
  misc_feature (1312)..(1312): n is a, c, g, or t
cgggtctcggtnacccatgggtaacattatnccggnatccaacaaccattctttcgcctcaacagccgcatcattaccaatagataaataatgccccgacgtttccacaaaaccaccagttttagcgatatctttaccttgagcattaatattgccgtcaattaacgcaatatcgccccatacaatagcgcgcccgcctttttctttgcctgatacattaattgttgagcctttttctaaagaggttttctttgctaattgaatgccgtttttaccttcgccgcgctcgtcgccgccaaggtaggtctctcccccttctttacctgaaaggtcgataactgcgcctgtttttaatgtgactttatcacctgtaatcatcaacttaccgcctttggcttgttgattttgagcggaaatcacgccgccaatttccgcttcgccctctttagcggaaagaacaatgttgccgcttttatctttgcttacagaatcggcagaaagtttaccttggtttcgaatgtttgcagcgcggacattgatattaccacctttagcaaagatatcacctagattgattgcttcattttcaggtgcggcaatgctgtaagtaatggttgggtttattatatcgctgatggtgattttttgccctgcaagtaaagaaatgctaccgccatttacgctaattacaccctcattttttactttgccgccaataaggtttacgctaccgtctttaccaacggtaattaaaccgtgattcacgatttcagcgagcgctttatccttggtttgctcaagggtgaaattacgcgctttgatgttttcgttagaaatatctagcgtagaagccgtaaagccattagtgttaataattgcgtctttacctattgtgataccatttgggttgattaaaaagacttgtccgttagaatctaaaatcccttttaattgggagatttggtcagatgtaacacggttgaaaacggcagagttgctgctttcttgtaaaaactgcaccatttcattttggtcgatgttaaattgtttccaattgatgatagcattgacgctattacggatagtggttttattgccgtctacttgcatggttgctgtaccgtgtacgacgctcattccctgtaaaccgctcgctaaaacagattgcggaatggatgccatgcccaaagatagcaatatagcggaaagtggctttaacgccaagtggcgtactttcgtacgaacaggtttttcactgccttttctgtggaaggtcacaaggggtctcatagagagactcgcaggcagctgnctgtcgttgttttgac

SEQ ID NO: 221 - DNA, 1762 bp, H. influenzae
ggtataccatatcggactcggtaccctgtagaacgtcgctatgaacgttatacttatgcgttatctttattagataaagagcctgatttaaatggtcaagatcaaattgaaattgatcgtgaaaaagcggctgcgccacaaactgaagctgatgcgaataaactttgggatgctcgtgtaaaaaatgacattattaatcttaaattaaaagataaaaaatggtcagaaatcaaagcaaagcttacaaaacgctataatttagccattcgtcgtttaacgcaaacaaaagcagacgatattgttcaaatttatttgaatgcttttgcgcgtgaaattgatcctcacaccagttatctttccccaagaacagcaaaaagttttaatgaaagtataaatctttctttggaaggcattgggactactttacaatcagaagatgatgaaattagcatcaaatctcttgtacctggtgcgccagcggaacgtagtaaaaagctgcatcctggggataaaatcattggtgttgggcaagcaacaggcgatattgaagacgttgttggttggcgtttagaagatttggtagaaaaaattaaagggaaaaaaggcactaaagttcgcttagaaattgagcctgctaaagggggaaaatcacgtattattactttggttcgtgataaagtccgtattgaagatcaagctgctaaactaacctttgaaaaagtgtcaggaaaaaacattgcggtaataaaaattccaagtttttatattggattaaccgaagatgtcaaaaaactactgcttaaattagacaatcaacaagctgaggctcttattgttgatttacgtgaaatggcggtggtgcattaacggaagcggtggcgttaagtggtttatttattgccgatggccctgttgtgcaggttcgcgatgcttatcagcgtattcgtgttcatgaagatgatgatgctacgcaacaatataaggggttattatttgtgatgattaatcgttacagtgcttccgcatcagaaatttttgctgcagcaatgcaagattatcgtcgaggtattatcatcgggcaaaatacttttggtaaaggtacggtgcaacagagtcgttcgttaaattttatctatgatttagatcagagtccgttgggtgttttgcaatatactattcaaaaattttatcgcgttaatggtggttcaacccaattaaaaggtgttgcagccgatattaatttccctgaaattatagatgcgaaagaatatggggaagataaagaagataatgcgcttgcttgggataaaatcccatcagcgagttatacggaagtaggaaatatcgattatattgataatgcagtaaatattctaaatgaaaaacatcttgctcgtattgctaaagatcctgaatttgttgcattgaatgaagaattgaaagtgcgaaatgaacgcccgagatcgaaaatttctatcgttgaattataaaatgcgtaaagcagagaatgataaagatgatgcaagacgtttaaaagatttgaacgaacgttttaaacgtgagggtaagatagcattgaagatattgatgatttgccgaaagatacgaagcaccagatttcttcttaaaagaagctgaaaaatagcagctggattccgttattttaattccagatcagaaaattaatcaagcaacgggctatccgaagcaaaacgggaagtaaaaataataccaaatggggtttgaccgcactttgtttgaa

SEQ ID NO: 222 - DNA, 2591 bp, H. influenzae
tacgctcaatcgcatcaattcgctcatcggttgcattggatcggctgcctcaatcatcgcatctctaaattctaacgggattaatgatcagaaagttagttttacctgcttccatcggcccgcctgaaccgaagatagttggaatatttaaacgcattgccgccattaacattcctggagtgattttgtcacagttggaaatacacaccatcgcatcagcacagtgcgcattgaccatatattccacgctatcagcgattaaatcacggcttggtaaggaataaagcatcccaccgtgtcccatcgcgataccatcatccaccgcaatggtgttaaattcttttgctacgccgcccgctttttcaatttctgcggcaacaagctgtcccatatcttttaaatgcacatgccctggtacgaattgcgtgaaagagttcaccaccgcaataatcggtttaccaaagtcattttctttcattcctgttgcacgccataaggcacgtgcgcctgccatattacgaccttgtgtgctggtcgctgaacgtagtttgggcataaataatctctccgagtaaaatttagggttcgtttgtatgattaattaaccattaaaacatccggcagcttaaccaactgattcactaatagatctaaagtgcggtcagattttacagtgatttttaaccgcacttgggtttcaatgagtgtcatttccattgttgtaacggtaaatccgcagtgacgtgctacgcgtaaaatgtgttgcactgaccacatttgatgctgacccacatcagtacaaattatcgcattatttggtttgcgattagataggctgttgagtaatgcccaaggatcaatcgggcgattgccttgattttcaacataagtgaaatctaattttgctttgaaatttctgatttgttcacgccaaggttcaatagtgacaactggaatggagtccatcatggcatcgcctaatccaataactaaattagtggcaccagagcctgatgctgcaatacagacgcccacttttcccgtggagcgagcatagccaatcgcagccattgcagtcccttgttcattacgacaaagtaagtgatctaagcctgcgtcataaagggcatcgtaggttggcataattgcgccaccgggatagccgaaaagagtcgtgacatgatgtgctttcaagcacgccatgataagttgtgcacctgtcattgtgtttgtttcctgttatttttattttgggataagtttagcattgtagcgaaatttcgagtcattggtagggcttggagagaaaaaaacgaaaaaaagtgcggtgaaaattggcttattttgaatattcctgttcttcccctaaaaaatttagtgaatttttaccgctctttaagcttgcttattgactgattgttagatttcattatattgaaactcttttcatttttttacataggataatttatggtgcactcagctccaaaagcacaaaagcgtgagactttttctggtcgtcgcgcatttattctggcagcaattggttctgccgttggtcttggtaatatttggcgttttccttacaccacttatgaaaacggtggtggcgcatttatcatcccttaccttattgcattattaaccgcagggattcctcttttattcctagattatgccattgggcaccgtcatcgtggtggtgcgccactttcttatcgtcgtgttagcccgcactttgaagtgtttggctggtggcaaatgatggtgaatgtcatcatcggattatattacgctgtagtgttaggctgggcagcaagctacacatatttttctttcactggtgcgtggggcgataaacccattgatttcttcatcggtgaatttttaaaaatgggcgatattaaaaacggtatcagctttgaatttgttggtatggtaaccgcaccattaattgcgatgtggattgttgccttaggcgtgctttctatgggtgttcaaaaaggaattgctaaggtctcttccgtattaatgccagtgctcgtcgtgatgtttatggtgcttgtgatttattccttattcttaccaggtgcggcaaaaggtttagatgcattatttacaccagattggacaaaattatccaacccgagtgtgtggattgccgcctatgggcaaatcttcttctctctttcaatcggctttgggattatggtgacttacgcctcttatcttaaaaaagaatccgatttgacgggtagtggcttggttgtaggttttgctaacagtagctttgaagtgttagcaggtatcggcggatttgcagcattaggttttattgcaacagcgccaggccaagaaattagcgaattaacaaaaggcggattgggttaacattttttgcattccccaccattattaaccaagccccatggggggaaatgcttacgcctgcttatccttttggggacttaccctttgccgacttgacttcattcatttcaatattcgaaagaatgtttatccggcctttcagattaaattccctatagcccgcggaaagcgacactcttcgtgggtgtccacactgcctt

SEQ ID NO: 223 - DNA, 1579 bp, H. influenzae
  misc_feature (229)..(229): n is a, c, g, or t
  misc_feature (327)..(327): n is a, c, g, or t
  misc_feature (345)..(345): n is a, c, g, or t
  misc_feature (436)..(436): n is a, c, g, or t
cataaaatgcctctaaaataaatttgcactattatagtagtgcaaaaggaaagtgcaatatatttatatcgataaaaaggggacattcagtcccctttgtaatgttgtcaaagcattcattattgacggtaatcagacaaaaatcttgctaattttgtaatggcttcctcaagttgatttacataaggaagagtaacaacacggaagtgatctggcgaatgccaattanatccttttaccgtgcacaagtagcactttttcttggcggagtaaatccagcaccatttttttcatcactgcgaatattgaatttttttcacatcaatnttcggggaacatatacantcgccccattggtttcacgcaagtaatggccggtatttgagtgatgagatcataggctttgtttcgttgctcaagtaatcgaccgcccggntaaaataaattcattaatactttgatagccaccaagtgcggtttgaattgcatgttgcattggtacgttggcacataaacgcattgatgccagcatatccaagccttcaatataacctttcgcattatgttttggaccgtttaaaatcatccagccttggcggaagcctgcaactcgataagcttttgataacccattcagcgtaacggttaataaatcaggagctagtgcggcaatgtgatgatgcaccgcgccatcatataaaattttgtcgtagatttcgtctgcgaagataatcaaattattttgacgcgcgatttccactatttcttgtaataattctttgctatacacagcacccgttgggttgttcgggttgatgataacaatcgctttagttttcgcattcacctttgctttaatatcatcaatagcgggaaaccaatttgcttcttcatcacagagataatgcactgctttaccgccagaaagggttaccgcagcagtccaaagcggataatcaggcatcggcacgagtacttcatcgccatcattgagcagtgcttgcatagccattgtgataagctcagatacgccgttaccaatatacacatcattgacggtcgcgccgagaatcccttttgattggtaatattgaacaatggctttacgagcagaatataacccttttgaatcacagtagccttgagctgatggcaaattacgtagcacatccactaaaatttcatctggtgcttcaaaaccgaaaggggctgggttgccgatattaagttttaaaattttattgccttcttcttctaagcgtagtgcttctttatgcacaggcccgcgaatgtcataacatacgtgttctaatttgtcggattttgggaataatcgcatagtgaaatccttttgtttctaataaatttttcgagaaaagtgcggttaatttacgctgaatttttatattgaaaagatttgtaaaaaaatttttgtcattaacaatctgcggtagatacggctaattttttgtgtatttaaaacaaatctatgagttatttagcgcagcataaggggagttaaaacgcaaatcccgcatattacagcatcacgatgacctggccggtttcagtgaactgg

SEQ ID NO: 224 - DNA, 1534 bp, H. influenzae
agccgattagttagatatttcctggtaatcacgcaaattttattgcaaataaccctgatttttcttgttatcttatgaaacaactttctaatgaattatatgatgcagaacaccgaataagtaatacagcttataagcgtagttacgaacgtattattgatgccattgaaaatttaactgaaagttatcccgattatccttggacctaccgagaagtagcggaattttgtggatgtgaaactgaaaccgcaattcgtattagtagagagcttaaaaaacaaggaattttagataaaaatacacgacatctacgaatatgctcttaaaatttaccactgctcgctgattgtaaataatatatctaagtaatgattaaatcagataaagatttttgtaatatataaaataaaaaagcccactatataaagtgagcttctttttagaattaatttttattcctcagttgttgcctcagcaacttctggacgatcaactaactcaatgtatgccattggtgcattatcgcctgcacggaaaccacatttcaaaatgcgagtgtaaccacctgcacgttgagcaaaacgtggacctaattcattaaataattttgcaacagtttcaacgttgcgagtacgagcgaatgctaaacgacggttagcaacgctatctacttttgctaatgtaattaacggttcaactacacggcgtaattctttagctttaggcaaagtagtcttaatgatttcatgactaactaaagcacttgctaagttacggaacatcgcttgacgatgactactattacggtttagttgacgaccactcttacgatggcgcatgatcttatccttctcagaaaaatcttaacctatgaccaaactagtcttcagcaatacttgctggcggccaattttcaaggcgcataccaagtgacaagccacgagaagcaagaacatccttaatttcagtaagagatttcttaccaagattaggggtttttaataattctacttcagtacgttgcactaaatcaccgatataatgaattgtttctgctttcaaacagttagcagaacgaactgtcagctctaaatcatctacaggacgtaataaaatcggatcaaattccggtttttcttccttaatctcaggctgacgaacatcacgtaaatcaacgaatgcatcaagttgctccgccaagattgttgctgcacgacgaattgcttcttctggctcaagtgcaccattagtttctaactcaataacgagcttatccaaatctgtacgctgctcaacacgagctgcctctacattatacgcatttcgttcaaccgggactatacaagcatcaacaggcaaacgaccatttggacgttcttcttgcgtatgtgtacgaaatgaaacagggacatatcctctacacgccgaacacgttaccctactaattgaagcggttttcatcagttaaaggacaacccctggactgggattacaattcaacatccccttctggggtatgtcccgtgcaacaccg

SEQ ID NO: 225 - DNA, 1652 bp, H. influenzae
  misc_feature (1414)..(1416): n is a, c, g, or t
  misc_feature (1603)..(1603): n is a, c, g, or t
cggctcttttacctcgaaacccaattagaaaaactggtgcaagattacttggtctttggtaatgcttatgttgagaaaactgtaaattcctttggtaaggttgtttcgttaaaatcctctcttgctaaatatatgcgtgtcggtgttgaaacaggtgtgttttatcagattgtgaatggttttgatgaatatgaatttaaaaaaggttctgtctttaacttgattaatcccgatgtgaatcaagagatttatggtgtgccagaatatttggccgcacttcaatctgcttttttaaatgaaagtgccacattgttccgctgtaaatattatctgaatggcgcgcatgcaggttcgattatttacatgactgatccaacacaaaacaaagacgacattgaagcaatcaaaacacaaatccgacaaacaaaaggcactggcaactttaagaatttgtttgtgtatattccaaacggaaagaaagatgggatgcaagttattccattgtctgatgctatcgccaaagatgatttcctaaacattaagaacgcaagccgtgatgatgtgttagctgcgcaccgtgtgccaccgcaactaatgggcattgtgcctaataatacaggcggttttggtgacgttgaaaaggcaacgcgagtgttttttatcaatgagataatcccattgcaagaacgattgaaagaaattaatagttggataggggaagaagtgatcacattctccgattacaaattgctaaattagatccttttcaaaaataaacagcccgcagaaattcgggttttttttgctaaaagagctgtttttgtcctgtatagtattagcactgtcccagtgtattatatcaaatcaatcaatatgacaaatcttaaatccttatttcagctcgatttttcgcccaattgtacgcatgaaaaatcgcagtcaaaccctcgccacgcccgcacactaaagatgtcgatttcaacgcaattttagatccttgccgaagtcttttcagatctaccgacattcagatccttattatcaaattctttaacgcaaaattactcaagtaaatgcaaattttgatgatataatcattgtccctaaaaggcaaaaaatcatctgaattggcgtcttgttttttatggtagtaagcttggtagtaagctatttttaactatttaatatatcttttaaaaacaaagtgatatttatctagatcagctttccccagcaacgctaagccattgattctaatatgatcaaattgattaatccaatgtcacaatgttctgctggcaagttgaaaatgcctgcaggggaatcaacaatttttactattttgaaagataaactcaatgacttgttgcttgaaaaaaaattgtatttggtcataaaaaatctgcactttagnnntggtatttaatcccacttttggagtgcagatcaaaagtgcggccaaattttttagaattcttttgaaattaaactttcggctaattgcaaatcagtgggggagtcaatatcaatggaacgataagttggcattaataaaaacgcttggcgcataaaaaaccgttttcttcaagaacttcttgaggcntaaaataaatgggccattgcccaaaaaattgggtattttgaacaagggc

SEQ ID NO: 226 - DNA, 1403 bp, H. influenzae
ggcagattgcagctgcagtcgacttaggtccccggatatacagtaattaatattcgcccagccaagggtaaaataaaaagaaatcgccgtgataacaaataaaattgcgtaatctgaaacgggaatattctcacttaatacattgcctaatcccatattggtaaatatggaaaagagaaacaacaaaaaataaaaccatattgttttagaatgaattatttctttcccaaacatcattaacttccttttgcacaaaagtaaaaaagtgcggtgaaatttaccgcacttttgagcaaaatttatctcaaattatcatttaacctgttattgttgcacttcatcatcttgattgatgaaagagtcatttacctcaatttttgctctctcacgtaatccttgtattaactgaaattgtaattcagattgatgactacgcaataattgcataccaaattgcgacaattctttttcacttaaactgccttgttcaaccttattcaaggcaacaacaaccacatcgccatttgaattatgcaccacttgataaagagcttcatttgattttggtttagcaattgaaaatataccatttgttaaaataggatctttattttcacttaaagtaaaagtctgctcacttgagaaattaatgccatctacttttgattcagggttttcacttaattttttcactgcttgttgtgctttttcattaagcgcattctcagctttctgacgttttaagaaagtttcaatatcgattttagcctcttctaaactttttacgccctctgctttgcgatccaacacacgtacaataattgtgtgataatcgcctacattaattggttcagaattcataccaacattcgtagtatctgattcaaatattgtgtaaataacattagggaaatttaatccagctggcacattttgacgagaaaaataatcactctcttgaaccttaacacctgctgcttgtgctgcagtattaagagacttactgtcttcaaaagccttatcactcgcttgtttttctaaagaaaaataacgactctccattaaagatttacgaactaaatctgcaatttgagctttcacattctccaaactttgcgctttacgttcttgcactaacacaatatggtaattgccatccacattgattggttggctatattgccctacctgcaatgcagctgcggcatcttcaaaggcttttggtaattcattctcatttacccagcctaaatccccgccattctcaccagaaattttatccaaagatttcgctttagcgacatcagcgaaatttgcccctttctggaattcctcgtaagccactttcgcatcttgttcatttgcaaattgaaatgtgctaaatggtgagtcataaatgtgca

SEQ ID NO: 227 - DNA, 1260 bp, H. influenzae
aggacccccactgtctcttgaggtggcaatccgttctacaatcttccagcaagtgggatgaaaatttggaaaactttaaggaacatcaggcgttgttgggggcttatgggaagttgcagaaagcaaagcgagcacatcaaaaataaattaggcttatttcgtactttcaattcttgaaagtacgacctacttttctttgcttcgccaaagaaaagtaggcaaaagaaaagcgcccctgcttttccttatttcctttgtttcatacaatttgcttaaacggaaattttctaaactcgccgcaagcggctcaaacagacgaaaattgcctgaaaattgaaagtcgcaaaggcgatttatatggggccccgaatttatcagagcattatttaaaaagtgcggttaattttaaattcattttaagaacaaaaaatattttgagttttgaccgcactttaaatcggataaagaacaaattgggttcccttcttttccacctttgtggaattgaatttgtaggaaattttcgtctgtttgagcgcagcgagtttagaaaatttccgtgaaacaaattcaatggaacaaagggaataaggaaaagcagggttgcctttctttttgcctactttttctttggcaaagcaaagaaaaagtaagtcgccatcaggcgaaatcctgatatcaaaaaccacatatccacaattttatgctataatccgccacaatttttgatcaaaaaaggaataccaatgacggattcaatccaatcatctatcacccctgtcaatatcgaagaagaacttaaatcttcctaccttgactacgcgatgtcggttatcgttgggcgtgcattacctgacgttcgagatggtttaaaaccagttcaccgccgcgtactgttctcaatggatcgcgaaggcaataccgccaataaaaaatacgtaaaatcagcgcgtgttgtgggtgatgtaatcggtaaatatcacccgcatggtgactcagccgtgtacgataccatcgtttgtatggcacaaccattctcacttcgctatatgtttggttgatggggcagggaactttggttcaattgatggggatgcgccagctgcaatgcgttatacccgaagtgcgtatgcaaaaaatacgcaagcattgctcactgatttggataagaaaccgtcatattctcgccaaactttgatggcgaattattgatcccagatgtattgcccactcgtattccgccctttagcaaaaggtttt

SEQ ID NO: 228 - DNA, 1492 bp, H. influenzae
  misc_feature (68)..(68): n is a, c, g, or t
ccacaccacttggtttattaagtcttgcggcttggggattaggctatttcgggcaaccgcatatttangcacgctttatggctgcggattctgtcaaatcacttatcaaagcacgccgtattagtatgggttggatggtgctttgcttagcaggcgcaattggcattggcttattcgctattccgtatttctttgccaatccagctattgcaggcacagtcaataatgaaccagagcaagtatttattgaattagctaaacttttatttaatccttggatcgcgggcatattactttccgctattttagccgctgtaatgagtacattaagtgctcaattattaatttcttcaagctcaatcacagaagatttctacaaaggttttattcgccctaaggcttcagaaaaagagctcgtatggcttggcagaataatggtgttagttattgccgcacttgctatctggatcgcacaagatgaaaacagcaaagtattaaaacttgtagaatttgcttgggctggttttggtagtgcgtttggccctgtggtacttttctctcttttctggaaacgaatgacatcatcgggcgcaatggccggtatgcttgtaggcgcagtgacagtatttgcttggaaagaagttgttccagctgatactgattggtttaaagtatatgaaatgatcccaggctttgctttcgccagccttgcaattattgttatttcattactttccaataaaccagaacaagatattcttaatacctttgataaagcagaaaaggcttataaggaagcaaaatgatcgactttcgccctttttatcaacaaattgctactacaaatttatcggactggttagaaaccttaccactccaattgaaagaatgggaaactcaaactcatggcgattatgcgaaatggagcaaaattgttgattttctaccagatttacatgctgatgaaatcgatctaaaaagtgcggtgaaatctgaccgcacttttcccctttcagaaggtgaaaaacaacgaattatccatcatttaaaacaattaatgccgtggcgaaaaggaccttatcatcttttcggcattcatgtagattgtgaatggcgttcagattttaaatgggatcgtgttcttcctcatttagctccactgcaaggtcgcactattttagatgtgggctgtggcagcggttatcatatgtggagaatggtaggtgaaggcgcaaaaatggtggtagggattgatcctaccgagcttttcctttgccaatttgaagctgtacgcaaactgcttaataatgatcgtcgagcaaatcttatcccactttgtattgagcaaatgcacccattagcgggatttgacactgtattttcaatgggcgtactttatcatcggaaatcccattatatcatttaagcccaatgaaaaccccattggtaaagggggtggatggtcttagaaaactagggggggaggggcaga

SEQ ID NO: 229 - DNA, 2114 bp, H. influenzae
gagagaagaaaagagaagaggaaagaagaatagttagtctgagagagagaaaaggcaaaggcgaaaaaagagaagaaaacaggagcgcaggaaaaacagtaagaagggaaggaaaaaaagaataaagagaagaaaaaaaaaaaaaacaggaagaggagggagggagagagggaagaagagaaaaggggaaggagaaaggagcaaagaaatagaaaacaaaagtaagaggaaaaaagaactaatttatggcggctggagaggaaagagaggaaggcagatagaagaagggcatttaaaaacataaacaaaaaaagaataaaatagaattaaaggaaaaaagcgaggtgaatgaagtggcagatgagaccaacgagatgcggagtgcaaaaggagcaatagaaaaagaagataagggatgataatgatttgattatgcaaaatggggcaggggtaacagccggccgggaggggagtgttgttccgcaggcgaaaagaaaatatgaaaaattacataaagactgtaaaatagatatcttcataattatcaaatatcaatgcttctcacaaaatatccttaaatccataagccccaatatcatcggtattaattgcatcttgttgaagttggcgtttcatcatttttaaacttaactcataaacaaattcaaatttctgaattgcacctgcaattaaggtatcttgtacaatagagggttgcatatcaaaccaatttctgtctgaaatttgtactacggtttgctctaacgaataaaatgcagcgtctaatacatttaaatttagcttatcagtcatcatttttacctctgttaaatactcatctattttaccatagactattttttctcaaaacctataaccccaaaagtaaacattgtgatattgatcacaaaatcaaaaatatttgagaaaagctctcaacaacttaatgtgatatttttctaataaaatcaatctttaacaaaattatcttacgacaaaaaggtctaaaacactacatattgtgtgttgattatctttttagatctatatatagtgcaatccgcatttcaaaaacactatatattggagctatatcatgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttgccccttatgtgcaaatcagttacgaaaaacatctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggtttttgggtaggtacaagctggcatcccgcttattcagcaagctttttaaaaaacggattcgtggcctcggaaaaacataaaagcctggattccaaaactgttttcccatcaaaaaggtttaaccaa

SEQ ID NO: 230 - DNA, 2227 bp, H. influenzae
ctgtatacgatatcgactcggtacccggtttggttaaataatcgtcggcaccaatttccagacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcgggattttttacctgattttccttttttgtgatctaaatcatagttttaggtattcaaatttctttgtgatagaatttcgagcatctatatttttatactcaattctatgaaaaaactctttcttttttttacgctgattttcaaccgcttttgcggcttaattcagggtttattcgattaaaaaaccaaaacctttttaaaagtagatgatgcttttgctttttctgctactttatctacagataaaagccagttacaagcccattgggatattgccgatggctattatttgtatcaagataaaattagtgctgagttagtcggtaaatcaaattctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacacagtgcggtagaaaatatgccttgttctcaagttaaatttaagcaaattaaaaatactgaagaacttgaccgcactttaaccggaaatccgcatccaattgctatgttcaatttatacgcggattggggggttgcttgtaaagaatttgaaagctgacgtttccagatccccagtgccacagcaattcaaaaaatcttatgttacaagggaaattgacaaagcatagcccaaaaaattaagcatcatgggacgctttaaagggaagggaaatgcccaccattttattttttgaccaccaaaatagtaaattccagcgagttgaggaccggctttttgt

SEQ ID NO: 231 - DNA, 1147 bp, H. influenzae
gagacccctttccatcgctgcttgaatagcgatatcaaattgctgacgaggaattaactcacgcattttttcaaccaattcacggccacgatattgtgaattatctttatgaacgattaaagccaacgcatctactcgttcgctgttaatcataatatccacgcgaaccatatctgccgcttggaaacgtttaaaaccgtaatctaacgaagcataaccacgcgaggttgattttaaacgatcaaagaaatctaaaaccacttcgcccattggaatttcataagtcagcgcaatctgattaccgtgatataccatattggtttgcacgccacgtttttcaacgcaaagggtaataacgttacctaaatattcttgcggcaccagcatattacattctgcgattggctcgcgaatttcagcaatattattaagtggaggcaattttgcaggactatccacataaacaacctcgccattcgttaattgcacttcgtaaattaccgttggggcagttgtgataagatctaaatcatactcacgctctagacgctcttgaatgatttccatatgcagaagtccaaggaaaccacaacggaaaccaaaaccaagtgcggtcgaagtttctggttcatagaaaagtgatgcatcgtttaaacttaatttaccaagcgcatcacgaaacgcttcataatcatcagaacttacaggaaaaagcccagcataaacctgtggttttacttttttaaagcctggtaatacttcagttgcagaattatgttgatgggttaaggtatcgcccactggcgcacctagaatatctttaatcgcacaaacaacccaacccacttcgccacattctaaaacagtcgtatcttcttgttttggcgtaaaaatccctaaacgatctacgttgtaagtttgccctgtggacatcactttaattttatcgcctttacgtaataccccatttttaatacgcactaaagataccacgcccaaatagttatcgaaccaagaatcaataatcaatgcttgtaatggcgcattaggatcgccttctggtgcgggaatttttgccacgatttcttctaatactcttcgatacccacacccgtttagggagaaccgagtcgatatccgaaaacag

SEQ ID NO: 232 - DNA, 1301 bp, H. influenzae
caacttgtcgagccgcctcacttatgtaatgacggtcgcaggcgcaacggtcggtttcggtgcaacttggcgtttcccttatcttgtgggtgaaaatggtggcggtgcttacgttctacttttctgtatcgcaatgattgtaatcggtatcccaatgattttagttgaaaacgtgataggtcgccgtttacgtgtaaattccattgatgcgttcggcgataaaattctcgacaaaggaaaaggcatttctaaatattggaaaatattaggttatatgggcttactcggcgcatttggcattatggcgtattatatggtgcttggtggttgggttatttcttatatcattagcctaatcagcggtacattagacatttcaacccccatcacaaaagacattgccaaaaatttctacgatcttcatatcggcaatagcccttatgaaattatattctacaccctcttatttgttatcgtgaattacattatcttggcaaaaggtatcattggtggaattgaacgttcagtaaaatatttaatgccattactatttatcttcttaattggaatggtaattcgcaacgtaacattaccgggcgcaatggaaggcattacattctatttaaaacctgatttcagcaaaattaccccacaattatttatcttcgttttagggcaagtcttcttcgcattaagccttggttttggtgtattaattaccctttccagttacttaaataaagaagaaaacttaatccatactgcagttattacaggtttcaccaatacaattattgctgtacttgctggctttatgattttcccctcacttttcacttttgggattgaaccaaacgcagggccaactttagtattccaaagtttacctatcgtattttctcacttatgggcaggtaaattctttgcgattatcttcttcggcttattattaattgctgcgctgactacttccatcacaatttatgaagtaatcattacagcattacaagaaaagctcagaatgcgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgctcttggctgtgctattttcgttggtttcgtgttaaaagatgaagccaaaaaagaactttcttcaacaaaatattcaactttcatcaaaatttggtttaactacgtgaaatttg

SEQ ID NO: 233 - DNA, 700 bp, H. influenzae
agagacccctgttatttttagtaatttggggtgtagtgattttcaaaaaagaaatcgaagcattaattaatcgctttataccaaaactgcaatttgtgatgaaactcatcggtattgcagaacgtattgcaagtccagtcgaagttattcttttcatattggctgcagtgcttggtgcatacacagggttcttactttctgcattgattagctatccaatgttgaataacccagtattacccgcattatttttagcctctggcacatcatctggtattgctgcaaccttcttaattatcttaattgcaggaaaactaaaaggtgattctcacgaatcgcacttcatccacaaatttgaagtgccaattatggtgacagaacttggtttgattgtgtgtttcttcgttggattacattttggtggcggacaaaaaacagttgccttacataatgccttatctggtttttggggagcgatattctgggttggagtattgattatcggtatcttgatcccattaatcgccaatatgtttgtaaatgaccgtttaaaatacaatcgtaactttattatcttggtgtcaatttttgacttaattggggtattctgtttacgtttctttgttttatatgcgggacaactcactgtagcctaaactgactttttataaaaaattatgctgcatataaaaggggtctc

SEQ ID NO: 234 - DNA, 2050 bp, H. influenzae
ccatacaaggcgtccaaccagaactaaaggttaaaccaagcacaaatgcctcaagtgcggtcgattttcctgatgtttttatttccaccaatttcgtgcgttccaacaaaccaattttaaaaatgccaagttgatgaatacccaaaataatcacgataacgccagcgataatgcgggtagtgttactaaataaaatattccctaaaaagccaaaactaaagcctaaactgacaaatgtaagggaaagccctaaaataaataaaaaagtattcaggacttttttaccacctttactcaaaataccaaaataaattggaataatcgggaaaatacaaggcgaaagaaaagaagcaagcccagctaaaaatacagttccaataaggagttgctgatctaacatcctacatctccttattttttaatggattgaatcaaatatccgtatcctgccttttccatttcagctaacggaataaatttaattgatgcactgttaatgcaataacgcaaaccgcctttatctttcgggccgtcgtcaaaaacgtgtcctaaatgggcattgcccgcacgacttaacacttcggtacgttgcatattgaagctattgtcggtttcataatgcaccacatctttaatgatcggtttcgtaaaattggccagccacaacctgattcaaatttatcatttgaagagaaaacaggctctcctgtggtgacatcaacataaatacccggttggaaattatcccaatattcgttactaaaagagcgttcagtatgtttattttgagtaacggaatattgcaacggtgtcaatttcgctttaagttctgcatcactcggtttcggataatctttttcatcaatcacaggttcatctgctttggtaatatcaatatggcaataaccatttggatttttcttcaaataatcttgatgatattcttccgctacgatgtaatttttaatcggttgtacctcaacttgcactggttttttatatttggtttgaagctgggcgagagcttgttcgatcaccgctttatctgccccatcttgataataaatccctgtgcgatattgtctaccacggtcgttaccttgtttgtttacactcgttggatcaatcactttaaaataatatttaagcaatttatctaacgaaatttggtttgcatcgtaagtaacttttaccgtttctgcgtgatcgggtagcccaatcatatgataactggttttccccgtattaccattggcatagccagaaatcgcatctttcacaccgtgaatacgctccatatatgcttccataccccagaaacaaccaccagcaagataaatttctcggatgttttgtgtattttccattgccattttttgttctccagatgatgatgttgaattttgtattgctaaagttggtgtagcactgcaaagtgcggtaataaatagaaatgtttttgatagtttcattgcttttccttatgaagtaaaaattaacgttacataaggttagacggcggataattcgatttcttacagatttttgcaaaatttttaaagaaattgattaaaatccattgttataaccaataataaagcgttaagatgcccaatctccccctcttttctaaggtaaaaatctatatgcaatcacattccattccttcactttatcacaaagcgattagttttatggtatcagcgtacttttccattaccttgatgaatgtatttgtcaaaacggcttctcaaacaatccctgcaagtgaaaccttattttcacgctttttaatcggcttgcttttcttacttccttttgtgattaaagatcgcgattttaaagtggatactcgtcaatggaaatttttaatcctgcgtaatgccgcgggtgtatcgaatatgttgattaacttttatgtcgtgaagttcttaccgctttccatcgctgtcttattgatgaatacctctgccctatttatcccgattttattgctttttttccatcaaaaaacaccgcttaatgtgcttttatgtagcttaatcggttt

SEQ ID NO: 235 - DNA, 2031 bp, H. influenzae
atagcgatgtatcaattctgtctgtaatcccaaagcaggctgttggcgtaaagatgatgattcgccaaattaaatagttgcgtcagcattattgtgggctctaagttgtgctttaaaatggtttgaacatttgccttgatttctttggcattgtcacccttcacacgttcgccttttatttgcgatgtgcggtcaataatttcacgaataaaaggtgcattttcgttcattgataccctcctatttttcgccgatcctagcacttctgtttacaataaacaacaaaaaagggctttcgcccttttattatgctctgtcccacattgaacttcttgctctggcttggcgttggttttcaatgcgttgtatttgttttgccacttgttgtgcaatggctcgttcgtccatgccttgtgcggcattgatggtgatatttacgctcattggttggctggtttgcgtcatcattggacgagcaaaaattggtgcacgagtatcaacttgcacaggggcggcagttgcaacgctgatccccaatccgcccgcaataagtgctcgtttgccgtaattaagggcgttgagcgtatttacaccaaggcgtgatgtggcttctttggtcatcacgtattcgccaccgtggacaatgcccatgggttcatatttgccaccgtttccagtgtagccgcctgaccaattttgactcggtaattttttgccatttgaaccaaagccagtgaaatccttaaatgattcccaagcacttcctgccgtttcttttgttgattgccaagcgttgctcgaagtgttttttgttctttcccatgcactagatacactatttttaattccctcccaacttggcatattttcagaaatccacttgataccatccattaatcttgttaatggggtcagaataaactcaatcgctttcgccattccatttccgaatctttcccctgcactgactgcagcatctaaatcttctttggtactttgtactggagacaataaatcagtaaaccatttcaccgctttttcaatccaaccgacgacaacaccaaatgcggtgcctagcggttggaatttttcaaggacgggggcgagacctgattttaaaccctcccaaaaaccgccaaaaaaggctttaataggttgccagaatttataaattaatgcagcaacggacaataaagctatccctagtggactgatagccagtgcaattaattttagcggagaaagtaatcctcttaatattagccgccctgcagatgataaatgtcctgaaaatttaggaataattacgtttaatttggataagcctaaaaatagccgtgcggctgggtaaagtataaaacttaaagcaaggcttaatgcacctaatagacttaaacttcccccgattgcaactgctgtttttgctatagtagaggttaatttaggatgttcatcaatccatgtctcgattttatcaagcaaattgccaaccccgtccattaagctagtcatcgaatcttttaaactggctcctacagaactatttacgttgaataaacgatttttaaataattgccattttgctgataaagtagtcattctggtttgaaattccctagccatactatttttagcttcttcgctatttgccagttcaatttgtctgcgccattcttcggtattggcaacaagccctgctaattgggtattataatttccgcctgcaatatcgctaattacgccagcctgttaatgcttaggcaatttttctattttttcaacaatcatcattaatgtgccttgtgcattttttaccattgctttttgaatcgcttttggatcttaacctaacgcttttagtccgtttttaacgggttttattctagcggctttacttagacgggcgcacgttctttcgaccgctttggcttgcgccctgccttcccccccttcttttctcccgttgcccacccccatcccgattctcctcctatccccgccacttatctccttcccgtgttcctcagccca

SEQ ID NO: 236 - DNA, 2107 bp, H. influenzae
  misc_feature (1285)..(1285): n is a, c, g, or t
atggtatacgaatatcggactcggtacccataagtttacataatatttctttaaagtgacgaaccaaaatttagatggtctgacgttaattcaaattcctggatttagtgatgaagaagtcgtatgttcacgtttaaaacgcgatgatatggaaattgttccaaaggcaagtactgaaattcgtatcaacgatattttgcaattagtgggcgatgataattcgcttgccaaaatgcgtttaattatcggatacgaagttgatgcaccaactgttgcctatagtggcgaaattcgttctgagcgtgtggtggtaacgaatgaaaaagtattaggcaaaaagatccgtgccttaggcattcatcaaaaatatggggttgtgatttcacgtttaaatcgtgcagggattgagttagttccaacgggaaataccacactgcaatttggcgatgtgctacatatggtcggacgcagtgatgtactaaatcaggctatttcagtcattggtaatgcacaacaaaaattgcttcaagtgcaaatgttacctgtgtttatcggcattggtttaggagtactcgttggttcgattccattctatattccaggtttccctgttgcgttaaaattagggcttgctggcgggccattggtggttgcgttaatcttagcgagaattggcacgattggtaaactttactggtttatgccgcctagtgctaacttggcgttacgcgaaattgggattgttcttttcttggctgtggtcggtttaaaatcaggcggaagtttctttgatactttagtgaatggttcgggacttgaatggatgggatacggtatttttatcacctttattccattaatgattaccggtattttggctcgtctatatggcaaactgaattaccttacaatctgtggtttacttgcaggttcaatgacggatcctcccgctttagcatttgctaatgaaattaaagaagataacggtgctgcagcactttcttatgccactgtgtatccgttagtgatgttcttgcgaataatgtcgccacagttattggcagtgttattatgggcagcatagtaaaaataatttcaatttagacataaaaagcgcggttaatttcgcgcttattttttgcgtggattttgcgcaagagggtattcaatgatagaattccgcacttttattgctaagtgagaacaaaatggcgttagttgaatttttgatggaaaccttagatgggttaaagggaacagatattgtacattttgatgtacgtgngaaaatcatcgattacggataatatgattatttgcacgggtacatcgagccgccaagtttctgcaatggcagataatttaattacagaatgtaaaaaagcaggttttgaaacttttggtgaagagggtaaaaatactgcagattggattgtagtggatcttggtcaagctatcgtacatatcatgcaacgtgacgcccgtgaaatgtatcaattagagaaactttgggcgtaaatattagtaaagtgcggtgaaaaataaccgcactttttagataaggatgacttgtgaaaatcacgttaattgctgttggaacaaaaatgccttcttgggttacaacgggttttgaggaatatcaacgccgtttcccaaaagatatgccttttgaactgattgaaatcccagcaggtaagcgtggaaaaaatgctgatattaaacgtattttagagcaagaagggaaggcgatgttagctgcctgtggaaaaggcaaagttgtgacgttagatattcctggtaaaccttggacgacaccggatctagccgatcatttacaagcgtgtaaaattatggctccacgctttgtttgttgtttgtcgcgccttatggttttctccccgaaagtaaatgccccgccggaattatattttcccccttccccaaggacataaccttagctccctgttggtgttgacgacgctgaccccccgcccccccccgcgtccgccccccccacgtctttccttttctttataaccccctttcccttttcccacgcgcctcaccttacacagagtttttagttttttcttttctgaccctgcta

SEQ ID NO: 237 - DNA, 2964 bp, H. influenzae
  misc_feature (2060)..(2060): n is a, c, g, or t
cacgccaacgaataacgaagcggccggaacgaataaagaccggacgcgggcaaagggggagagaggcgagaagaagaaacatgacaaaagcggcggagaagcgcaacaaacggggaaagcagacgaaccgggagggcaacagggcgccggcggggtgacacgaaagggagttcgacgggggtaagagacgcgcgcggggcaaataaaacacgcaaacggagtgcccggagggaaaaaaaaaggtgggacgacagacgaaaggccgatggattggggggaaaaaggaggtacgaaaggaggacggcggacaaaaaaagaaaaggagggccacgcgagggatacgggacgaaggaaagggggcaaagagagagaaagccgggggaagcggttagagaaggggggaaagcaaaagggggggagggggggagaaggcgtaaagggatatgaggagggagggtaggggaggaacaggggacggagaacagagggacatggggcggtagcaagacggagggggagcggggagaggaagctgtgaaagcgaggcgatgaatgcaaaagtagcagctacggagaaagaacgttttgcgaattcaaggggggggccttttagtaaaaagtatgagctaatggctaaaacaaaaaatgcgcctgtcacataacctgcagaaagagtatgtaagaatttactttgtgcaacagggtttaaccaaagatctaagaagttagtcatttccatacgtacagtttcaaaattaaattttgaacctgttggtgcttgcatccagccatttgcaaccaaaatccacatagcagataaattagaaccgaaagccacacaataagttgctaataagtgttttccttttgataaacgatcccaaccgaagaaaaataaccccacaaaagtggattctaagaagaaggcaagtaacgcttcaatagcaagtggcgcaccaaaaatatcccccacgtaatgagaataataagaccagttagtaccaaattggaattccataataataccggtggtcaccccaagggcaaagttaataccaaataactttccccaaaattttgtcatatctttataaacttctttacctgtcgccacataaatagtttccataattacaagaataaaggataaacccaatgttagcggcacgaaaatgaagtgatacaacgcagttaaagcaaactgcaagcgagaaagatcaacaacgtctaacattctcaactcctttgtataaacaacattagttccaacaatgattaacaaggcgatgccttaaataatccctaattactcaactccaatcagctaagtttatattgacttatctacataattatttttaaaggttaaaaaaacaccagttattatagagataatccaaattggcggctattctactactaaacataaggataaaaaatagtaaaaaatgctatatagatcacatttttgatataaatacaaaaatagggcttatttgttatatttcatttaattgatttagatcaaattgacatttttgcaataatttttgttttaaagatgattaatttcattgtgtaagatcatattttaatatttgtctcaaccaacatcatctcttgatgtttttaactgcttgaataagtatgtagtggcatttaatacttaatttatcattcaacatttgtaatgtaattgttgatcctttccaaggataaaaaggattaagccaaaactagcattgagttcattgcgcaaatcaggtaaactaccatcccgtctttgatagctaattatcttcgatttttgaccgcacttttggttgattttgtctgtaagatgattagctataatcatttatattccaatacagattaggttccctatggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggngaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagctagccaatccagtgtgagaagtaaccatcggtatggtatgcaaacacactgagttacccgatgcctataatcaccaaatgaatcctttaaacatctcagtttcaccaatctgcttaattctagcattaattcttattattccctagaatgttaacacaaaagggcccgatatttataaaggcccgcgatggccatctttgttccagtgtgcattcgttacacggttttaaa

SEQ ID NO: 238 - DNA, 1573 bp, H. influenzae
tgttatcgaatatcgactcggtacccgcaaaagtttatgtttaaattggattcgtttaagcgtgaaaaaaccttcatacaaagtttgttcgcccaatatttctatatcttgttggctaaaatgttgaatttctgacatctgttttctccaaaactgcacgcaaaatcatacgcttaaaagactacaaaaaaaatagaaggtttccactttttgttgagagtttgaagtgagtcacaaaaaaacaaaatgccatgattatttattcaacagtcatagcattcttttttagaagtaagtgaaacagtatttcactccatttttacaaaataagcatcttacaaaaccttactcacaatttttccatcagccacttgagttgtaatgaagtccccttgattgacatctttcacgctaacaatggctttaccttgcggattttccgcaatggaataacctctcgccaagacttttaatgggcttaagccatccagttttccgcataatgttgccagtttattttgacgttccgtcacttggcgatttacgcaaaaatttaaccgcacttttaactgctctaagccttgttgataacgttgtatgcgatatggcaatggattttgttttaaacgaacagaaagtgcggtgaatttttgttgtgtattttcaaactgacgcaatattgcaagttgcaagcgatgtgtaagctgttcattcttcgcttgttgagcacgtagctgattctgtggatgttgattttgcaatcgtaaggcaagctgtttcaaacgctggctttttcgcgtaaataaacgatcaaatgccatatctaaacgttgctgttgatggcgaagttgctgcaataattcatcttgattacgactaactaattcagccgcagcagaaggggtcggcgcacgaagatctgcaacaaaatcggcaatcgtcacatctgtttcgtgtcccaccgcactgataatatgtaaggttgaacgaaaaatcgctcgcgccacttcttcttcattaaaacaccaaagatcttctaatgaaccaccaccacgccccacacttaatacatctacttcttgtcgcgcattatcatgtttactcattcgcacaatttctcgagctgcctctttgccttgaaccgcatcgggacttatgaccacttttagcttctctctcctcgctctccatcttctttctctcctccttttccgccctccccttgttttccccttcccctcccctcccttttcctttcccttccttttctcttgttgctttttggcctcccttcctgcttcccccttccctctctccgcattcactctttccaccgccttcttcagttcgtcacccttctttccttctttttccccttttccccccccgttcccctcttctctttttttccctcccccttcttccccttttccccccccttcttccaccttctcttcctcccctgtcatcatcccccatttacccgtttccacttcccgtattaccctctttcgcccctttctctctcctcctcttcgtgttctcccccgctcctttttcccttctcctttct

SEQ ID NO: 239 - DNA, 2068 bp, H. influenzae
  misc_feature (1966)..(1966): n is a, c, g, or t
  misc_feature (2001)..(2001): n is a, c, g, or t
tagttgttttcatagcctttggcaatgcagcacttccatgagtgttccccgattttcatgtagggttgagtgacgtccttggatcttgaaaattcatggaaattgctcgggcgcggatttattcatttcagcattcggtaaattaactaattctttcccttcaaaaatggcagagcctcccacttcacccttggctgccaataaacccattaaagcaaaggctgtttgtgacttgcctgatccactttcgcctacaatgcccagcgtgcttcctgcattcagcgtgaagtttaagtcattcactgctgtaacgacgccatctggtgttttgaagcgaacgtagagattttttacatctaataaaggattcattattcgctcctatctatctttcggatcgagcgcatcacgcaacccgtcaccgataaagttaaaacaaaatagggtaaggcaaaggaaaaatgccgggaaaattaataaccaaggcgacacttccatttgtgcagcaccatcacttaagagtgcgccccaactactcatcggctcttgtgtacctaatcctaagaagcttaagaatgattcaaatagaatgagcccaggcacttcaagcgaggcataaactgccactaagcctaatacattcggaataatgtgtttcaaaatgatttggcgacgaggtacgccacaaacgatggcggcttcgacgaattctttattttttaggctgagggtttgtccgcgtacaatacgtgcaagaccaagccaggcaatggccccgatagcgataaaaattaagaaaatgttttggccaaaaagggtcaccaacaaaatcacgaaaaacataaatggaaatgagctaagaatttccaaaaagcgcatcatcagcatatctgttttaccgcctacataaccggaaatagccccataaattgtgccgatagtcacggaaatgaaagcaccagcaataccgaccaataatgaaatacgtccaccgatagcagtacgtaccaacaagtctcgacctgaggcatcggtaccgaagaagtgatagccttccattgttggtgcggagctcatcatattccaatcggtatcttcataggtaaatgggaagaaccaaggcgctacggtgataaatataataataaacgccaaaataatcagactgacaacggccgctttgttgcggaaaaaacggcgtttcgcatcttgccataggctgcggccttccagttgcatttcttcaatacggtcagccacttgttccacaaaatccgcatttttctgattaatcggctgagtacgataatctgtcataacttatccttaataacgaatttttggatcgatgatggcgtataaaatatccacaatcgcattaaataaaatggttaatgcccccactaaaatggtgaggctcaaaactaaagagtaatcgcggttcaatgcgccgtttacaaataataaccccatgccaggtaaaccaaatacgctttcgatgaccattgagccagtaataatccctacgaaagcaggtcctaaataggttatcacgggtaaaagtgcgggacgcaaagcatgttttaaaatgattctcgacatggaaagtcctttagctttggcggttcgaataaagttggaatgtaacacttcaatcatcgaaccacgcatgatacgcgcaatccctgcaacataagcgatagttaaggaggctacaggtaagatcatgtacatggcggtaccgccgttccaaccgccagctggcagccatcctagataaatggcgaaaattagcactaaaacaggtgcaaatacgaagcttggcataatgaccccaagcatcgagaaactcatcaaaatataatcccaacggctattttgattgagagcggcgagcgtacctgctgttactcctagcacgactgcaaaggcgaaggccaccattcccaaatttatggaaacaggnaaagctgacgcgattaaatcattgactggatgggnctttatatttaaaagaaggaccaaaatctcctttgggaaggattttctaaaataagaaatattgtta

SEQ ID NO: 240 - DNA, 1333 bp, H. influenzae
gtttctaaaataaattttttaattgcaagatattgttctctactctctttatacagcagaacaaagatgtgtttcaccacaagtatcagttattttttgttgccctcctgcagaaaactcatctcttaaactagtgtttattactccatgtttagtcactagccatagtgcgaatttatcatatttatttctaggatttcctaagatcgtttcagggaagaaagcatatgcttgagcaattaacatatctcgctcatatttttctattaccttccagtgtctaactttgggaggggcaatatcatctaaaacattgtttgaagtccaccataaactttcaccttctattaatagagatttatagtatttagctacaggagttattggattatctaattctcggagagaatcatatgtggtctccattttttcaaatatgctctcccccttttctaataacatatctattttatatctagggtaatgggttacagctatatcacataaacacgactcatatggtttggataggaatttaatatttccacctaatttaccaaatgttaagaaaattttttctatatttggaattcgtgtagactcaagaatagaactgccaattgaagtccatttatctccttgtgtactttttacttcaataccataatattgactagctacaatgtctggaaaatgtttccctgatactaaactaatagtgtcttcgaaaggagtattttgagcacaataacaaatagcctcatatacatctttttctaaatcaataccactacgtttcttatagtatgcaattctattttctgcatcatgattaagaaaattatcgactctattcattaatgccgtgaattcatgtaaaggtggatacttatttttagagaaaatcataaataaatcctatttaaaataaagattccattttttttctatatttttagcaatattataagctaatacacatggtaccgcattgccaataattttataggcattactagctgaaacagaaacgttttctgctgttttaggtaaaataaattggtatctatcaggaaacgtttgtaatctagcacattctcttatagtaagacgacgttcgagcatgcctttagataattcgttaatatatttccctccatgctctatgcttagtctacgatattcaatattaccatgatgttcagatcggattgttgggccaacagaattaagtttaatttcaacctgcccttgacaatggtttcccatatatttggcttttgaatatttcttgtgagaggggtctttgactaaaattgggttactgtagact

SEQ ID NO: 241 - DNA, 2287 bp, H. influenzae
cgtgaatttaaatctgtcgtcggcaccgtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctgggtaaaaaagtgcggttgattttaaccgtactttaaaaaaccaaaaccccgaaacgttaaagcattttcggggttttctattattgtgtgattagcttatgcagtaaatcgcttgcctgttgtatatcttgctgaatgtttttgttgaacacaaacagatagctatctccatttggaatgctggaaaaaaagaactccacaaggcgtttttgatcttccagttgtgcgcctgtaatggcttgctggaagttggcatattgtgatgcgtaagttaccatttttgccattgcctgtttaagttcatcactgacaagcggtagtgtaagttgttttggctcgttacggtgcattgctaagaacgcacgtaatacgatcaaatggaattttgggctaatccacattgcgtaggctaaaacaagttcttcgcaagcgtaagtgccgccttgagtgccgcgaatagttttaaatgcgcagatctgcgcatttagatcttcgtcttgaatttctttaattaattcttgagtggtttctaagcggataaattgatttgggcggtgtttctcttttcgaccgctagcaacgtgtaaatcgtttaaagagaaaagattttcgtatgaacgaatagaattgttgagaatggttaagtttgacatatctgattttccttttgatggaacccctaattttaggttagggcgatcgacagctcaaaactggtcagataatccagcggacgtattcccttgcggtattgtattagtcgcactgtcgatcattgaataaattgttaatttttgctccgcacttctaatgaattaaataatggtggtttaactcactaaaatttggatacaaaaaaatcacactaacggggtgaaaaccgtatctgataaaggtttttgagaccttaaattaatcctaatgaaattctcggccattgtaaagagaaaaaagtaaattatgagcatagtaaaccttttattttcagcccttgcgggcaagcgtacgacaattggtgtattggaattggacgcacttttaaccgaaaacacatcactttctagccaaatcacggaatatcccattgaagacggtacggtaatttccgatcacattacacgggaaagtgagcggttaagccttagtggtgtgattactggcacaggaacattgtttaatgttggcttagggaaatataaattgattgcagcaaaagagacgttgcgagaattacacgctaagcgtgaattagtgacgattgttaccggtcttgatgtgtatgaagattttgctattgaaagccttgagattgagcgcaacagtgatgacggcgagcggttaaatattagtgcggaatttcgaaaaatcaaaaagtgacgttacgcaaggaagaggtgccaccagtagaaagccgcgccaaacgccaaagcaaagcgggacagacgaaagtaaaaaccggcaaacacaaactgggcagccgcctaatactcatgcccaaaaatttcgagtttcgcgaatggactgggataaaagaaagacaccaataattttggcaattttacccatctcaccacttatcaaactcgttgataaagcctctttttttcttctttttgaaccgaccct

SEQ ID NO: 242 - DNA, 2092 bp, H. influenzae
  misc_feature (2063)..(2063): n is a, c, g, or t
acgtgtttaagtttcatccctttttcatatttgcccgaaaccacacgcataaacgccactctgtcacggtgtttcggatccatattggcttgaattttaaacacaaaaccactgaatttttcttccgcactttccaccgttcttgtatccgcttgacgagattgcggtttcggcgcccattgtgttaagccatcaagaaaatgatccaccccaaaattacctaatgctgtcccgaaaaatacaggggtaagctcgcccttaataaaggcatcttgctcaaattcattacttgcgccttgcaccaattccaattcatcacgaagctgttgtgctaaatcatcgccaacagcaacatctaattcaggattattcaagcctttaacaacacgcactgcctgaatggttgaaccctgccctgattgatataaataggtttcatcttttgcaagatgataaacgcccttaaacaacttcccacagccaattggccaagtaattggcgcacaacgaattttcaacacattttccacctcgtccaacaattccatcggatcacgaatatcacggtcgagtttattcataaacgtaataatgggcgtatcacgtaaacgtgtgacttccatcaacttaatcgtacgttcctccacccctttggcagagtcaataaccatcaaacagctatccacagcggttaaagtgcggtaagtatcttcagagaaatcttcgtgtccgggggtatcaagcaaattcactaaacaattattataaggaaattgcatcacagaagtggtaatcgaaatcccacgttgtttttccatttccatccagtcagatttcgcgtgagccgccgagcctttgccttttacagaacctgcagtttgaattgcattgccgtataaaagtactttttcagtaatcgttgttttacccgcatcagggtgggaaataatcgcaaaagtgcgacgtttattaacttcttctaatggataactcattgtttcttctttgttcaattaaaaatgtgggctattttccctgattttaggtttttgctcaaacgaatttgtaaataaagtgcggttggttttcttagaaatattggtctgctttgtacaaagacaaattttcgcttatactacgcaagttttttacgctaacaacataggaaaaattatgggtttcttaacaggtaaacgcattttagtcacaggtcttgcaagcaatcgttccatcgcttacgggatcgcaaaatcaatgaaagaacaaggtgcagaacttgctttcacttatttaaacgataaattacaaccgcgcgtagaagaatttgccaaagaatttggttctgatatcgtgcttcctttagatgtggcaaccgatgaaagcatccaaaactgctttgcagaattaagtaagcgttgggataaatttgatggttttattcacgcaatcgcatttgcaccaggtgatcaattagacggcgattacgtaaatgcggcaactcgtgaaggctatcgtatcgctcatgatattagcgcatacagctttgttgcaatggcacaagcggcacgtccttacttaaatccaaatgccgcattattaacgctttcttatttaggtgcagaacgtgcaattcctaactacaacgtaatgtgcctagcaaaagcctctcttgaagctgcaacgcgcgtgatggctgctgatttagggaaagaaggtattcgtgtgaatgcaatctctgcaggcccaatccgcaccttagccgcatcaggcattaaaaacttcaaaaaaatgctttccacctttgagaaaacggctgcattacgtcgcactgtcactatcgaagatgtgggtaactcagcggcatttttatgctctgatttagcatcgggcattacaggcgaaatcgttcacgttgatgcaggtttcagcatcactgcaatgggcgaattaggcgaagaataatttttcttacattcttttttaggcaggcttttcagtctgcctttcgctttttaaaatataacgatgtttcaaaataactatgtttcaagataattatgttncaaggggtaccgagccgaattcgtaaaca

SEQ ID NO: 243 - DNA, 1549 bp, H. influenzae
  misc_feature (288)..(288): n is a, c, g, or t
  misc_feature (1512)..(1512): n is a, c, g, or t
  misc_feature (1522)..(1522): n is a, c, g, or t
ctttgaaaaaatattagaactttcttcaaaaaaaataacctaaggttacccagccaaaattatagtttaaatgggaaaaaacccaacgatgaataggaagaatagattaatagaagctttaaaattaattgattctgaaagtattccaagtggagttcgccaagcatatgcccaattattaaataataagtagatgttgtttactaacaaactctacagtactgcccccacgatggcgcactcttcccagcgtgtgcctaacttcaataaaaacacctcaaaaactcnccgcactttaatttctagggcacgcgttgggaaacgcgcgtcggcataagcgttaaacacaaaagtgcggtgaaaattttcaacgtttttagacttattgcaacaaccaatccaccacataaatcacttcaatcccatcaatctctgtttgttcgtaatatttccccgtaattaaaatctttttatagttatctttaatatgcaaaagattatctgtttcgtgggtattttcagggatttcaaaagcgacttgtacatataaaatttcatcagcttttcgggcgataaaatcaatttctttgctgtcgagtttacccacatcaacggtataacctcgtctaagcaattcaataaagacaatattttctaggcgattggcataattcgcaccttttttgccgatagcgtgtcgtcttaaaccgttatccacaataaaatatttggcattggtttttaaatagccttttccgcgaatatcgtattgttttgctttataaaaaagaaaggcattttctaacaaatcaagatatttgcttatggtgtgatttgaagtgggaacacgttcggacgtgagcgtgttgctaattttgcttggattcaccaactgccctacgttatccgctaaaaagagaattacacttttaagaatatgcgtgtctttcactccagctcggtgggcaatatcatttagcacgatggaatcaaaaatacccgataaaatcgtttcttttaaaggctcatcagccatcacaacgctggggaaaccgccatatttttcatattccgaatagagtttatcgaccaatcttgattggctatccacatttttggcgtgcaaaaattctttgaaagaaagcggataaattttgatttctacataccgaccgcttaacaacgtcgcaagctcgccggaaagcaagttagcattggaacctgtaatcacaatgtcagcgttaaaactcacgcgaagcccattgacgattttttgccaaccttccacaaactgaatttcatcaatcagaaagtagattttcttttgagaagacggcattttttcttgaatcagctgttgaaaatcttgagcgtctttcacccattgatattcaaaagattcaaaattgagataaagaatattttcggaagcaatgccttgttgttgaaggtaatcacggtattgcatgagtagcaccgatttaccggaacgacgaacacccgagggggatnctatagagtncgacctgcagggcatgccaagtctggc

SEQ ID NO: 244 - DNA, 1184 bp, H. influenzae
ccgatactctgccttagaaatgcttgggcaagtcagttgcatcgggtgttattccgtgtcgtaccaaaagactatccagctgaatttattgatgcactaaaccaaaaacgtggcagatgaactctttgctcgaggagaagcgaatattggcgtgactaaagtaggcgacaaacaatcactgaaaatgactaccctaagcccgattgcaacattggaaaatgttaaagcgttattaactcaagtactaacagaagcaaatcgcattaaagatgacatcaaaaatggcacttacacaccacccattgattaattagttagtcaattaacacaaaaaataaccgcttgtatctgaaaacaggcggctattctgtaaaataaaaatcttttagcatagatcaaacgagatatataaattttatccattagataactacctatatttttgaaatattcatcattttaattttcaaagaatataaaaaaatggtaaaactaaccgcactttatatcattattctatccacttactaagttgaaaatcatgccagaacttcctgaagtcgaaactgcactacgtggtattagcccttatcttaagaattttacgattgagaaagttgtcgtgcgcaagcctaaattgcgctgggctgtatcagaagaattaataacgctaaaaaatgtaaaaattgtcgatctcactcgtcgagcaaaatatttgattattcacacggaaaaaggctatatcatcgggcatttaggtatgtctggatctgttcgaatcgtgccacaggatagtgcaatagataaacatgatcatattgatattgtagtgaataatggcaagttattacgctataacgatcctcgccgtttcggtgcttggttgtggacggagaatctagatgactttcatcttttcttaaagttaggccctgaaccactttctgatgaatttaatgcagaatatttattcaaaaaatctcgtcaaaaatctaccgcacttaaaactttcttgatggataacgctgtggtagtgggcgttggaaatatttatgcgaatgaaagtttgtttatttgtgggattcatccccttaaactcgctaaaaatttgacgcgcaatcaatgtttctctttagtgaaccgattaaaggaggtttgggaaaaacccatattcaagtgggaca

SEQ ID NO: 245 - DNA, 1146 bp, H. influenzae
ctatattaaagaacaagaaaaattagtatggatgttccaagcagcgtgccaaacttgccataattaatgaataaatttcaacgctaacgaaaactaacctgcaattaatctaactcaataaagttagattaatttaatttgtctaagattaaatttgatccagcaaattacctcaaaagtaagagtttcctatttagaataagaatgtcaaattcagtctgaataaaggaaactcttatacctattattcacagtgatctctttaaactaatttagttaatttagccactaaatttaacgttttttaaatcagtaaataaatctatagaaataaatattgtagagcgttaaaaattttgattattaactatttttttagttgataaaatatattcttgagaatttagagttaaattaataggataaaaaataatttaaaatgaagaaatattaaatttgttagctattttattatttcttgtccaattagataaaaaaagcccctaaataattaggggcattaaaaaggaatttatgaataaaatctctaaagtttagcttcatcaaaggaatctcgataaaacgccaccattatattgagtaatctaaagaatagcaagaaaaatctttacatttctttacaaatctttacatttcagcatttcgataattacttggacagtattttccatgccttgtaaagaaaccaactcgtgtttactatggaaattatagccgccagtaaaaatatttgggcatgctaaacctttagaggctaaaaatgccccatctgtaccgcctcgaatcggcttatgatttggtttaattcccaccgctttcattgcgcgatcagcaagttcaattgattgaggaacgttttttaccacatcatacatattttggtagctatcttgaatttctaactctataggctttttcaaaccttttttagcattaaatttttccacctgatttttaataaaagcttttctttgtgcgaaattctgttcgtcaaaatcacgaatcaaataggtaagctctacttgctcaatatcgccagaaaaatcttctaaatgataaaagcccgctttcccatcggtttttttctggtacttcatcaacaggaaaacttgctgaaatcacaga

SEQ ID NO: 246 - DNA, 2155 bp, H. influenzae
  misc_feature (1910)..(1910): n is a, c, g, or t
  misc_feature (1988)..(1989): n is a, c, g, or t
  misc_feature (2091)..(2091): n is a, c, g, or t
  misc_feature (2093)..(2093): n is a, c, g, or t
  misc_feature (2103)..(2103): n is a, c, g, or t
cctcgcggcatggaggggaagggttatccttaaccccggcgatgctaaatcgaggatccccattgccggtagtaggttggtcatcattaatgtcccgccattgtgtgttctgtagtgaattgaccagttagcgttgagtgagcattggcgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcatttttatcaaaaggtgcgccatccacgccgaaagtggtaacagatattcctacaatatcttttaaatcaatgccttgttgtattaattgattgaaggtttgagttgcacaagagattaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagtgcagtcaaaaatccttatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgctccccaatttgccatgactgaatacacatcagtaaatgcaccttttccagttaaacgtggaacaaaccatgttgttggccaagtttcattagtacgttgatttaatttattatgtacatcttgaggtaggtcgattgaccatccttcagcaatttgtagaacgggacctagacctttaataaggttaatgcggtgcattgtaaacggtatgccacctttggttaggaattgagaagataaaccgcccccacgaaaatattcgtgaacagcaggacaccaacgcgtattttctaagcaacgttttgcttcttcttcggtgacatcccatgccggttttaaggttggattgccttgagcatcttgatgctctcctgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcatagcctccataaaatctccgtttggcaaatgatcagtccaatgacgctgcccttgaaaacctgctgcaatggcattatggcctaaggcttcttctgcataatttaatgttgctaattttggatttcctaccatcaaatcacgagtgataatggtcattttcacaacattttcccatagttctgcacgctcttctgcattgcgttgattctctaggctattacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaaagctgatttacatagagcctgncattcccatggaaactgacccatagataataaggatttcctcgaatacttgcacagcagcccagcacgagcaaacgcnnatatttttctttcatctcaggatagggtggggcatcaagctcttgacctctgtaccgaaatggaaagccttggagtcctaattgaaatgaccagcagggcananctaataacgnccctgggcgtttggggccttaatcccaaatgcttagctttgaaggtcataaa

SEQ ID NO: 247 - DNA, 1809 bp, H. influenzae
  misc_feature (1504)..(1504): n is a, c, g, or t
gcttaataatggattaattcgatttgctatccaacctaataacggcacacccaactgttggataacctttaccgttaataaagcgtgatttacacaaccatctttaattccaactacaagtactactggcatttttcgttgagtaatccaatctgcaaaactttttccttctgccattggtgtcattaaaccaaaagatccttccaccacaacagattgataagtttgattcaaatgcgttaaatcataattaattttatctaatttaattcgcattttatcttgcgtgagcatgggtgcacagtggctaaaagtataactattaatatcctgataagacacattttcttttgttgaatgcatcagcgttaatacatcagcatttacgaaatgatcataatcagatgtattttctgattgtgcgataggataaatactctcttctccacaacaagcaataggtttatagccgacaacttgcactccctgctcttgcaaggcttgaatcattgcgcgcgctgctgttgttttccccacattcgtatctgtccctgcgacaaaaaagctactcatttttttctcctttaaaaagtgcggtggattttaaaggaattttttatttaataatttgagataacgcaaattttcactttttttatcttataaatagacaaattatttgatctcactcaagctattaaataaaccatcatcttgttttgctatttgtaagtaaaatccttggcgtttaattgtttccaatacttcattacaatctacattgtatagtgctttacgcccaagcagattaaacatcatcactaattctggtttaccaaaatgttcgagtaaaacgctgggaactaaagaaaaatcctctctattagcaacataaaggtaacttcctaacttctttttacttttataaatggcacatagcatatttaatttcccgaaataaaaatccgcacattttacgtgcggattacaatttatcatttcctatttttgaactgtggctaaaaattctttacgagtatctctatcttctaagaatacgccaccataagcagatgtgacagtataactatttgtatctctaataccacgtgctttcacgcaaaaatgggtcgctttcacatataccgccacatcatcggtttcaagaatggtttgaaatgctgtcaaaagttgctcagttaagcgttcttgaacctggggacgttgcgcaaaaaacgagcacaattcgattaattttagaaagaccaatcacccaatcttttggatagtacgctacacaaactttaccatcaatcgtcacaaaatgatgttcacaagtgcttgctaaagtgatgtcattcacttgcgccatttcggtgactttcatctgatttttgattctcgacattttaggaaaattggcataatccattccactaaaaatctcatcaataaacattttagctaaacgatttggcggtggttctaaactatcatcccgcanaactaatccgatcagcttcattacttcatgcatgtgtttcgcaatgctttcttcgacgttcatctttagcctgtgctggatcaatcataggtgtctcaatacctttttcaatcaaggcatttcttacattcagagcatccagggaagatttgctcataataggctttcctagaaaataagcggctattctagcaaggatattggatggtgaaaagagaaaaatgccatttgaatgaattagctttaaattaaaaagccgcaaattttatcagtagggtttttatgcttacttgggaccagctcga

SEQ ID NO: 248 - DNA, 1804 bp, H. influenzae
  misc_feature (137)..(137): n is a, c, g, or t
  misc_feature (218)..(218): n is a, c, g, or t
  misc_feature (1777)..(1777): n is a, c, g, or t
atagctggaacgttcgctttttgcctctttatatgaatttacaggacggcaattttcacaaggcatgaaagaattgcttgattattcagaaaaatcggcagaaaaccgaaaacttgcacaacaaattttaatgcggngattattctgatattacgccaatttcgattgagcaattatgggctcgttgtccagaagatattttgtgcgtaatacgcccnaaacaaattgcgtggcatacaagtttgctggtggatttcgttgaggcattattagtgaaaattagtaatcgcttttcacttggcggcacagaagtgtttatttattgccaagaccaaccgcacttatttaataaagtggtgagtaccattggcgcaaaaaaattcagtatccacgatgcacagattattacgacacaagatggttatgtttttgatagctttatcatcacagaacttaacggagaattggttgaatttgatcgtcgccgagaattagagcaagccctaacattagcccttcaaagtgaaaaattgcccgcactttctattgtgcctaatcgccagcttcaacattttactgtacaaaccgacgtgcgttttttacaggaaaacaaaaaagaacatactcaaatggaactggttgccttggataaagcagggttattagcccaagtgagccagatttttactgagttaaatctaaatttattaaatgcgaaaattaccaccgtaggcgaaaaagccgaggatttttttattttgacgaaccaatttgggcaagctctggattctcaacaaagagaaatattacgtaacgtgctgtatcgaaatattggatagtcctttttataaaaatatatttctaggtaaatttgccttatgttatcctttacaaaaaattttagggtcacactatgctgagtatttttgttacttttcttggcgcgtttttaacattgattgtgatgcgaccacttgccaattggattggattagtcgataaaccaaactatcgtaaacgtcatcaaggcacaattccactaatcggtggcgtatcgctttttgttggtaatctttgctattatctgatggaatgggatcaacttcgattaccgtatctttatttgttcagtatttttgttttattggcgattgggattttagatgatcgctttgatattagcccttttttaagagcaggcattcaagcaatattggcgattttaatgatcgatcttgggaatatttatcttgatcatcttggtcaaattttagggcctttccaattaacgcttggttcaattggtttgattattaccgtctttgccactattgcgattattaatgcctttaatatgattgatggtattgatggattgcttgggggactctcttgtgtttcttttgcggcgattggtattttaatgtatcgagatgggcaaatggatatggcgcattggagttttgctttaatcgtatcgattttaccttatttgatgctcaatctagggattccatttggaccaaaatataaggtgtttatgggggatgccgggagtacattaattggctttaccattatttggattttgttattaagtacgcaaggaaaagggcatcctatgaatccagtaaccgcactttggattattgcgattcctttgattgatatggttgcgattatttatcgccgtgtacgtaaaggtaaaagcccattccgtccagatcgtttacatgttcatcatttaatggtaagagcgggtttaactggggtctcntagagtcgaccgcaggcagcaagctgg

SEQ ID NO: 249 - DNA, 3057 bp, H. influenzae
atgttggcggaatacagactcggattccgttaaccttgcagcccttctatatatccgcaccaaacttttttaagcgggaaataatcgattgaactaattcttctggtgcagacgcgccagctgtaatccctatggtttttacatcattaaaccaatcatcttgaatatcggaaggatcatcaagaagctgtgatttaatccccattcgagacgccaattcatttaaacgatttgaatttgatgagtttttagaccccacaaccaacactaaatctgataatttagccaattctcgcaccgcttcttgacgattggttgtcgcataacaaatatcgtttttatgtggcccttgaatagcgggatatttttcctttaatgcagcaatagtttctgctgtatcatctagcgataaagtggtttgcgtcataaaggttaaatcatcattgtcttgcattggcaaacgtgcaatatcttctactttttcaatcaagaaaattccgccatcttcattactatactgccccattgtgccttcaacttcagggtgtcctttatgtccaatcaaaatcgcttttgttccctttcgacttgcacgagcaacttgcatatgcactttggtcaccaaaggacaggttgcatcaaatactttgagattgcggtctttcgcttcttgtcgaacggcttgagatacgccgtgcgcagaaaaaatcacgatcgcaccatcaggtacctcgcttaattcttccacgaagatcgcaccacgatcacgcaatccgttcacaacaaatcggttatgcaccacttcatgacgaacataaatcggtgcgccatgaatttctaaggcgagttcaacaatactaatagcacggtctacaccggcacagaatcctcgtggattggctaaaattatcttcatttttgaccgcacttttctacttgtttatcttgtacttttttcttttcgctcttaaacgcatctaatgctaataaccctgcgccaatacaaatggcaatatcggcgatattaaatactggataatggtaaatatcccaatagaaatcaaagaaatccacgacgaaaaccattgtaagtgcgatctaccatattcgctaacgccccaccaatagtcagtgcataagcagaattttggattttttgttcggcattattttttgctaaaaaatagaccaacattcctgaaatagccaatgccaacaaaataaagaaatattgttgccaaccactatgatccgctaagaaactaaatgctgcgccataatttcgaacataagtcaggttaaaaacaggcagcacattaacactttcatacaaatcaaatttttgtaccgcaatgtattttgtaagcaaatcaaccacgaaagcgaccgcacttaaccataaaaatgaaagccctgattttttggacatactatttcccttttaaaaaaattccgctaattctagcacaagccgataaatgataaagcacgatctcatttactgaacggcttctggtaattttgctggatcatcagccaactctttaacatttacaacgttattccaatcaaatactttaatttcctgtttttcaggatggaagaaatccacgccttgtaaatgtttttccttaattcccatccaatcagcaaaaccataaacaaaattaaatgccgattgtggcgtttttattttttctagctttttactatcactcgaaaacataacgaaaggaatttcataattttgtttataaagattatttggatgcaatgataaaccttcagaatcctcataatgagcaagcccatgatcagaaaagtaaatcaccgaatagggttcattttgcgatactaactgcgaatttaatttttctaaaaactgatccgtatatttaatcgattctaaataacaagacatagattgattaataaaataatttttaacttcgtacggaagacgctcacaaaaggctggatgtgagcccattaaatgaatcacaattaattttggattcgtaatattttcttttaaggctttatctaatacaggcaacatttcatcgtcataaacttttttagagttataacctaacggcttcataaaaatcgtttcatctgcactttgaccaatacgagaggccatcgtatcaaattccccaattttgccttgattagaaatccaataagttttcacgcccgcttttttggctaaagaaataatattatccgtataaaccgtttctcctttatctgctcgatatagggtgtgttgtaaagacggttgcgtattcggtgctgcagaataataattttcaaaaactgtgcttttcacacgctctaaaaatggcgtggttttcagtggaaagccatataacgacatataatcttttcgcatactttcaccaataattaaaatataatttttatattttggcgtaaaagattgaatatcccattgagacggcgcattaacggattgatttagaaaatctcgttgttctaaatatagatcattcattcgatcaaattcagaataaaaaagaactggataaaaacggaatttataggcgtagttccaattagaaaattggttataagaaaaaactaataataggctgataacaaccatatttagccatttaaatgcttgttgtttaacataaaaacttaatttcattaaagcaacaaataaaatgatataactaacttgaaataaaaatatccaaaaaggaatggttgtgtaatattctaaggtttcattaatattcgcttcataaacagaagcgataatccccaaagatggaattcgatagaaataaccagcagagcattaatatagcgcactgaggaataatacagtaattaatattccccccaatgccaggggtttaaatattaataatcgtccgtgataacaaataatattgcgttaattttgaaacggtatatatctcacttattaccttttctaatcctaatttgtttattttcgaatgtaaatcaccccacaataccccaccttgtttttgtatgtttttatcctccccatcttct

SEQ ID NO: 250 - DNA, 1086 bp, H. influenzae
  misc_feature (1030)..(1030): n is a, c, g, or t
  misc_feature (1052)..(1052): n is a, c, g, or t
  misc_feature (1067)..(1067): n is a, c, g, or t
atggtatacgaatatcggactcggtaccctttatacttagataaatcaatttggtatacagcaaatccaacttcatctgtacccacttgtttcattggatactgtgctttttctttgatgaattgagctgcttgttcgcttggtgaggtttcaaaacggacatctaatttatcgttacctgagataggcacaaaacgccagtttttatccgcgctagggtttacagaaccttctttttcactggttactttaatgtaatcagctaaaatttgacggttttcatctggtgatgcgtaaacaatatgttgatcgccagtgcctgggaatttattaccgtaagcacgatagttattcgttgcaatcaagaattctgcttttggatcaaccggtttgccttgataagtgagattcactacacgatgcgattctgggttaatcaatttacattcaccatcataacgtgcaggtttagttagatcatattcataattgacaccatcaatcacatcaaagttataagtgcggaaaccttcccagtcgattaatgattgtggtttatcacttgtagggtcaatttgtttaaacataccagcactacattctaaccattcttttaattgttcgcctgttgctttaacaacgactaatgtatttggatagagatataagtctgccgcattacggaaagttaattcacctttatttacttcggtataacctgtagggtcatttttacgaccaccagctttaaatggcgctcctgcacttaaaataggtaagccagccattgctgcaacatttggtgcaactttttctacatacgctttttgtgcttggttcactatttggatggttggatcatcttgcactaatgcaagatagctgtacatattgtctgtggctttaccaataggttgagaaacaaacttacgtgtagcttcgtgaactggttttaaaagtgcggtaatttctgggtcatttctgcaagcactttttattttagcatcatagattggcacgaagtactganctttcaccagaagagtggggtnacccgtagatcccgnataattcggtaatacccta

SEQ ID NO: 251 - DNA, 2213 bp, H. influenzae
tgtatacgatatcgactcggtacccgtgttattttggtggtggcaatgttaattgcaccaggaattaccgcacttacgcttaccaaatcttttgataaaatgttatgggttgctattgcaagttccattgcatcaagcctaattggcgtaatattgagctatcattttgatgcctcaacaggtgcttgtatcattcttctgcaagctgcattttttgttatagcattagcttatagcaaaattagaacaagataattttccttcccccctctttctcaaagaggggttatataatcacaataaatttatccgtttgtggaaaaataaagtcattagtctgagactaaacctaagccaaatccaaccccatttgccaaaacgcaatttccattctagtggcggtggtaaaaatctgttgaatctcggtaagctggcttgagtttagcggtttacaaagtgcggtaagaaaatcaacggtttcttgggcggcttgttgaaattcctcgctcgcataagtgtcaatccacgtttgataagggttgttcggtaagcgaggataatgctgagtaatgtaacgagcaacttgagcataacccaaagcacaaggagtcacagctgcataaagctcagccaaactgcccgtcatgccgcaatcaagcaaatagcgggtataagcaatacaagcgggactttcttgagtagcaaaaatctcttgctcactaattccccactcacggcaataatttaaatgtagttgaatttcttggcagagtatctctaaggttttgcgaggtatttccatttcagcgaaattttttgctttatacacgcccaaggcaaaagctcggctgtaatgaaaaagatagagataatcttgctttaaataatgctgaaaacaagcttttggcagcgtaccttttgcgagctgttgcacaaattcgtgttcaatatattgttgccaataaggctgggcttgttgaatgagttgttcaatcatcttttttccttattcaatttctaccgcatattctttcaacgctaaggcttttggaattaagcctttttgttgcataaattctgccatttgttgataacgtttagcgtctaattgacgaggtttattggctaagaaggggagcgtgtctttccacgccagttgatttaatggcgtgttgagttcgttcggtttatagctgacaaaggcttgccacgcttcattggggtgagcttgcagatagcttgtggcttgttcaagtgcggtcaaaaaggcggatgtttttttatctgttacgctgtttttattggcaactaaaatcaattcatcataagcaggcacgccatattgctcagggaagaatgcgacgccttcttgcttttctaaagcaagctgattgagttcaaaattacgaaatgcaccaatcacagcatccacttgtccagttaaaagagaaggcgaaagcgaccaatttacattcactaattccacatctttattgcttaaaccaatagaatgaagcatggtgtcaagcaatccatcttcaaaaccgctgacagaataccccacttttttaccttttaaatcagcaagggtttccaaattgctcttttttagtaccactacgctatttaatggatttgaaatcagtgaccccactcgtactaaaggtaagccttctgccacttgttgataaagctgaggctgataactcacggctaaatcaacttttcctgccgccgctaatttcggcggtaatgcaggatcagcaggttcgataatttcaacctccaagttatttttttcaaaaaagcctttttgttgagccacaatgatggctgcatgatcggggtttacataccaatctagcattacgctgattttctcttttgcaaagctaggaagcgtgagcattagccccattacaaagctgaaataacggatgattgtcttcattttttctcctttaatgaaaagttaaacagaccaaataaaacggtgtaatagccaatcaatgctgaaatataaacagagtgaaattgacactaaaatcagtaaggcggcaaacattaaatcgacttgcattcgggcattggcgtgaatcatcaaataccccaagccttcagatgaaccgacccattcacctaccaccgcaccaatcggggcgaccgaaacggcaattcgcaagcccgaagcaaaagcaggcaaagccgcaggt

SEQ ID NO: 252 - DNA, 1976 bp, H. influenzae
  misc_feature (1286)..(1286): n is a, c, g, or t
  misc_feature (1929)..(1929): n is a, c, g, or t
  misc_feature (1946)..(1946): n is a, c, g, or t
cgttttcgaatatcgactcggtaccccctccttatttgcatttattagatatcctatcaatcaaggaacggttggcattccaccaaccagcttgtactacagatttttgtttaaccagtcttgtgccactttaattgcttgtgccacattttctggttgggaacctcctgccattgccatatctggacggccaccgccttttcctccaacttgttgagccattaaattaacaagttctccagcttttattttggcggttaaatcatttgtcactccaacgacgagattaactttttcatctaatattgatgcaaatgcaattacgcctgatccgagttgattttttaaatcatcgaccattacgcgtaatgattttgtttctataccatctaattgttgtgcaataacagaaacaccgttgattttgaccgcactttttacaaaatcagaaccagcctgcattgcggctttttcttttagaccttgtaattctttttccactttcttcgttttgtcttgaagttgttggattttttccactaaggtatttacgtctgattttaataagtctgcgctttgggtcagaatgcgttgttgattatgtaaccagtcaatggcattttgacctgttacagcttcaatacgacgaatgcctgcagccactgcgttttcagtaataattttaaataaaccaatatcgcctgtgcgttttgcgtgaataccgccacacagctcaattgagaaatcgcccatcgttaatacacgaaccttatcgccatatttttcgccaaagagagccattgctcctttcgcttttgcggaatcaatatccataatatccgtttgaactggaaagttagcgcggattttttggtttactaatgtttcaatttcactcaattgctctttggtaatggcttctggttgcgcaaagtcaaaacgtaaggctttatctgaaacaagcgaacctttttgcacaacgtgtaaacctagaatttgacgtaaggcagcgtgcaataagtgtgtcgctgagtgattgagtgatgtgttgtggcgacgtttagcgtccacaatcgcattcactgattgtccaacttttaaacttccttgcgttaattccccaatgtgtccaaatacttgcccatatttttgggttctttcacataaaggttacaccttgtgtgcttaaatatccgctatcgcccaatctggaccaactgtgattctgcataaaaatggcgtattttcctaaaaatacccggccccggcacttgacctacttcggnatctttccactgatttaccatcatagaaaagtgcggtaatttttgcctgagattctacttcagtatagccttcaaacttagtttcgccatctacacgaataacgctgttgtagtccacaccaaactgggctcgctgcttgagcacgagtacgttgtgcttccatttcacggtcaaacgcttgttcatcaatagtaatgttacgctcacggcatacatcagccgttaaatccaatgggaaaccataagtatcataaagtttgaatgcaacttcacctgaaagaatgccatctttcacttgagaaagtgcttcatctaataagctcaagccacgctctagagtacgagcaaattgttcttcttctagacgtaatagtttttcaacatttgtttgttttgcttttacatcttttccagcttcagccattacttcaattagagtgggcacgagttataaaaaaaaggattctttggcacctaatagatgaccgtgacgaactgcgcggcgaataatacgacgtaagacataaccacgcccttcatttgatgggataacgccatcggcgattaaatatgcacaagaacgaatatggtcagcaataacacgtagtgatttgttagttaaatctgttgcgcctacaattnccgccgttttgcgatanagggtaccgaggccgatattcgtttaccag

SEQ ID NO: 253 - DNA, 1379 bp, H. influenzae
  misc_feature (1286)..(1286): n is a, c, g, or t
  misc_feature (1305)..(1305): n is a, c, g, or t
  misc_feature (1308)..(1308): n is a, c, g, or t
  misc_feature (1318)..(1318): n is a, c, g, or t
  misc_feature (1326)..(1326): n is a, c, g, or t
atccccgtatttgatactgaatttggcacaatggtacaaattttagtgggtgcaaccatcactgcaagtattggcacaacttgggcaggcgtaattaatccaccacgccacaacgaagtgaaaacttggacttatgaaggcgaaagtgcggtcaaattattgaaaggtcaagaaatgggttggttccaacttggttcaacagtaattaatttattccaagccaatcaagtgcgtttggctgatcatttaagcgtaaatgaacctgttcgcatgggcgaaatcttggcatataaaaaataaacaggatttatttccataaatgacagaaacaaatcctgaaagtagatatttctcacttctttaaaggcagtataaccttactgccttttcttctttcatttgaacaattaacgcattgttacaaattcctctgaacctgttggatgaattgccaccgtattgtcaaaatcagcttttgttgcgcccattttgattgctactgcaaatccttgaatcatttcatctacaccgaaaccaataccatgtaaacccataactttttcatctttacccacacaaactaatttcattttgcacggttggcgatgttgagttaccgcagtgtacatcgctgtgaaagaagatttatatactttaacattttctgcgccgtactgctcaatcgcttgcggttcagttaaacctacagtgccgataggcggatggctaaatacaacggttggaactaaactgtaatctaaatattcagtcggtttattattaaataaacgctctgaaaggcggcgacctgctgcaactgcaactggtgttaattcaataccgttttcgataatatcgcctaccgcataaatgcctttcacattagtattttgatatttatctactttgacatagccgtgttcatttgtttctacacctgcattttctaagccaattttatctgtcgttggaacacgacctgccgcccaaataacgcaatctacggtaacatcagattgaccatcacattttacagtaagtgaaccatctgcattttttacaatttcagatggggtagaattggtatgtaattgaattccatcttgcgcaagcacttccactaatgtttctacgattaatggatcctgattacgcattggcgcatggcgacgcactaataaatgtgtttccacgcctaagctgtttaatacgccagaaagttcaacagcaatatagcctgcaccaataacacagcacgttttggtaattcggttaatggcaagaanccatccgaatcaatgcgtnatncttgcctttnatattggnacgatatgggcggccccagttgcgataaaaatgaacttgcggtacttgttttt

SEQ ID NO: 254 - DNA, 1218 bp, H. influenzae
ttttgtatagacaagtcagcacctaatactatttcatgacgaagatcgcctttttctttaaaaaggcaaaaataatgccattaatcaaccatgccagtaatgtcgccaccaataaatctattgggtaatgcatgcctaatcgcacacggctaatcaacatcaataagccccacactgcaatacccaccaccagcaattttgctttaaaagaacggttacccaataattgggtaaagccaacagcaagcattagccaagttgccgcataaatcgtatgtccagaaaggaacgaataccccgtttcattctcataatgatgaactaaccaagctggtgtgatagcatccatcgaataaaaattcttagctatttcagcacgcaaagtgcggtcatttttataaaagttttcaggcgttgaatgagtttgctcagctagataaacggtaaacggacgaggttcttcaaataatgcttttgcccctgtttttgccgcttgagttgcaataactgaaatccccatcacaattacgcctaatagccattgttttggatttttaaataaaaacgcaaacaaaagcgtaaataacacacaggtaatcaacgcataaggtacgctacccgtttcagtgagcaaataaagccaataatcagcttgagttaattggctattaccatgccattgataggaaataccccaaataaaaaatggtacaagacaaagtaataacgtatataatgacagccttttgaacatgctcgccccttgataataaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtccttatttatcatcgtgaaaaggccgcggaattggcttgatcaaaaaatatccgggcttactttttacaagataaaggactgttaccatcgatacctatcttgcttttaggtttaaagggattgaaccaaccctt

SEQ ID NO: 255 - DNA, 1991 bp, H. influenzae
caatgaagcaattcagcaactttgttatagttatgaaaatacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttgtagtcacaaggcaaataaaatagacaatattgaaataagatttttgataaaaaagaaattttttgctggaaaaatggtcccccctaccggacttgaaccagtgaccaagcgattatgagtcgcctgctctaaccgactgagctaaggggggagagtgcggtaattatagagaaataatcacttgaagtctataaaagaagggatgattgacgaaaaatcaaccatccctttttacattattgaagcactgaaatatcagctacttgtaagaataacccttgtaacgtatttaaaatcgctaatcggttttggcgtagtgctggatcttcagcatttaccatcacgttatcaaagaaactgtctactggcgcacgtaagtttgctaatttatccaatactgcggtgtaatcgccttgtgcgataagcggttgtacttcagtgcgtaatgccagtaccgcttcagcaagggctttttctgctggctctacgcaagcggttaaattgatctcgccaattgccgcacctgctttcgctaagatgttgctaacacgtttatttgctgctgctaacgcttccgctgaatctaaagtacggaagtgtgaaaccgcacgcacgcgcgcatcaaaatcagcagggcgagttggacgacgtgccaataccgcttgaattacatccaccgcaatgccttcatcttgataccatgcacggaaacgaccgagcatgaagtctactacctcatcaaggattttttgttttggaactaaatcatcaccacgtgtaaagaatgaaacataaccttctgggtattcactaaatccacctcttgttttggcaataggtgcattacgtagtctttcgttatcaagttctttatataaatcaaatgctttgctaataatgtcattcagatcaagaggcaaatttttctcaacgataatacgtaatgcacctaatgccgcacgacgtaatgcaaatgggtctgcgctaccttttggtgcttggccgatgccgaagatacccgttaaggtgtcaaatttatccgctaaagcgaccgcacttgccactaaagacttaggtaattcatcacccgcaaagcgtggcatatattgttcgtttaacgccactgccacttcttcatcttcaccgtcgtgacgagcataatgcatacccattacgccttgcgtatcagtgaattcgaataccatgttggtcatcaaatcacattttgacagtaaacccgcacgttttgctttcgcttcatctgcgccgatttgttttgcaatttcgcctgcaagttgttcaatgccggtcagttttgctttcatgtgccagttgttgttggacacacggttctaacgtgtaaacgatcaccagttttgtttaagtcgttttgaaaaaattccgatcggtaacgtggacaacattttttgtccttcaaaatcgggtggactttg

SEQ ID NO: 256 - DNA, 1736 bp, H. influenzae
acttcatcgtcgtgaatctgttgaagtgtcaaggtctgcatcagtaagtaatatcaacgaccgttagataaaccgattacagatcgcttggaagcatttaagaaaaataatttttttaatcctgcacagcgtgaagaaaattaataagtttcagaaaatacctagtaaatgaaggtagtagaatgattaaacaaagaacattaaaacaaagtattaaagtaacaggcgttggcttacatagcggtaataaagtgacattaaccttacgcccagctatgccaaacacaggtgttgtttattatcgtacagatttaaaccctgcggtggcatttcctgccgatcctaattcagtgcgtgatacaatgctctgcacagcactaattaatgatcaaggtgttcgcatttctaccgttgagcatttaaatgcagctttggcagggcttggtattgataatatcattattgaagttgatgcccctgaaattcctattatggatggcagtgctagtccgtttatctatttgttgttagatgcgggaattgaagaacaaaatgcagcgaaaaaatttattcgcattaaagaatatgtacgagttgaagatggcgataaatgggctgaatttaaaccttataatggtttccgtttagatttcactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagcattaggtggtagccttgataatgcgattgttcttgatgattatagaatcttaaatgaagatggcttacgctttaaagatgaacttgttcgtcataaaatgttagacgcaattggcgatctttatatggctggttataacattatcggtgattttaaagcctataaatcaggtcacggtttaaataacaagttacttcgtgctgttttagcaaatcaagaagcgtgggaatttgtaacctttgaagataaagagcaagtgccacaagggtatgtagctccagcgcaagtgcttatttaattgttttattgttgaaaaagctatatttctggtgggaagtatagcttttttatttcatctcgcgcttaaatatcgaatgtactaaaagtgcggtcaatttcgtgggattttttataaggaagcattatggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagaactcgtattgaccccagcagtctacttgcagaataaacttaatgaacaacgtaatcaaaatttacatattgcttttttaggtaaaacgtggttcttattctaatttagctgcacgtaattatgctggctcgtatcaaaacaattgagactcagggagggcgcctttggatcagatttgaaaaaattcaaatggaaaactgtttttggggttggcctttaaaatacactcggggcattaagggaggttaattacctcactact

SEQ ID NO: 257 - DNA, 1792 bp, H. influenzae
  misc_feature (1529)..(1529): n is a, c, g, or t
aatggcttggtgttaaagaatgttcgttatcaaacccgctgggattgagacacatattgcacaagcacgtttacagctcgattttggttgtttgctttcacgtgaagtttgtttacgagacttcaccttaaataaaccgaccattgcgattaatactgcattattgcctccatcggcacctgataattcaaagtctggctcaatgaagcgtatttccttgccaattagtatcaatgcagaaaatttggtggtgcaagatttatctgtaaacattgatcagactaatattacgcttggaaattttaaaagtgcggtaagtttaaataatgaaaaaggcttaactattgcgccgactgaaattaacgatatttcagtgattgcaaaaaaattgcccgaaggtaaacctgagctgaaagccaaacagccgaataaacctgtagattgggctgcgattgagcaatctttaacgcctgcttttttaggcaatgtatcagacataattcttccttttgatttacatattcctgaaatttcaggcaaaaactggcagtatcaagcagtgaatgaaaaagacgaaacgcttcaatctgttgaaatgtctagtttaattgcacaggcggataccgtcgataaccaactgcaattacaaaaattagcggtagaaagctcgttgggtaatctttcttcacaaggtaaattacaactcgatggcgatatgccgctagatttaactttaaaatcccatttggagccgttgaaatccgctggaaaagaaattctgccagagagtgatgtggatcttacgctttcgggatcattgaaaaaatccaccgcactttctgtgaaaacaaaaggcgtattagatgctgaactgaatggcaacgtgcaattagcacaagataaaatgcccttaaacctcacattaaacgtggcaaaaggacaatacacttttgtaaacacaatgacgccactcaaaattaatgatgtgacgcttaaactcacgggggatttactgaattatcacgccgaatttaagggcaatgtggcaggaatgaattatattcccgcatctcaagtagactttaatgccgacggcaaactttatgaaataaccgtaaataaattggggatagcttcattagacggtaaaagtgaatttgtgggtaatgcaaattggaaaaatggtgcaaactgggatattcaagccgatttagaaaaaatgaatattggtttttttgttccagttatgcctgccatattatcgggtaaattacattctcgcggttttgcggactctcaaggttggcaagtggaagtgcctacagctgatttaaatggaatattgtctgcaaaaccaattagcttgaaaggttctgcaacgcttaatcaaaatgtacttctaaccgtgcctgatttacagattagatatggcgaaaattatcttaaagccagtggcgtattagatgatcattctgattttgtgctagatatagatgcaccaaatttacgtggtttatggtcagatttanaagggcgagtagcgatttctggtcaaattacgacacctaatcttgatcttgatttaacttcatccaatttacatttacaaggttttcagttagctaaagcaagtataaaaggtcatataaacaataccccactctcgagtggaaattggatattaaatcagaaacacttctttatggcgaaaatattaaactccatttacttgatccttgatttatccgggcgaggaacaaatcccaaatttttcctaaatctcaagccgagc

SEQ ID NO: 258 - DNA, 1346 bp, H. influenzae
  misc_feature (1058)..(1058): n is a, c, g, or t
acccctctacttcttttctaaattgagtcattttaatcacctttttgggttagttaatttatcgtcattatagaaatttcaagaagaaaaaacttgatgaagatcacattttcaaaaaatgctctcaagacatattttcatttttcggattagtttttttagggaaaaatgttctatctatcaatcttacacagatttcaatagcctaccaattttctcaaataatttctgaatttgctctgcacgacacccgagtacccgcaccattaaaccatattcattgagttgtgatatgcctatcagtagatctttttcttccgtactttgttgctgcaaggcttgcacctgttgtttgatttccgcattatttttcgccaaatttagataagtcagcgaaccttgatgggaataattttccatctgactcaaagcggtaagattcattttagacggcagccactggatacaatcactgacaagcggtcgttttttgccatcgtctttcaaagtataaatcttcaaatgggaagaaaactggcggaaggcaaaacgttcatcattcaacacccgcccaatcgccacgatttcaccgtaaatcagctcgctttgttcgcccatttcaatctgggtttgctgcttaaaaacggaatctttatgtaacaccaacggatgcggcaaatagaataaacgactgttttccgcaagcaaaatatgggttgtttgcatcgcactgtcgccttcattcatcgcctgcacccgagtaaatgcctgcgtatttaaagaaagtgcggtcaattttgccaacgaaatatcaatctctaacagatcgcccgccagcaccccaggggaggaggacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtagggggctaattacattagccccgatatttcaccaataattgggcanatgtaatttgcccctacgattaacgaaccaaagatgcaggttcttccacattcttcaacacgcatatttttcgatccaaccgatcacgccatccagattttcttttttcatcagggtagtgaaaataaacggctgaccgttacgcatacgacgagcatcacgttccctgacgcttaagttcacaccaccgaagggagcagggacagttttgttgatcaccagtaatctgaacgagggatacccgccccactttacgagggaattttttcccctggaccacgtcaatca

SEQ ID NO: 259 - DNA, 1753 bp, H. influenzae
  misc_feature (1333)..(1333): n is a, c, g, or t
  misc_feature (1605)..(1605): n is a, c, g, or t
  misc_feature (1627)..(1627): n is a, c, g, or t
  misc_feature (1733)..(1733): n is a, c, g, or t
aatagatattttcaagattggggaacagcaactcaaaacaccgggtgagaggtcaacggggagaaatgtggcaagaagatataaaagatgttattatcggaatccggcgacaagcacgaacagccccggaaaaaaagatcgaagcgtctgcatgaagccaaaacaagtaatgccacagaaaacataagacgctataaagatttctactccagtgttcgatcctttatagataaaagtgtcaatgcagaggtggcactttcaaattttgcggaattaagaaattaattcagggatgacagaatgaataagaaaaccgtgtgtcacaaaatataacgatgtggatcttcaggtgtatcatgcccccccagccaattatgctgaaatattgctgcatagaatcgaccttgaagctctcgaggatctaaatcaatgcgagattgcccctggttttgcaagcgaaccgcagtgacaacatactcatcaagttgccagctgagtaatggagtagctcgcacaggcaatgcaggtaagagcgttttaagcggtgtaggaaggcgatgtgaaacttggcgcacaccttccaaaggctcaactgaacgtaaaggcgcataaaacatttgtgcggcataacgtgttaatgcagctggagcggggagtgccggacgcgcatttggcattggttcgttatatgcatttgcatcttggccataagcagttgtttgtttttcaactttattttcataaacaaagcgaattggctcacttgcattggcaacagaatgcttcgcttgcacatcaagtaagattatttctccagttgcaacatccataagctgcaagcgtgtttttgggaaatctgcagttgcttttaaataaaccgcaccgccagttgattgaatgcgaagcttgctatctaattcaggtggataacctacttttacatttttatctacgaatagaatacgttctttttcgatttgtaagtcaataggtaacggtttgcgcgcccatttcattaacacatcggcagatgccgtcattggtgaaaagataaaagccgcgcttagtaacaaagtgagttttttcattattggttatccccttctctaaattcttttgcttctaaacgtaatggaattgagctgtagcagttaaatcccaatccccaaggattgttctgtaaatctgtttccatgcgcacgatattgaccgggaagcgggttaaaacacgtttaactggtcatctttgaatactcatctacacttaaatcaagattaaccgtccagctatctggactatgcacaataacgctactgtctttaaatccacgtnccacaatttcataaacaccacgtgcacgttcacgtaattcaccgttagataaacggcatagtaggctttcttcaaaattcttggcaacttggcgaaataaggctttatttctttcatatttattttggattcttcctcgccatctccatccagcggtttaactgctgggaggttggataagcaaagcctaaccgcgtgatttttggcctttccaccaggggccgtgacttcccccccggaaattcggcgggttaaaatattaatcacttggngcgggaaaataaggggcttagnccccaaccattcccacaatgccccgatagcatttccccggccagatttgcgattttttagagaacaatccctttaagacccctaaaaactctgttatttgaccggngctcaaccaggcctggggga

SEQ ID NO: 260 - DNA, 1476 bp, H. influenzae
  misc_feature (1439)..(1439): n is a, c, g, or t
tgcattaaccgtgattattcaaaaattactcacctttgttcattcaactctttctttgattattacaacgattctttgcggtctaacaatgattggggttacttgtaatgggcaaatttctattctaattccaggagaaatgcttaaaaatgcgtatgtagaaaaaggattacatccaaaaaatctaagtcgaacagcagaagactccgcaacaattattgaacctattttgccatggactgccgcaggtgcatatatggcaggcacattaggtgttgcaacattgtcttatttaccttgggcaattttatgttggagcggtattatctttgctattatttatggtgcaagtggaataggtattgcgaagctaaaaaaataaatgtggtattggatataaaaatggccagttattctggctatttttatcttgaagctaaatatcttttctattataacttaaatagcaatttcccatagataaggatataaaatgacggaacaatactacaaaattgccctcttatttaatgcaaacaaagtatatgatcggcaggtggtggagggtattggacaatatattcaggcatcgcaatgtatgtgggatatttttgtagaagatgaatttatctatcatactgatactattaatcaactttctattgatggcattattgcagactttgatgatccaaaaactgttgaattattgcaacacactcttattcctactatagcagttggtggatcttataaacaagctgatttttatccgcactttccttatgtagcaacagataatatggcattggttgaaatggctttatctcatttacaggagaaaggactgtcacagtttgcattttatggtttgcaagtaaatactcataagcattggtctatagaacgaagagatgcttttgtagagttgatggagaaaaatcattaccctatttacctatatgagggtgtgcaggttcatgctcaaaattggttggaagagcaacaaaagctaattgtctggttaaaatctcttccttctcatactggtattattgctgttacggatgcgcgtgctcgtcatttattgcaggcttgtgaatacagtaaaattgctgtacctgaagagctttgtgtggttggtattgataatgaagaattgatccaatatttatcgcgtatgtccctttcctccgtagaacaaggcacgagagagattggttatcaagctgcgaaattattacacaaattactcaatggtcaaaaagtttcacatacccctattttaattccaccgattaccgttcactctcgaaattctacagattatcgatcattaacagatccgcttgtcattcaagcaatgcattatattcgtcatcgtgcctgtcatcgaattaaagtagaacaagttttagatcatcttgaaacctcacgtnctatactgaacgggtaccgagtccgaattcgataaca

SEQ ID NO: 261 - DNA, 1231 bp, H. influenzae
acagaagttggcacattacgatatgccacaatatcatttacatttttaccaaattcagcaatttgtccgccaaaaatgatgctttcagggtgctgttcaataaacgctacttgcttttcaaaacgatcaggcacgcaaatatcatcggtatccatacggaaaacccagtcataagtacaatgcaataaaccttcattcaaggctttgcctaatcctcgattttgcggcaatttgactaattttaatggcaattttgtttcaaattctgtcacaacagattctaattctggcgttactacgccatcaaaaaccaatacaatttcatctgcttgacgagtttgtgcaacaagactttcaaaacactcccgcaagaattgaggattttccttaatatataaggacattaggactgaaaatttcattttattttcccaaccgttttaaattaatggctaattttggcgaaattaaaataaccaaagtaataataaattgcctaatgctttttgttttcttaaaaatatcaaaataatattttgccgctttacgcgataaattcatgatatggggataagccaaaatatagctcgcgttaatatcaaaattacgagcttgctccaccgttttcacataatgctcgcgaatataatcaatggctttttgcgtattagtggtatccgtagacacacttgagcgtttagtatggaaagtacagtaagttagtggttcattaattttataaggagtaaaacttggctcttgtaacagttttaacaagaaatcatagtcttccaaagaacgaagtgcggtggataatccacctatttttaaaaacatctcttttttaatcgcaaccattggcatgccaccaatcttattggctaacaaaatacgttctgtcgagatttcttggggttcaatcggttgagtcacataagtaaacccttcattgaccatttcacatttagcaggatgataaataaaattaatgtctggattttgctcaatcacttgtagtattttttcacatttttctggcataaaacgatcatcatcatcgagaaaaagcaaccaatcgccctttgatgtacgcgcaccaacattacgactttccgctgcaccttgattggtttcgttacgaatcactgtaactggaaaagaataactttgttcaacaactacttctctttggagcaatcatccacaataatcacttcaaaattactcgatg

SEQ ID NO: 262 - DNA, 1782 bp, H. influenzae
gccagacttggctggcctgccaggtcgactcttataggatccccactcgcgctttggcggcagcttgatgatctaagctagacgcagattgtgaaacgcagtgcagaaaaaatgaaagggaaaataaccgcacttagttgtttacttattgtttgcatttttctccttttaacaggggcagtcgaaatatttaatatgctttaatttgtatgaaaacatagggcatgtgaacttgattaattcacatgcctagaatattaattaacttctgttaccccaatattttgtccaaattggcgtttcattgccgtacgtttagtacgatcgatcacatctccagctagctgtccgcaagccgcatcaatatcatcgccacgggttttacggataatcacggtaaagccatattccattaatgttttttggaagcggtcgatacgcgtattcgagctttttgcataaggtgcctctgggaacggattccacggaattaaattaattttacaaggtgtattttttaatacttctgcaagttgatgagcgtgttcaatgccatcatttacatgatcgagcatcacatactcaatcgtcactttgccgtggtttgcatttgatacatttaaataacgatttactgagtcaatcaaggttttgatattatattttttgttgattggcacaatttcatcacgtaattcatcatttggtgcatgtaatgaaattgccagtgccacatcgatcattttgctcaaattatctagtgctggcacaaccccagaagttgataaagtgacacgacgttttgataaaccgtaagcaaagtcatctaacataatttccattgcaggaacaacgtttgcgacatttaataagggttcgcccattcccatcattaccacatttgtaatgggtctaacgccagttacgccaaagttaccaataattttagaggctcgccatacttgaccgataatttctgaaaccgttaaattgcgattaaatccttgttgtgctgttgaacaaaatgtacaagctaaggcacagccaacttgggaagatacacaaagcgtcgcgcgatctgcttcgggaatatacacagtttcaacttgctgctcgcccacttgcattgcccattttatcgtgccatcggctgaacgctgttcaacggcaacttctggggctttaatttctgcaaccgctttaagtttttcacgtaattttttattaatgtttgtcatattgtcgaagttatcttcgccaaaatgataaatccattttactaactgatctgctcggaatggtttttcgccgagttctttaaaaaattcgcgcatttgttggcgcgttaaatccattagattaatttttttagcgggtgcatctgattgcacagacaataattctgacattttagcctcgttattacacattgtggcgatagcgttgtgcaggtgttttatcaaaaactcacaacgaaaaattcgcaattaaaaaatgaacggcgattgtacagatttgtcattgcataatctagcggaattgaaaaacgatggaaaatcttaccgcacttttttgcgatctagatcgcaaatatttccaattacagcgtaaaaagtgcggtaaaatgtgagctcattttttaaggtgtccaataatgtttaaaaaagctttatttattttatctttgtgtccttcttttttgctggcacagtcttatgttgtgtatgattttacccataatcgagtattggaaagctatgcgcctgatagtatcagcctatt

SEQ ID NO: 263 - DNA, 2741 bp, H. influenzae
atgttatacgaatatcggactcggtacccatatcagcctcatcatcgcctacaatgcgataagtgacttcttcgtctgtatttgtatttacaagtacaactgttgcaccaaaaatcactttaccattatttggcatttttgtgacatcaataatttgagcattaccaagtttaccttcaatctcttgaatacgcccctcacaaaaaccttgttgctcacgcgctgcgtgatattctgcattttcttttaaatctccgtgctcgcgtgcttctgctatggctttaataatttctggacgacgtacattttttaagaaatccaattcttctcgtaattgttctgcgccacgcacagtcattggaatttgttgcattgtttttccttttactaaataaaacaaaaaccacagtaaaattctaaaatcttactgcagtattatcaaaaataaacttgaaatgagaaaatgatttactcaatttcattcggggcttattattgttcgtctaaaaaaaaatagcaaccataacaaacctaatatgaaaaaattatcttcaatttccaccgcacttggttcctttttactttcagtgagttttagcctaccaactttcgccaatattaatgtttcagatttaacacaaaaattgcctgaaggctctaacgcaggtgttattgctaaaaatatcaatcaaaatcaaataattgctgattataatggctcaacctttatgctgcctgcgagtaccaaaaagtttttacagccgttgccgctaaactgcattagcgatcaattccaatttgagaccgcacttttgagtaatggggaaaattcaaaatgggaatttagatggcaacttaatcgtgagtttcacaggcgatcctgatctcacaagaggtcagctttatagcttacttgcagaattaaaaaaacaaggcatcaaaaaaattaatggcgatttagtattagatacctctgttttttctagtcacgaccgaggattaggttggatttggaacgatctcacaatgtgtttcaactctccaccagcagctgcgaatattgataacaactgtttttatgcggaactagatgcgaataaaaatccaggtgaaatagtaaaaattaatgtgcctgcacaatttccaattcaagtgttcggacaagtttatgtagcggatagcaatgaagcgccttattgtcagctcgatgttgttgtacacgacaataatcgctatcaagtaaaaggatgtttagcccgtcaatataaaccttttggcttaagttttgccgtgcaaaatacggatgcttatgctgccgcgattattcaacgtcaattaagaaaattaggtattgagttcaatggcaaagtcttgttaccccaaaaaccacaacaaggtcagctattagcgaaacatttatcaaaaccattacctgatttattgaaaaaaatgatgaaaaaatcggataaccaaattgccgattcattattccgagcggtggcattcaattactataaacgccccgcctcctttcaattaggcacattagcggttaaatccatattgcaaaaacaaggaattcgttttggtaatagcattttagccgatggttcgggtctatctcgccataatcttgtggcacctaaaacgatgctatccgttttagaatacatcgccaaaaacgaagataaattacatttaatggaaacttttcccatcgcaggtgtagatggcacgatcagtgggcgaggtggattaattagcccaccattagtgaaaaacgtgattgctaaaactggttctttgaaaggcgtttataacctagctggctttatgacaaatgcgcgaggggaaaaagtggcatttgtacaatttattaatggctactcaacgggcgatttagaaagcaaaacaaaacgtgccccattagtacaattcgagcgtaatttatataacgaactctataaatattaaggtgctgtagtagataacaactaaaaatcccatttaggttagaataaaccaatgagaaaaagtcgcttaagtcagcataaacaaaataaactcattgaactgtttgtcgcaggtgtcacagcaagaacagccagtaaattggttaatgtaaacaaaaatacagccactattactttcatcgattacgcttactcatttatcaaacaagcccacatttggaaatgtttgaaggcaaaattgaagccgatgaaagctatttcggcagtactcgaaaaggcaaacgtggtcgcagtgttgcagggaaagtcgcggtattcgggcttctcaaatgaaatgcaaggtttataccgtaatatgttcctaatgtgcaatcagcaacattattgccaattatccgaaagaaagttaagcctgatagcattgtgtacacggatacctttcgtagttatgatatgcttgatgtcagtgaatttagccattttcgcatcaatcacagcacgcattttgctgaaaatcacaactacataaacggaattgggaatttttggaatcacgcaaaacgccatttacagaagtttaatggcattcccaaagagcattttgagctgtatttaaaagaatgtgaatggcgttttaacaatagcgaaataaaatctcaaatttccattttaaaacaattagttaaggggagtttggtctagttatctagtacagcccctaaaaaagcggggtcctccaagagtcgacctgcaggcagcaagtatggc

SEQ ID NO: 264 - DNA, 1630 bp, H. influenzae
  misc_feature (1519)..(1519): n is a, c, g, or t
tgcttgatgccgtccgagtgtattgggcgagcggcgaagatgggaattaaaaacaagccgataacaagaccatgcccgcagtgcggcagaaattatcaatatcggcgggcaagtgggcgtacttttgagctttgcgaatattgtcgcaatcttgattgtgtagtttgtggtaaaaaagtaccgccggaacgtgggcggaaaaatacttgctgtgcggagtgcgaaaaattgaagatacacaatatccaaaatgcgcactacgccaaacggatagcggaagaccctgagttaaataaacgcaaccacgccaaagcccgcgaaaaccgaaaagcagacccggaacgaatgcacgaacatttggaagcacaaagggaaaggcattatagacgtgtgcaagatccgaattatctagccactcggaaagtttatcaggctcaacgatggcaggataaaaaagatgagatactggctcaacggcgcgaattttgggatagtttaagcgatgttgagaaagcggagcgacttgagcgcaatcaagcaatacaacgtaaacataaagccaaaaaacgtgaccagttgaaattagatccgcaaaagtgggcggaatatcaagagtatcaacgcacaaagcggcgcgaacatagacagagaaaggcgcttaatgaattaatggtcggcacaaaggagttattaaatgttaccaacaaagacaaatagttttgatattgtcgccgttaaaagcatgacaatccaagatttaaaggcggaattagccaaaacactaagcattacggcggaatatctcatgtatattgcggcaatatggcgggagttagagtcgcgtggagaggacttgagcgagttacgccatggcgtgatgacttatatcccgttaatcgcaacaaatcaacttgacgcgcggcttgttgtcaattatgccgggcaaaaaacgctgttatccagcatggcaaaattaccattaagagagcaacaaaaactggccgaaaaaggcactttggatgttgttattttgggtgacgataatcaacagctaattaaagaagttaaaatatccgacctcacagcagcccaagtttatcaaaccatcggtgatggcaaaataaaaacaccagaacagcagtatcaaatcctgttagtccgcaataaagtgcggtcaaaatcaaagccgaaaaagacttaccgactaacgcaaaatttaaaaatagatggtaaaaatttagtgattgccggaaaacatgcggtatccattgagattttgaaaaaatatttagaggataacaatgagctatagcaagttaagcaacaccaggaaaaagactatcagtgttaatgctaataaatacactaaggataactatagacagatacttttacgcctaaagccagatgtagcagatatgtttgattcaatctgtgaaaaggaaaaatatcaagggcggaaatgctaaaaaaacttctagaaacttattcatataacaaaacaacaaaatggcagagntgagccctgccatttttgtttataattctcagaatccttaaaccgggttttttctactctcagaacattaaattttcctataataataacctttatctcgccacggtgaac

SEQ ID NO: 265 - DNA, 1558 bp, H. influenzae
catttgaaataaataaacattgcggatttgattatctttaatcttatcaataaataacacaacgttattattgttggtagaaataaactgacctgaagacagcacgccaacggttggattagcctttgcatcttccaccatattcacttgtttttgaattgcccaaggcgaaagccataatgcgttataagcggcaatacctgccgttaataaaatcataatcagtgccactttaaccaaaatccgttgccccacaccgcacgcgcgcatcactgtgattccactttcagcgtaaaggcgaccaaaactcagtaaaatcgcaatacctacacatagtggcaacatcaactgcggcccatgtcggcattcctaagcctaataaagagaaaaccaaatcagctggcacattcccatttgccgccgcacctaatacacgcacaaactgctgactaaaaaaaatcaatagcaaaattagtaaaattgcgatttggcttttgaaaacttcttttattaaatatcgaattaaaatcatcttatttcgtttgtttttctaaatctaaaacggaggaaaactggataaaatcggtcgcatatgataacttattttcgctgaattaaacagaaatttaaggacaacaaatgaaatatcaagcaaaaaataccgcactttctcaagccactgattgcattgttttaggcatctatgaaaataataaattttcaaaaagttttaatgaaatcgatcaattaacccaaggttatttaaacgatttagtgaaatcaggtgagctcactggcaaattagcccaaaccattttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatctttaatacggattgtaatcaagcacaacaagctatttctcacgccaatgccattagctcaggcataaaagcagcacgtgacatcgcaaatatgccaccaaatatttgtaatccagcttatcttgctgagcaagcaaaaaatttagcagaaaattctaccgcactttcattgaaagttgtggatgaagaagaaatggctaaacttggaatgaacgcttatcttgccgtctcaaaaggctctgaaaaccgtgcttatatgtctgttttaacattcaataatgcgccagataaaaacgccaaacccattgtacttgtaggcaaaggattaacctttgatgctggcggtatttcacttaaacccgccgcagatatggatgaaatgaaatatgatatgtgcggtgcagcctctgtcttcggcacatgaaagccattgcacagttgaacttaccatt

SEQ ID NO: 266 - DNA, 1765 bp, H. influenzae
atttaatggatgataaataatggaatataatcttctcctaaacgcccttatttattacgcgcctattatgattggctagtagataatagttttacgccttatttagttgttgatgcgacttacttaggtgtgaatgttcctgtcgaatatgtaaaagatggacagattgtattaaacttgtctgccagtgctacgggcaatttacaacttacaaatgatttcatccagtttaatgcgcgttttaaaggtgtctctcgtgaactgtatattccaatgggcgcagcccttgcgatttatgctcgtgagaatggcgatggcgtgatgtttgaacctgaggaaatttatgatgaacttaacattgagccagatactgaacaaccaacaggtttttatgaagcagtagataagcctaaaaaacgagaagaaaaaaagaaaacaaaatcagtttcccatttaagaattgtggattaagaaaaaacgcgatgaaattatcatcgcgtttatttttataaattaccttgttttgcaataaagttgagaattttttcttcaatgccttttgtatccaatcctaaatctgccaatgcttcttgccgtgtcgcttgtggaataaaataatctggcaaaccaagttgtaaaagtgcggttgattttcctgatgaatttagtacttccgcaacagcagatcccgctccaccttgaattgcattttcttccaatgtgaccaaataatcgtgagtttgtgcaagcacattaatcatttcaatatcaatcggtttcacaaaacgcatatcgacaaccgttgcattgagtttttctgataactctaaagcggatggtaatagagtaccaaaatttaaaatcgcaattttttgaccttttcgaattaaacgtgatttaccaataggaagcatttctaaaggagtaagttttacaccaacggcatttccgcgagggtaacgcactgccgcaggttttccacattgataacctgtatagagcatttgacggcattcattttcatcactcggcgtcataatgatcatatttggaatgcaacgcataaagctaatatcgaatgcaccttgatgtgtagccccatctgcgccaactatccctgctcgatcaatcgcaaatagcacggggagattttgaatggcaacatcatgaattaattgatcgtaagcacgttgtaaaaatgtcgagtaaattgcgacgacaggtttatatccgccaattgcaagtcctgtggcaaacgtgacggtgtgctgttctgcaatcgctacgtcaaaatattggtttgggaagcgttgggaaaattctaccatacctgaaccctcacgcattgcaggtgagatacctataattttggcatccttttctggcatttcacatagccaatcgccaaatcttccaataagccggttactttgcgcctggtccattttccctgatgcgatccacttagcccctcccggatacctccgctatctcttgtgcggagtcgatctcttattttgtttcggctttttgataagggtttgccgcttgtactaaacaggcctgtccgatcgggtgaccctataatgtcctatttttgctcacggctcttatcccctagtatgttatgtcgtctgcttgagctcgcgccctgtatttatgtttctgcacgttagctagacgcacgtgtttttttttcccattgtttatcctccgacccgcggcgttgcgtgccttctgtcacccggctcggcttgctgtctgg

SEQ ID NO: 267 - DNA, 1720 bp, H. influenzae
  misc_feature (1684)..(1684): n is a, c, g, or t
  misc_feature (1692)..(1692): n is a, c, g, or t
ctgcccgcataaggataagtccctgcaattgaactcaaattgataatctgcccgtgattacgagcgaccatatttggcaacacaaggcgagtgatagtaaccaatcctttgatgttggtatcgatcatctgataccaatcttgtaaatccgctttatgtgctggctctaatcccaaggctaaacctgcattattcactaataaatcgaccgcttgccaaccttcaggaagggtatttagagcgttaattgtgacttgttcatcacgaatatcaaaggcaagcggtagaaaattattgcccaattgtgaatggatttctgccaatcgatctgcacgtctacccgtgccaatcactttatagcctgcttcgatcaattttttacagatcgctaagccaaagcctgcggttgcacctgttactaatgcagttgtggttctcattttttctcctaaatcttgagcttatttgtactattaaagtagtacaaataagttttgattgcaagcaatttcattttaattttaaaaatgtcattaaatgaattaatttaacaatatcgcaaacttttgcttgatggtataatctgcccaatttttatttcaactgattgaggttaatcgtgagcaacacacaactgagctataaagatgctggcgtcgatattcacactggaaatgaattagtcgaacgtatcaaaggcgatgtaaaacgcactcgccgctctgaagttatgggcggattgggtggtttcggcgcattatgtgctttacccaccaaatataaagagccaattttagtttctggcacagatggcgttggcacaaaattacgtcttgcgattgacttgaaaaaacacgataccattggtcaggatttagtggcaatgtgtgtgaatgacttaatcgtacaaggtgcagaaccgcttttcttcttagattactatgctacagggaaattagacgttgatgtggcagcaagtgtgatcaaaggtattgcagatggttgtgaaatgtctggctgtgcgttagtgggtggcgaaaccaccgaaatgccaggaatgtatcacgaaggcgactatgatttggcgggtttctgcgtaggcgtggtagaaaaatcagagattattgacggcacagcagtgaaaacaggcgacacgcttatcgcactcggctcaagcggtgcacactcaaacggttattcgttaattcgcaaagtgcttgaagtaagtggtgcaaatccagcggatttattagaaggtaaaccacttagcgaacactttttagcaccaaccaaaatctatgtaaaatcgattttacagttgatcaagcagaccgaagttcacgccattgctcacttaacaggtggtggtttctgggaaaatatcccgcgtgtattacctgcaaacacaaaagcagtgattgatgaatcaagctggcaatggcctgcgatcttcaactggttacaagaaaaaggcaacatcagtcgttatgaaatgtatcgcacctttaactgtggcgtaggtatggtaatttcattaccagaaaaagaggttgaaaccgctcttgcattgcttgaacaagcgggcgaaaaagcgtgggttatcggcaaaattgaacatcttggcgaaggcgaagcacaggttgagattcaataataaaatcttaaatttaaattggggatcccnctagaagncaaaccggcaggcatgcaagtcaaaggc

SEQ ID NO: 268 - DNA, 2020 bp, H. influenzae
tgttatcggatatcgggctcgtacccggacctcaaaattggaatattcggggtaagaagaatcccatccattattggttcccgagggaaaaacggcggttaaatggaccgcctttagggggcttacacagggttaaaataaaaaaccaacggcggaccattccggggacaacacaagtccttattgggggtcgttcttataacattcttccaccaaattaaaatccacagaatccaaattctgcacacagtgaccgtcgttacgcaaatattccatctgaggttgggccaaacgcagaaaatttaaaattaacattagaacgcgcattaccattctgggaagatcaaattgcaccagcaatgctttctggcaaacgtgttttagtagttgctcacggtaattcacttcgtgcgttggcaaaacatattatcggtatttctgatgctgaaattatggattttgaaattccaacaggtcagcctttagttttaaaacttgatgataaattaaattacgtagaacattactatctttaattaagttcaacgtattgttgttctaactgtataaaacaaaaccccgcaaattagcggggtttttaaacaagtccaaattattttgtgcttggaattttgaaacggctgttgaaacgctcgacacgaccaccagtatcaacaacacgttgtttaccagtgtagaatgggtggcagttaccgcacacatcaagattgatgtctttgcctaaagttgaacgtgttttgatcacattaccgcaagaacaagtcgcagtaacttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattgggtgcaatggtttgcacgcgaactaagcccaaatgcgatctttgtccgttaaatattgattgtttggcttataaaaatacaaactgggaaaaatttccagctaaaaaacctataaaagcgatgccagaaaaaactacctattttttattttgtcgaaaatggcaaagatgtttggaacagcgagaaaactcaggattatggggcggattattttgtttttcacaatttgaagataatcctcgttgcttcattttttagcccagaaaaagcccgcattatcagaatgcgcgagtttcgacaacatttagccttttctttagatattatccaattatgctgaaatggaagcgcttatgcgaaagcagctatttaactggcgaaaaggtggaagccaaaaatacaatcaccttcagggcggcaatatggatgacccaaacctac

SEQ ID NO: 269 - DNA, 1700 bp, H. influenzae
  misc_feature (1644)..(1644): n is a, c, g, or t
gcgggagagccgccatggacaccgaaccagaacagtcactgaatgttgatatacgttattaatgcggagtcccgtggggtgcattttgttccgggcgtgggtggctcccagaatttaggggtcccccccagattgcccgcgccattctgccaataacagggatcttaatgtcttcgccttcatctactaagcgttattgtactgggatcgcaatattccagaaaaaaaacgatattcgctgggcaaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgtggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataagctgaaatcctgaaaaagaaaaagtgcggttaaaattgaccgcactttttattataaaagtgagagaatatgagtatcaaaatcttatctgaatcagaaattaaacaagtagcaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatgctatcgagccactaaatgccaaaacctttaagagagacagtatctggcgtgaatacttaactgaaattcttgatgaaataaagcccaaagctaacgagcaaattgctgcaacaattgaatttcttgaaaaagcctcttctgctgaattagaggaaatggcaaataagctcttagcacaagaatttaatttagtcagcagtgataaagccgtctttatttgggctgcactttctctttattggttacaagcagctcaacaaattccccataatagccaagttgaaaacgctgaaaatttacatcactgccctgtttgtggttctttacctgttgcaagtattgtacagattggtacatcacaaggtttacgctacttacattgtaatttatgtgaaagtgaatggaatttggtacgcgcacaatgcaccaattgtaatagtcatgacaaacttgaaatgtggtcattaaatgaagaacttgcgcttgctcccgccgaaacctgtggtattctgggaagctatctcgaatatgtcccccctttattaagatcctcacccccacctttgttccccacgcactgtttttcacttttttacacttcgaaacgcacccatttggtccttttatccgtccttattccccttattccgcttnttccatccccccttatttccgcgccatttatagctctttatctcctctattttctc

SEQ ID NO: 270 - DNA, 2264 bp, H. influenzae
  misc_feature (100)..(100): n is a, c, g, or t
  misc_feature (1932)..(1932): n is a, c, g, or t
  misc_feature (2236)..(2236): n is a, c, g, or t
cagtgtacccgaaatattacctacagcaagagtatctccggttgcagtaagtgttactccgccagacttggactcaattccacctttaatgtcacctgtnttagcggttactcccacgccacctgtggtcgcattaatggttgtgccttctttggttgttacatttcctgttgtggcagagatatttattgtcttgtgagaagtgatgttattatttactgccacatcttttgcggaaatagttaaaccagcgttgttaccattactatcgccagcagcattactattaccattagacgtttccacttcgctatttagtgttacattgtgattgccagctgagatttttgaatctttaaccttgtcaaagattactttttgagcaccagcattaccgctatcactgctagccttgccaataattaaatcactgttatctttagctgtaatttctgctttatgaaagcctgaaatgtttaggttgtttgttaattctagcgttttggttttaatggttagattggcattgttttctgtgcctgaatcagaattctccccattaacgcctgctttgattgttatctgcttggtaatattgactttatcagaagaaattgtgagattgccttctttttgcgagatattgccgccaatttggatttcggcattatttttattatccctgatgtttaagtcgccttttttattggttatatttccggtaataatggttttttgattagtgttagcgtgagtagtaatatttaaactaccttcattggtaatattacctagttttgccgcccctttttttacatcaattatggaggtgccgttgttggtaaaattgccggtaatgtttaggttgttattagtattaccattaaaagtagcatcgtttccaacagtaaaatcaccagatacatcaatagtatcgccagttgcaacaagcttaccttgagtattgatatttccagctacagctaaagcacccttatgatttccaaagtttgctgacgcaagagtaagatttgcacccttttcaacagttacatttttatcaaatttggttttagctttatttgaacctagggtgacattccctcctttaatggtaacattaccgtttacctttaaacctgtatcaagatgagtatctgtaccttcaatttctttaatggatacaaatgaattggttgcgtttatgattaaatcatttgctacattaaataaggttgtagatggcatactaccagtaatgtttagctgcgaaccttcggtaacattaataaatctagaggaaatgttcacccctggagttttgtagttattgctaagcgcattaaattttaaattaacaactcctcctcctttaacagtaatatttccgtcaaaattgacagcagcaattcttgaatttttaactggagatatcggtagggtgtaggaaatatcaactctagcaccttgttttacattgaaaatggtatctcgtgtaaaaccaatccctcctgtgttttttttgtctttagcattgtcatatcccccaactttaatcgcgtcttttattgatgttaaagaaaaactagaatcagaatcaacattaagctgcgtcaaattccaatatgtataaccctggcgatgaaaataagataattgattattagcagtgtgattaattgaaatatttacctgaatatttaacacaccatcaaatttgggctgagaaaataccttgatttcctttagctgtaatgaatttcaaccctctaccagttccatttagtgatacattattaaaacggaaatcttgaccactgcctgcagtaattacaccctgagcaacaattttagcatcacttgcagcacggcctttatcaccccctgccttttcaaaagctacagaacccccagcggtaatatttaaaaacncccataccaatcgtgatatttttgtgaacatcaacccagctacctgctttaatggttaaattaccattttgttctgaggtaatatcaccgttaatttcaactccaccttgttctgagtgtaacgttaatgttccattatgaacattaatatctgcagtaacatttactttctttttagcagaaatattaactccaatacctttagctaaagctgtagataatgttttgttattaacagtatgtttattatctgctagaattttattaggtgaatcgcctctatcggccttaatgaggggtctcntagagtcgaccgcaggcagcaagctggc

SEQ ID NO: 271 - DNA, 1410 bp, H. influenzae
tgatgaaaatttattacgtaaaaaactagcggaacaacatactcagattcgacgtgaatttgattctttagtttcagttgcttcgattattgaagaaagttactggcaacaagataatccagatgccatttatacctatcaacatttagatcagttagcgacaaaagccacaatagatgcgttggctcaaaaagccctaaaaaaatcaggcagatttgtcagcgtattaaaagcagctacttattagaaaataaatgaaatctcaatagatctgaaacagataaaaataacggtgatcgcttaaacgatcaccgttaaattgaactcactgtttaaacagtaaattatattggttattttcgagaagtattactcttcattcaataactttaattcacgacttcttacttgatttttcaagatttccgcaaattcttccacagtaaatgtacctaaatcagcacctttacgggtacgtacagccacttttccttctgcgatttctttatcgccacaaacgagcatataaggcacgcgacgtaaagtatgttcacgaattttgaagcccactttttcatttcggaggtctgctttaacacgtaaacctgcatcagataaggttttaacgacttgttgtacatagtcagcttggctatcagtgatattcatcacaactgcttgggttggggctaaccacgcagggaagaaaccagcatattcttcagtaatgataccaatgaaacgctcaatagaacctaaaatcgcacggtgaatcatgacaggggttttacggctattatcttctgccacataagttgcatctaaacgacctggtaatgcgaagtctaattgcactgtaccacattgccattcacgacctaaacaatctcgtagtgcaaactcaattttcggaccatagaatgcgccttcaccttcttggatttcatattcaagaccgttgtgtgctaatgctgctgcaagacctgcttccgctcgatcccacatctcatctgaaccgatacgattttccggacgagtagaaagtttcactgcgatattagtgaaaccaaaggtgctataaatgtcgtacaccattttgatacagctagttacttcgctctcaatttgatcttcagtacagaaaatgtgcgcatcatcttgagtaaagccacgaacacgcattaaaccgtgcaaagaacctgatggttcattacgatggcaagaaccaaattccgccatacggattggtaaatcacggtaagattttaaaccttgattaaaaatttgaacgtggccagggcagtcatcggtttaattgcgtattcacggttttcagattgagttgggaacattaatctgccgaatttgccagtgacctggtttttcccccatacgcgaaccatcataaag

SEQ ID NO: 272 - DNA, 1501 bp, H. influenzae
tgttcgattcggctcgttccctttgctcctaacgcaggagtttgatcaattcttcgttttctgttattgcgccaccacgagaaccacgatttgggcgatctaatgcttcaaaaacagaagcacttgaaataatgcgtaagtcattttgaagcactgccacatcaagcgatttatcaccaatgcttaatacgccttcgtgaatagctaaagggagttcttctagtgcttttttatgttcccagcgtgctaacgctgctttctcggctcgttctttacgtttttcagccgttaaggaggtagaaaccatatgttgctccattgcttatttataacttttattagcataatgctaaattatatttaagtaaagcattattttatgctttacattctcaaaattttcctctactattttattcaaggtctcaaaagccttatcaagaacggtaactcaccccgtcagcgtgatttttttatgcgtaaaatttaccttgtttgttttattgccattaagacttacaacgcataaaaagaaaattatcaatcaatgttcgacagtgcgactaatacaataccgaaagggaataagtccgctggattcttgaccagttttgagctgtcgaacgcccgatttatcgggggcttccatcaaaaggaaatcaagatgactactcaaatccaattctcaatatttaatttcaaaaattccccagttcgcacgattaccgatcctaatagtgaaatttggttctgtggcacagatgtgtgcgatattctcggttatgtaaatgcgcctgatgcaatgaaaaaacattgtaaagaagctggtatagcaaaacgctatatcagctatccaagcggtagaaaggaagcgatctttatcaatgaaccaaatctttaccgtctgatcatcaaatctcgtaaaccagaagctgaaccatttgaagcgtgggtatttgaagaagttcttccgcaaattcgtaaaacaggaaaatatcaacttcaaccgcaacagctcgccttgccagaacccgaaaagaaattcagttttgaatttaccgagtatgaacttcaacagcttgtttggttgtggttcgctttcatgcgtggcatcgtcacattccaacatatcgaaaaagcctttagagttttaggctcaaatatgagttcacaaatctacgggcaggcttacgagtatctaagcgtgctacgctctaccaatcaaatcttaaaccgcatcacaagtgattttgacatcgaccaaatgacaaactggcgtgtattaaaacacttgcgaggctttaatccaaaagcagtcaaaatcgacttctaaaaacaacggaaaatccgaccgcactttaccgtgtggcggatttttacacctcaaattcacgaaaaaggatacattatgttcagaattctctttgcggtggcgttgttatgggcagcatacgaactcaatttaaaccaagattgcgatgggtatattgcgggggatttc

SEQ ID NO: 273 - DNA, 1235 bp, H. influenzae
  misc_feature (1196)..(1196): n is a, c, g, or t
  misc_feature (1202)..(1202): n is a, c, g, or t
  misc_feature (1221)..(1221): n is a, c, g, or t
  misc_feature (1226)..(1226): n is a, c, g, or t
ctatagcattacaagtcgcgaaaattaatgggcgattgcttgatttagaattgagtgcgttggagcgtgaaaataatgtagaaattattgcaagtcctcgcttactcactaccaataagaaaagtgcgagcattaaacaggggacagaaattccttacatcgtgagtaatactcgtaacgatacgcaatctgtggaatttcgtgaggcagtacttggtttggaagtgacgccacatatttctaaagataacaatatcttacttgatttattggtaagtcaaaattcccctggttctcgtgtcgcttatggacaaaatgaggtggtttctattgataagcaagaaattaatactcaggtttttgccaaagatggggaaaccattgtgcttggcggcgtatttcacgacacaatcacgaaaagcgaagataaagtgccattgcttggcgatatacccgttattaaacgattatttagcaaagaaagtgaacgacatcaaaaacgtgagctcgtgattttcgtcacgccgcatattttaaaagcaggagaaacgttagaggcgttgaaacaaaaaagtgcggggaaaaaataacttttttagacgatgaatttttttaattttcgctgtatccactgtcgtggcaatcttcatattgcaaaaaatgggctatgttcaggttgccaaaaacaaattaaatcttttccttattgcggtcattgtggtgcggaattgcaatattatgcgcagcattgtggtaattgtcttaaacaagaaccaagttgggataagatggtcattattgggcattatattgaacctctttcgatattgattcaccgttttaaatttcaaaatcaattttggattgaccgcactttagctcggcttttatatcttgcggtgcgtgatgctaaacgaacgcatcaacttaaattgccagaagcaatcattccagtgcctttatatcattttcgtcagtggcgacggggttataatcaggcagatttattatctcggcaattaagtcgctggctggatattcctaatttgagcaatatcgtaaagcgtgtgaaacacacctatactcaacgtggtttgagtgcaaaagatcgtcgtcagaatttaaaaaatgcctttctcttgttgtttcgaaaaatgaatttccttatcgccgtgttgcgttggtggatgatgtgnttactnacgggtaccgaaggcccgnaattncgaataaca

SEQ ID NO: 274 - DNA, 2035 bp, H. influenzae
  misc_feature (1998)..(1998): n is a, c, g, or t
  misc_feature (2027)..(2027): n is a, c, g, or t
cgtgcaatatcgcgtgcaaaatcctgcaaaaatctttttagcgtaacaaatgcagatgatagtttgaatcaagcgacagatagtgcattacgttatgttattgggcatatgtctatgaatgatattttaaccacaggtcgctctgtcgtgcgtgaaaatacttggaaagctttgaatgaaattatcaaatcctatgatatgggacttgaggttattgatgtgaacttccaatctgctcgtccacctgaagaagtaaaagatgcgtttgatgatgcaattaaagcgcaggaagatgaacaacgttttattcgtgaagcggaagcctatgcgcgtgagaaagaaccgattgcacgcggtgatgcacaacgtattcttgaagaagcaacagcttataaagatcgtatcgtgttagatgcaaaaggtgaagtggaacgtttgcaacgcttgttgccagaatttaaggctgcaccagatttactgcgtgagcgtttatatattcagacgatggaaaaagtgatggcaaataccccaaaagtaatgcttgatggcaataatggtaataatttaactgtgttaccgctagagcaaattatgggcaaaaaatcggtaacaagtgcgccaagtgcggtcaattcttcgcctgcttttactgcaccagaacgtcaaaattcttatcagcctcagccgactaccgttgcgccgattcgtcaagggagatttaactaatgcgtagatttttattacctgttattttcgtgattgcggcagtggtttattctagtatcgtcgttgtaacggaaggtacccgtggcattatgttacgatttaacaaagtacagcgtgatgctgataacaaagtggttgtatatgaaccaggcttgcattttaaagtgcctttaattgatagcatcaaagttttagatgcgcgtattcgtactttagatggctctgcaacacgttttgttactgttgagaaaaaagatttgctagtggattcttatgtgaaatggaaaatcagtgattttggtcgattctacacatctactggcggtggcgattatgctcaagctgcaaatttattaagtcgtaaagtaaacgaccgtttacgttctgaaattggttcacgcacgattaaagatattgtttctggtacacgtggagaattaatggaaggggcaaaaaaagctttaagttcaggacaagacagtacggcagaattaggtattgaagtgatcgatgtgcgtgtaaaacaaattaatttaccagatgaagtctcttcttcgatttaccaacgtatgcgtgcagaacgtgatgcagtggcgcgtgaacatcgttctcaagggaaagaaaaagcagcatttattcaagctgatgtagatcgcaaagtgacgttaattcttgctaatgcaaataaaactgcacaagaattacgaggttcaggcgatgcagctgcagcaaaattatattcagatgcttttgctcaagaaccacaattctttacttttgtgcgtagcttaaaagcctatgaagcgagttttgcaaattctgacaatataatgattttaaaaccagatagtgatttcttccgctttatgcaggcaccgaaaaaatagagtttaatttgataaaaacaccttcctcgtgaaggtgttttttatagccaacgtcttactttttgtttgtaacgacgatattcatcgccaaatttattttccaaataggcttcttctcgggctatttgacagtggttcataactagtataaagacaattacgcctaaccaagctaaactattacctaaccaaagcgtccaagcaagcaaaattaacagcaaacttaaatacattgggttacggctaaatcgaaatatgcctgtggaaactaattttgttgtgcctttaaagtcacgaggattaatggaggttttacatataaagaattgcataacgctgcttaaagcaatcaaaaatgaaagggaaataacaaaaacaatcactnaaaaaggacagggtaccgagtccgaattncgaaaaca

SEQ ID NO: 275 - DNA, 1894 bp, H. influenzae
tgtttacgattcggactcggtaccccccttaaaagccaaccagacatatctgacgcacctgcagacattgcagtaacaaaactgcctaaacgacgtccaccgagaatgtaatctgataaattattcgtgtaataataggcgagtacgccaatcagcaacatcccgaaaatataaatagtaaaagtaataagacttgggtcgaatccaaacattatataagtccaaaatgggttaaaaatttcagaaagggtgcattttaccttatttcgggctattattctatttagactaaatatttgatgaaatttaagaaattaggaatataaaatggatgctgtcgagttattgatgaacgtaacgcctaacgaaacacgcattgcgctagtagaaacaggaatgttgcgcgaagtgcatattgaacgccaagctaaacgaggaattgtcggaaacatttataaaggtcgtgtcactcgagtgttaccaggaatgcagtcggcttttgttgatattggtttggaaaaagcggcttttttacacgctgcggacattgtatcccatacagaatgtgtagatgaaaatgaacaaaagcaatttaaagttaagagcatttcagaattagtacgagaagggcaggatattgttgtacaagtggtgaaagagccgctaggtacaaaaggtgcacgtttaacaacggatatcacattgccatcgcgtcatcttgtttttatgcctgaaaatagccacgtaggcgtttcacaacgcattgaaagcgaagaagaacgcgcccgtttaaaagcattagttgaacctttttgtgatgaactcggcggttttattattcgtaccgccacagaaggggcaagcgaagaagaattacgtcaagacgctgaatttttaaaacgcttatggcgtaaagttttagaacgtaaatctaagtacccaaccaaatcaaaaatttacggcgagccagcacttccacaacgtattttgcgcgattttatcggcacaaacttagaaaaaattcgtatcgactctaaactttgctttggcgaagtaaaagagtttaccgatgaatttatgcctgaattaagcgataaacttgttctttattctggcaatcaacctatctttgatgtgtacggggttgaaaatgcgatccaaacagccttagataaacgtgttaatctcaaatcgggcggctatttaattatcgagcaaacagaagccatgaccacccattgatattaatacaggcgcatttgtggggcatcgtaatctataagaaaccatctttcaataccaatattgaagcaactaagccatttgcgcagcactccaactacgtaatcttggtgggcataatcattattgattttattgatatgcaaacagatgaacatcgcaatcgagtattgcaatctttatgtgatgcgctttctaaagatcgtatgaaaactaatgtgaatggctttacgcaattaaggcttgtagaaatgactccgaaaagaacccgcgaaagccttgaacacgtgctatgcgatgaatggccaacttggcatggaccgggtcgcggtgaaaacctgtgagacaggttggtaccaaattatgcgtggaattattccggggggatcatttatttcaggagtggcactttggtggttatgcctgcgcagccgtttcacaaaattttattaatgaaaaattctcccggttactgccccaaagggaatgggtttttgggaaagcggttaaggtaaaacggacccgtttttatcccaaacaacttgtggggggggttatgggaaccccttttccaaaagggggggaaaaatttttggaacttttcccgcctttttttttttaaaaccaattttcttttattttatcaataagg

SEQ ID NO: 276 - DNA, 1428 bp, H. influenzae
ataatcggtgatggatgatattgtttaaattgtgcaccgatattttcaattttatctttgagttcgtttaaattaaggacgcgagcttgacgttcgcccacggtttctgtgaaaagtgcggtcggattttgagataattctacaccttgaattgaaaacgtttttaaatcaacctttttatcacgacccgcaatttgctgcagacgcacaccgacaagaatacgttgatgacgtgagttaatggtatctaataccgcgtaacaaacacctggacgcaatttaccatgtaaacctttatcgcgagaaccgcctgtggagccagcctctgttgtattacggaaatgtaaaagggttaaatcgggaattaatgcggtcacaaatccagccattgtggttgatttacctgcaccgttaccaccagaaagcgtggtaactaattcatctaaatcgaaagtacgggcaaaaaaaccattccagttaattaaggttaaagaacggaatttaccacgctctacaccattatttgtcgtcatgctaaaaggcataggtgcgtcaacgatttcttcgacgttttcattttccataatgacttcatcgctctctaattcgatttcattttctaattcaaaaacatcagacattattcttgttctccgtcaaattcttcgtcaatttcatccgcactttctgtatcgttttccactaattgtgcttgtttttccaacgataaggattcaggtgttgccgcttccccatcacgaatgagtctagcttgggcctctaatggatcatctccgctacgcacttccgccccaaaacgaaatacagattcagaaatagtaaatttcccactattttgttcgccaacggtttgaatcatacctaaacgacgtaaacgaccaattgcagctcgcactttttctgccaatttttgtttatctaagtcagaaccacttgaacgctgattaactgcttttaataattttccttcatcagcaagatttaataattcatcatacacttcttgcgtgctaaaaataccttgttgggctaaacgttctgggcttaaataaagataacaaagcactttaccaacaagcatttccaactcagccagtactgaacgtgcaattaatggtcggtgctctccggcgaagatagaagaatccttctggcgccacgaataggtccacggatagcgacgatgaaagccgcctatttctttgggaaacgcattagacaggcgagatattctaaggcccgggcctgtctggcgccccgtgcccctcttatttcttctcgctgcaaatttggtattggcattgcacacgaccgtgtcgggaagtaacccttgtagctgctcgcctctcgtctccctcgatctcatggccgccgcgtagtcctccgcgaccggccccgctcccccat

SEQ ID NO: 277 - DNA, 1821 bp, H. influenzae
tgttttcgaattcggactcggtaccctcattgctcattggctgagcagtcataattcctgtcgttgcccaacgattaaccgtttttccatttgaatctttttcaacaaagttggcatctcggtcatctttcattaaacgagcaatacgtttaatggcatctttccaagaaattcgttcccatttatcagaacctggcgcacgatattgaggatataaagaacggctttcactattgacataatcgagtgagccagcacctttcgggcaaagcgcaccacgactgactggatgatctggatcaccctcaatatgaaagagttttgaacgagtatttgtgccagtatggctgcttaatgaattgtaaggtttgcctgtgctatataacaacataccgcaacttacagcgcaatatgtacaggtgttacgggattcaaacgcgcgtaataatttatattcgcgtggcgcagctaatacgtttgctggagcaaagcccaacattgcagctgacgttcccgccatacctcctgcacagatcttgaagaattttcttcttgagacctgcataatcactcctttcaacaacaagttgttgagatattatagatagtaataaaattcgtttagtagctagattatgttgatttcgttaaaataacactctctagtatataaatcatcgtaaaaacgttgatttattggatggctagagtaacgattttttaacgataaatccataatcaaatgacattagcttcaacaaatattgtgatctagatcataaatataaaaataatttaacagactttttacatttaactaatggactggtaataaatgcagtgctggattcgacaaactatcaacttttttagaaagacaaaaaatacagaaaaattgaccgcacttttgcaacaaaaagaggacatactggctgttgagatgccagtttctttagtatataacgggatttctcacgcagttatgatgtgttccccaaacaatttagaggattttgctttaggcttttctataacagagggaattattgataaaccagaagatatttatggcattgatgttgtagaagtttgcaatggtattgaagtgcaaattgaactttccagccgtaaatttatggcattaaaagagcatcgtcgtaatcttacggggcgtacaggctgtggtatttgtggtacagaacaattgaatcaagtatataaaacttttccaaaattagactgtacttttcaatttgatttaaatttgctagatagttgtcttattgatcttcaaaaaaatcaattacttggatgtaaaactggtgctacccatgcttgtgcatttttcgatttatatggaaatatgttagctatttacgaagatgtaggtcgccacgttgcgttagataaattgcttggttggcacgcaaaatcgggtaagcctagaggttttattttagcctccagtcgagcgagttatgaaatggtgcaaaaaacagtggctgcggggtggaatgttagtcacgatttccgccgcaacggatttagcagtaacaatggcagagaaacataatttgactttaattggttttgctagggaaggaaaagggaatatttatagtggggcatcaacgacttcacaattaaccccaactaagagcgagagtttttgaggggtttggggtgattaaggaaaatagcgggatttggctcctttggatgttaaaaatagaggaatttagcgggaaacataaattatgtaatctaatttaggggattggggggggtttaatatgggataatccccctcatttttaccaa

SEQ ID NO: 278 - DNA, 2237 bp, H. influenzae
  misc_feature (1245)..(1247): n is a, c, g, or t
  misc_feature (1249)..(1254): n is a, c, g, or t
  misc_feature (1256)..(1257): n is a, c, g, or t
  misc_feature (1265)..(1265): n is a, c, g, or t
  misc_feature (1269)..(1269): n is a, c, g, or t
  misc_feature (1272)..(1272): n is a, c, g, or t
  misc_feature (1278)..(1278): n is a, c, g, or t
  misc_feature (1282)..(1282): n is a, c, g, or t
  misc_feature (1286)..(1286): n is a, c, g, or t
  misc_feature (1293)..(1293): n is a, c, g, or t
gccctaatgcggccgtttgggtgtaacaaaaggcgggtggattttgaataattgggcgggggttttctttacgcggcggaataaaaaattccattaaaacttggcgtaatcaaaaaaatgtcctttttgcgcaatggctcatatcaatgttgtattttttcgcaaaagctttaattacaaaatgtgttttttgccccatttttgtttagcaacccagccagcaatttgagttaaataaatttgtggcatgacatattgaaatgccactttttaagcgttgccaataagaatttgaagtcatcattatctttccttgttaaaaaaagaggcgtgattatagcaatttttgttatagttccaacctttttagttagcggataatttcctttattgagttatccaataaaaaatgtgatttccctttgactatcttcgcaacaacaggtaatattcacgccctatgcaaaaggtaaaactacccctaaccgttgatccagtaaaagatgctcaaagacggcttgattatgttggttattattcggcaaatcagcttgagcgtttggcggaatcagtggtaaacgtgctcagcgatgcacaggtaacattatcgttttatgttgatccacaaaaattagtggtgatgaaaggtaaagtacagattgatgtcgatcttgaatgtcagcgttgtaacgaaccttacaaacaaacattggaatgtgagtttacttatagtccagtggctaattgggatcaggctgatgacttgcccgaaatttatgagccaatcgagttcaatgagtttggcgaaatagatttaattggcacggtggaagatgagctaattttagctttgccgcttgtcccaatgcattcatctgaacactgtgaagtgtccgcgcaggaacaggtttttggcgaattgcctgaagaattggcaaaaaaaccgaacccgttcgctgtattagctaatttaaagcaaaagtaaattaaatttaggagtatagccaatggctgttcaacaaaacaaaaaatctcgttcacgtcgtgatatgcgtcgttcacacgatgctttaacaactgctgctgtatcagtagataaagcaagcggtgaaactcacttacgccaccacgtaactgcagacggttattatcgtggtcgtaaagtgatcaataagtaattttttacttataggtgttcacttgaaccgtctaaccttggtgttagatgtatgggcgggggacccnnngnnnnnngnnttactatntggnttncattancatngganaataatncggggtggtcttatctcttacttggcgatagtccatagattttttcctttttaatcgcttatcttattgagtatgaatagtagaattttatccaccggtagctatctgccgagccatattcgcacaaatgcggatttagaaaaaatggttgatacatcagatgaatggattgtcactcgttctggtatccgtgaacgtcgtatcgcagcggaagatgaaactgttgcaacaatgggatttgaagcggcaaaaaatgcgatcgaagctgctcaaattaatcctcaagatattgaactgattattgttgcaactacaagtcactcacatgcttatccaagtgcggcttgccaagtgcaaggtttattaaatattgatgatgcgatttcttttgatttggcggcagcttgcacaggctttgtctatgctttgagcgtagctgatcaatttattcgtgcaggcaaagtgaaaaaagccttagtgataggctcggatctcatttctcgtaaattagatgaaacagatcgcagcactgttgggctatttggtgatggtgcgggtgctgttattttacaaccgagtgaacataatgaattatctcactcattttacccctttaacagaaaaaaaatgtccttgtttagctcgccaaatctggtatacaaaatctgctttattaaatccaggtcacaatacgtaaattggccgttcctgactttcaatgggtggaaaaacccttttacctaattttataaaaaaaatttaatgctttgccccccaccatttttctttttcccctccctcttaaatttaattgacatttcactggtggtacctttaatatccctatatttctccctcggttttgtgttgagaatgctcttgctggtctgttctcgggcctgccttttttctacctctcgtgccgtgtcttgggttctcgcttg

SEQ ID NO: 279 - DNA, 2592 bp, H. influenzae
ggatatcggctcggtaccccttcacggctggtgtatggtttattggttcgattctcgctttaatttatacttggttttgtatgaccacatcaggattaatgatcctagaagctaatctgcattatccaacaggttcaagttttgacaccatcgttaaagatttattaggaaaaagttggaatattatcaacggcctttctgttgctttcgtcttatatgttttgacttatgcctacataacctcaggcggaggcattacacaaaatctgctcagccaagcattcagttctgctgaaagtgcggtagatattggaagaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaagcatatttaccttatttattgaccgcacttccagtttgtctcgtgtcgtttggtttccacggaaatgtccctagtctcgtcaaatattacgatcgtgatggtcgtcgcgtgatgaaatcgatctttattggtacgggcttagcattagtgatttacatcttatggcagctcgctgtacaaggtaatttaccacgcactgaatttgcaccagtcattgaaaaaggcggcgatgtttctgcattattagaggctttacataaatatattgaagtggaatacctttccatcgcattaaatttctttgcttatatggcaatttctacttcattcttaggcgtcactttagggttatttgattatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaatgctatttggcatattaaatattgtggcgcaaattggggcaaacttaggttggtttgcaagttttactgggtaagttttaaaaaataaatttaaattattaaatagcgatctgcactttaactgtgggttatgtagtccaactaattcgtgcagatcagcccctcaattattttactttttattagttacaaacaattttaactgcaagtccgccttgagatgtttcgcgatacttggcgttcatatctttacctgtttcgtacattgtttcaatcactttatctaagcttactcttggattggtggtgcggcgtaaagccatacgcgatgcattgatcgctttaactgaagcaattgcattgcgttcgatacaaggtacttgaacttgaccgccgacagggtcgcaagttaatcctaaattatgctccattgcaatttcagctgcgatgcatacttgtagtggattgccacccaaaatttcagctagtcccgcagcagccattgaacaggctacacccacttcgccttgacaacccacttctgcaccagaaatagaagcgttcatcttataaagtgaaccaatcatccctgcggctaataaatagcgttcaatgatttcaggtgttaatggcgagatgaatttttcatagtaagctaataccgctggaataatcccgcacgcaccgttagttggtgccgtaaccacgcgcccgcccgctgcattttcttcattgacagcaagcgcaaacatattgacccagtcgattacgcgcattggatcgttagataaattcgtatttgcttgcaacgcacgataaagtgaagctgcacgacgtggtactcttaatgggccgggtaaaataccctctgtgtgaataccgtgttcaatacaagcctgcatcgttttccagacattctctagatgagcactaacagcctctttgccattcaatgcgatttcattttccaacatcacagtggaaagcattaagccgttatcactacaatgtttcaaaatatcttcggcatttttgtaaggataaggcacttggactgtgtttttttcttctttgccaaaatgggcttcatcgacaataaaaccacccccaatcgaataataggtttggcgataaagctctgtgcgattttcatcaagagcggtaattgtcatgccattttcgtgcaattttaaaaaagtgcggtggaaaatgagattattttcaaaatcaaattttactatcttttgaccgacattaatgggtaaaagcgcagtttgtttcactttctcgatgaaacctgaaatcatatcgatgtccacattatgtggtaaataacccgctaatcccataatgatggcgatatctgtactgtgacctctccctgtcatcgaaagagagccatacacatccacataatttcagctgtttgttcaaactgattcgggggtctctagagcgaccgcaggcagcaagtctggc

SEQ ID NO: 280 - DNA, 2039 bp, H. influenzae
  misc_feature (1734)..(1734): n is a, c, g, or t
  misc_feature (1737)..(1737): n is a, c, g, or t
  misc_feature (1751)..(1751): n is a, c, g, or t
  misc_feature (1788)..(1788): n is a, c, g, or t
attcggctcggtaccccattagcgttatttgcaaaagcaaaaatttcacgttgttgatctagtaatgttttagaccttgtaatgtgcctgataaacattcttgtgcctcacttactgcaatatcttctttaattcgagatatttttaagtattggctgtaagcattatttggtgtgtaacctaaagttaaaatacgttcagccacctcatctactctagcaactaaattagtataaatttcttcaaattttgcgtgtaatgcaaagaagtttacgcctttaatgttccagtggtagccccgcacattagtatagaaaacttggtaggttgcaagtaattcgttaagtttatcggctaattctgctgattgaactttatctagtccgattgatgtttttgacataataatttcctttttctagttgaataattgagctaatgccctccctttgatatgggtattatacctttctataatttgaagtgaaattgttctattcaatataattgatagccttagtcttatttgttaagaaattgtaataaatagaagctatcaaataagtgatcaagatcacaattttaatgaatatttaatcaaactatcgcagctaacaataaattttgatttaataagtacagttataatttttaatattttttctaaggatatgttatgcaagaacttattaagcgcaccttgccacaagatgatgcacttaatcaagctattgtgaatgaacttcgttcacaaaattgggctggttttttaaattattcccaagtgcagcagctttgtcataattttgaacttaccccactaaaattggctatgcacttgttgccacttgctgcaagttatagtcatactgctatttctcattttaatgtgggggcaattgctattggcgaacaaggggatttttatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatgaattgcacggtgctgaaaaaatttcaattcatttgccgcatagccaaaataatccattacattcttatttaccggatgcgtttgggccaaaagatctcgatattgcagcgcatcttttggcggaagaaaatcatgatttagttgctgatcatcaagatgatttggttaatcaagctattttagcggcaaatcaatctcattgtccttattcaaatagtccgcacggcattgcgattttatttaaaaatggtgatgtggtgacaggacgttatgcagaaaacgccgcatttaatccgagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcagtagaattagagtattattctttgtaaatatgaaacgcgagtaaaataaaaaggaaataatttccttttttatttatttgctaaaattaccgctcttttcggtgcttgatagccttcaatggttttactgtgatcatttgaatctaaaaaatcaatcaggctttcattttccacccatcagttttacgctgttcttctaatgtagntgncgctacatccacancacgtacgttgggtaaagccaactttttctagccagntaattagtgcggcgacagaggggataaattaacatttttcattttcgcatagcgatctgctgggatgagcccagtatttacatcgccatccaccacttatggttctataccaattcccaccttttacaattgattttcattggctaaagatctatggggattacgatgatgagacgcccatgaaatcacggccaatgccctaatgttgctttgctcataccaggggaaagattgtccgcatcatttagcct

SEQ ID NO: 281 - DNA, 1765 bp, H. influenzae
  misc_feature (1726)..(1726): n is a, c, g, or t
  misc_feature (1730)..(1730): n is a, c, g, or t
  misc_feature (1740)..(1740): n is a, c, g, or t
  misc_feature (1752)..(1752): n is a, c, g, or t
  misc_feature (1757)..(1757): n is a, c, g, or t
gagaccccatgtgataattagaaattggttaatcgcagccgcaacttcttgatcttgataaatattgttcacaatatcattaaaagtttgagatagcactttatgaatttcatcattgtccgcattaaatacgccctcttgtgaacgcgtgacattaaatgatttattatacgaacctttcgcaccttgtacataaactgtcgcttgaattttagtattaagtttataacgaagattaccttgttctacttgcgtaccaaattcatgcacatctacagttacccacgcatttgaaccatttaattgcccaattctaaagcctttactaattaaattttgctgcatcacttgctgaaataattgtgtaacacttggggatgcatttaatttaatcagttccccgtgtttcgtataactcgcaatctcttgtattgtgcggctatcttttgttgtaacagatacaacggcagttcgattaacattcattgaagcacttggcacaggcggtgtaaatgctaatatatttgattgtgcttggcagcctgcaagaaataatgtagcagctagaatacctactgatgataatgttttaattttgtttactaatgccataatttccccataaatcaattagaattgtgctattcttacaaacttccttattaatgtatagcgtttcattttagtttttgtggagaacttatagtgtcaattcaacaaattattgagcaaaaaattcaaaaaaaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaactaagaattaaatcatagtattcacgcattagcattacatttattcactccagaagaatggaaagcacaaaatgaaactgtaccgcactcaacaaaatgtgcaggtattgggcgttaattttgttataaaaatgtaacatttttgatatatcgcaaaaagttctaacaaaaaaaccctctgtttaagtagcgaaaaacagagattttcgctagaatgaggcgtttaatttagtccaaattcgatttctcggtaaaattattaactgtgaaatcaatccatttgagttttttattttgtgacattaatgtttttttagcggtttgtcacactcaaacgtgagattgcttctagggtatttttactatattagcaattgtatttttaaccttgaaaagtagtgcaaatagtatgattacaattaagaaaggtttggatctcccaatcgcgggaaaaccagcacaagtaatccatagcggcaacgctgtgaatcaagttgcgattctaggtgaggagtatgtggggatgcgtccttcaatgaaggtacgcgaaggcgatgttgtgaaaaaaggtcaagtactttttgaagacaaaaaaaatcctggtgtaatttttacagcccctgcaagcggtaccatcactgcaatcaatcgtggcgaaaaacgggtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttnccanccattgggtnaccgaggcccgnaattncggataac

SEQ ID NO: 282 - DNA, 2105 bp, H. influenzae
gagaccccctgtcccctttgaaaggcattatcatctaaatagttaatagtatcggctagctctttggcatctttggtggttaatttaaagtttttctgtactttaccaaataactctactaattcatcggggttttctgcatcaaatgctgttgccatttgggtatttaagcgaataaaatcttctaattcattttcctgaatatccattctcgctgcagcagtaaccatgtcaccaatttgatttgtggtaagaggtaattcagttgaaagctatttaatcttgtttttccattcatcgtatttaggggtaaattgcccaaatttgtcttttagccctggaacttggcgagcaacccccgccataacatcttcaaacgacataaaatctcgaatggaattgacaattggtgcagtcattgttgtacctgcagctgttgcctgtgcaccaatgatttgtgctttaccactgatatctttaagtttctcaacttgcccacggtattgattataagcggcttgttttgcgttgagttttttcaatgcggcttcttgatttttaatttgatccgttcgcacttttggtgtttttctgtagttccctttgcttttgcgcgagtttttctgcagaaatgcctgattttgctaattcttggcgtgcttgctgtaatttatttgctgcatcaatttgttcttgcttgagtttttttaccgcactttttgctttctctacttccttttgaaatcctgcagtaggatgttgagcgttcttcatatattgagcataagatgcggctttttgttttgcttgctctaattcttgattcagcgaatctaattttgatttcaatgggttgatagcagaagcatattgtttcattgcagcttgatgctgcttattttgctgatttagttgtcgatgaatcgatttgctttcttttagttttgccgatagctcatgaacgcttttagatgcactgcgaactggagcagatattttatcaatggcatttaataagactgtaagctctaaatttttcatttttacccactttttcttgacattttaggaataaggaacaaataatgaacaaacttaacagggagagaacgatggaaatttttgttttgctcattggtttgccaattattgttggtttacttattgcatttggtactgcagtattagccgcatttagttatatttttgttggcgcattatctttagcgattaatttctggtatatcacgttagcagtaatgcttgttttgcttgcacctcttatttatttaaatagttggttattttggattttggctgcactcgttattttctttactgttgcttggttttttggtggcgataccgaacaaatcaaagcagaaattgaacgtaaacgtattgctaaagagcataaattgtaaattaacccaattaaaattctttacccgctatagctctaagcacaaatctttcaatcatttcaatatcttcttccgcaaagcccagtaattcacgctgggcatattgcactttgaaatctttattgttagatggtcgtgccgttaaaccgtattgatgcactgcgaactggagcagacattttatcaagggcatttaataagacggtaagttgtaaattattcattttttcgccttatttttattgacaaataaacgtatgattgctaataatgaagaaagagaataaggagcggatatgaaaaacaaaagaacatctcgcacgttgatcatgctaaacattgctatgtggagccttgttattatttccacctgtttacattatcaatttaatcctttttcatttatctggtttgatgttatcgcaccagttggtcatttttttgcagtcgttttttctgctttatctagttttactgtttcaatgtatgaactttttaaaccagaaacattttgggggtgggtatggtttgtaatgtttgtcgtgccaatcatttgtttgcctctttatgtggttttattggtattgtttgctggtaaactttcacatcatgatacggtggttccacttcttattaaagtaatagctttgctaatgggtaccgagtccgaattcgaaaaca

SEQ ID NO: 283 - DNA, 1983 bp, H. influenzae
atccccatcaacgaatactatgagtggatgggcgaaataaaatcacccgaaatatcaaagaaatagagcaactttatcccttaatagagaaaatagaaaaatctggaaaaagtcttgaaatttcctatgcaaaatatatttctcttcaattaattaaaaaaataattcgcatcctcaataaaaaaagagcgagtaataaatgggatgaatatgatgtaaattcatttattttatctctaatcaaactaagaatgacaatcaaggaattatatttaattgaagttaagggtgaattaagaacagaagaagaactcaatgctattgctgcagatatatccaaagcaaaattgaatttagaagagcacatctcacttgaagagcaattagtagagaataaaaaggagttcgaaaatttaaaaaactcactgattacactcaaaaaatcttataacgacgcacaagaacaaataactgaaatttcccagtggcacgaacagtcagagaaattaagtggcgacatttcgaactatgaattcaccgcacaaaataatcttactaaaattacgacattagcaaccacagcggaaaccaataaaccccaaatcgaaaaatatcatgaagatattgaaggtatgattaaattattcaataaacaaaaagaggagattgaaatgattattgaagacgccaaccgagcaagcatggcaggttcgtttaaaactcaatctgaaaatatcgatagtaaaatgaaagctgtagataaaattttgctttgggtcacttgttgcaacatctgttatttcattggtcaattattcaacaagcctgagtgcagcagacagccttaatattttacaatttcttgctaagtccattgtgacaatcccgttacttgtcatcgcctggttaaaagcaaaagaacgggcttatctctttagattaagggaggattataactacaaatattcctcagcaatggcatttgaaggttataagaaacaagtacaagaacaagaccctaaattacatcagcaacttctgcaaattgccgtggataatttggggataaatccaaccaaagtctttgacaaagatttaaaaagcacaccacttgaaacaattatcgatggagtaggaaaacgcctggataaagctgttgatggtattaaaggagaggtgaatgacattccaaagaaaacaaaagaattaattgatgatgaataactcgctccctcaaattctcagcgctttttatttgacaccgccctcacttcggattaagataaccacactttcaacagaaagtcgggaatgtcgcagtttctgaataacttggagcggtggaaagacagacgctcaatgcgtctttttttatcgccacaaaacagctattctacctttttcataaatttatgaaaaagcccaatgatgaactgtttaggaggatcgaaagatccgccgttttgctctaagtacggtactgcgaatcctattcagttcatcaccaactattcgcagtggttcgtgatgagttttaaaacttaacttagagcacatcacaatgacacacttaaacttaattcctgtttttaatggcttaatccaaaatcaacccgctcaactttgcaacgctcgcgaacttcacgcattcccacaaagcaaacagcacttcactgatcggatcaaaaaccgccatcaacgaacatggcttcattcaagatgaatactaccctgtcatccccggaaccccctcaatgcatcccctttctgtgttcccccccttatccccatatatcggcgcaaaacctagaatttccttccctcccctaacccccccatcccatttcattccccccactccccttccccccctcgcctccttatctcctttctcacccccccctttgcctcccgcttttttgtcccccccccctccccttcctcccctccccctttttcctttttctcccccccctccctccc

SEQ ID NO: 284 - DNA, 2481 bp, H. influenzae
gatttaagtaggattaattggttaatcacacgttttatgtttattaggcaaagttaaaaaaccttgcgggaaagtaagcgattttcaccattttgaaatcaaattcaatgaatttttgtttgaaaagagtgctgtattggttcataaaaaatatacactttagttggttatttagtcaatttttggggtgtagatcataaaatgcgttttttaatactaacttttttaggttaatcaagcgtcttcctattttaataaggaattatcgagtgacaaatcttcatttttatttacacctataccgcgtgcgataacatttttggcaatttcgtgtgcatcttctaaggaatgttccgtatagcttccgcattgatagatatttaattcgggaatagaagcttgatcttgtacacctaaaacatcttgcattgaagctaaccaagcctcagacacttcctgttcatttggtgtgccaatcaaagacatataaaatcccgtgcgacatcccatcggagaaatatcaataatttctatgctatcgccatttaaatgatcgcgcataaatccagcaaataaatgttcaagtgtatgaatgccttttggggaaagaatttctttgtttggaatacaaaaacgtaaatcaaaaacagtaatattatcgccttttggcgtgcacatcgtttttgcaatgcgtactgcaggtgcgttcatttttgtgtgatccactttaaaactatcaagtaatggcataaattttccttataaatcagttggttaagaaataattgaataaatatttattttttacaaattttaatgaactttatagtaaggttcattgtcttatagaacaagcaacttgcagttgttttaataaaattggttccttaggttatttgccccacatttattgtggggttttttcttgctcattttataataagaatggtgtactcaaaaacaataacgcaacataacgaaccatttttcccagaaagataaagagactactcgttacaaaatttaatcttaaccaaccagctatggcacaaaataaatcgccaactacaggcagccagctcaaaagtaaaacaatcgccccataacgccgtagctgatttattgcccataaagtgcggtaatttttgggatcgaattttggcatccatcgtccaattccgtaagtggttaaacttcctaagctatttccagcggttgcaatcaatattagagctaatatatctgcgttaaataaagaacctaacattaatttaggtacagcaagcgcaacaaatataacttctgaattacctggtaatactgttgcactcaaaaacgcgctgataaacataaagcataagctattagcctgccaaaaatcagcactaaaaaatgaaaaaatatccattatcttggcgaaataatttctcgtgtgcgaacatcaaacacatccattcccgcacttaatcctgcttgcacgcctaaatccgcatcttcaaatacgatacaacgacttggatttgcttgaattaactccgcacagcgtaaaaaagtttctggatgtggtttatgttcttttacatcatctgcactgacaatggcattaaagtaaggtgcgatagccagtttatccatcaacatatcaataattttacggtgtgagccagaacctaaagcaatcggctttttctgatggaaggatttaacaatttcaaaggttggcaataactttgattgggtcggaataagttgataagacaactcacgttttgcagccagcacatcctcaattcgatctagtggcatattcgccgctttcatcatttcccccgcgatagttcgaaccgtcgccccgccgaagttatacataatttgaaaatcaaattcatagccaaatttctttcccaccattgtccaagcctgcgcatgcacgggcattgtatcaattaaagttccatccatatcaaaaatcaatccttcatatggattgaagatctcgtaatctaacatttttacatccttacaaatttttttaccattttgctacaaaactgggatctatgcactgttttatttcagttaaagtgcggtaaattagcgaacaaattttgaactaacttaaaccaatgcggttattttaagcatttatcaacgctgggaaaacttccaggcaaataaatcaatctttttttggtggggggatttcctttacgagatccctttatcttatttttgggctagctgtatgggattactctttcaaggggttcctcacgcccctacttattggtttggtattttatgcccgcctattaacgtatatggttggttttttttcctccgtcttctttgtggcctcattaaaatttcaaaggatgtttcttccccccctggttatttgttttggcccccgcctcggctgttattgttggtattttatccgcccggtgttttattcttttttttgctctctatcacccg

SEQ ID NO: 285 - DNA, 1626 bp, H. influenzae
  misc_feature (1563)..(1563): n is a, c, g, or t
ctcaagttcaagataattacggtaatctaacaattcttcgccgattgtttgtgctgtgcgttgtcccatatcaatatgtggattgatacgttgatagagcttcgccatagcttcagaaaaggtgatgcagttgtcgttaaataagtcttgatattcatcttgctgaccagaaagtgcgtccaacaacatggcatgggtatcacgaatattcactaccaaacgaacagattttacttgaccaaacgagatgttttgcaaaccttgattgagcatacgaatacgattttgttcacgctgaatcgttttacgcataatatttgcaacactttcagaactgatcgccaattttttctcacggccagttaattcagccgttaaacgagaaagctcaatttccatttgttcaatggcatcaattggatcatccgttttaatgatgtcttgacgaatacgttcacgtaaatgctgatacaccgcaataaagaaccgcactttattttcaggtttgcgactatcttccgacactcttaggctatcacgtagatattcattatctgccaccgctgtacgcaacgcacctaatgctttatccgacattgaacgtaactcatctgcagataaataagcgagctctcggcgattgaggcgtttttccatatcagaattacgtgatagacgtaaaactacacaccaactcactttcgctgctaccactaattcacgttgagtcttataatcgcgttcagttttgcggattagacgatttaagttgtccgcttcactttcaattaatgtgagttgtttttctacataagaacgacgctgacggctcgttgaaagttgttgatgtaattcatcacgacggatacgcgcgcgttcttcagcaccatcatcagctctcacgccaagatcgctaatttcactaatcaattcatttaaaagctgatatttactatcgtaagagctttgtaactgaatcaatacgcgattatattcagcaaattgactttgtttttgacgaacttgctcacgttgcatatctcgctgagcctgcatttgttctaaacgttggcgaagtttttcgttgagttcagaagttttagcctgccctgcatcttcataaccaaaatgatgtttacgttgtacaacatcagctaacgcaaatacacgttgttgaacttgtttttgacgctcaatcgcttgagttaattcattttttaagccgtcgtaattttctggatcactttgtaaactattggcaatcggctctaattgtgacaacgttacgccatattgacgaataaaatattcatcttgctctgcaatatctaattgttcacgacattcttcaatacgatcaattaaatcttcatcagccaatacattgagctgtggaaataacttgttgagtaactgcagtttttcttttgcattatttaattgaaagccgcaaccgcggtcccccgctattggattgatttaattcacgatacatttctttacgcgccgcgaggagcctcaaaccttacctttttcgtctcctgttggaagtccccgccgttncggttttccacacactgggcgagatgcgcggcgtaacgtttgtttcttttgtcccccaacgca

SEQ ID NO: 286 - DNA, 1704 bp, H. influenzae
  misc_feature (1676)..(1677): n is a, c, g, or t
aaagtttactgtaagaaaatgcggtcaattttcaccgcactttaaaggtaaggttgctcgtattctacgaggaacaaaaatgatgtgcaaataataaagaaataattaatggaaaatattgtaaaattaagctctacacgagcattacaatgatttctctgtgcgagcgacctttttaatgccgtcttcttttaagcctagttctgtagcaaggtaatcaaataccccaactttagaaatggttgcgggcacaactaaaaaaccatctttagtgatggttctttgtgtagctgcttgagtggttttgtctgtaaatttcatttatttaccccaataaaaaactcggcaatttcaggccgagttgaatttagtatcttaagagtgataaaataagccaagccaagccacaggcaatagggcatagcacgtttcggacgttaagcagacgccatttgtgagtcaagcactatgcggagcttgtggctttctttttccttttaatccacattgttttaactgcaatcttcttgtgtctcttcctaacttcctgcacgctgaatatttcgtcatcaatctcttttttaatcaaaaacgtttcattccctgaatcgcttgtcccagtgtactcaatgctatcaaatgcggagacaaccaaaggcaataataaaatgtctttttttgtaacggctctttgccctcgtttattttccgctttttcgtttccatgttgtttcaatatgtgtcggatgcttgattcatcaatactgtgttgccaatctgtaatatccaaaccaatactctctttcgctaacgtaattaattcagaattaaccccaccaaagttagaaaatgacttattaccacctccaccgatagagctttcaaataactcatcgagatccattttccctgtcttattaggttctgcggcctggtagcttaattcggtttcttctgattttaagttaactacatcatcaagcactggaatctgaacgcatcgacaattaacatcatgaccagggtgaccagtatcggcaggcggattggcatattcgaatatctgcccatctttttccgcatggctttctcgcacacgctcatcacccgatgttgaccacatgtatttttttataccaacctcttcatgtctcgcttgcgttaaggcggcatttaattttgaggactggtctcgagcaataaacatcgctcgtttttcggttgttttacctaagtcttttacttgtgctgcaaggtctttatttaaagaaccccgaaccattgcttgcatgacggtattttgcactttatcaagatattgcgagcgaatagacttgattaactggatattaccagcggtcaatgcattcactctttcagcaatatttggactattgcgtaaataagcggataaatcgatgccagtttggtttttcaaattggttgatacttcagcatggttttgtgcatcaccacgaccaacgaagccattggcgatattttcagcttgagaagtgcggtcagatttttcgtacttttctaatactttcatcagcgctttcgcactaatcgcctggaaccctttcgcatcatccataaaaaaagagccttgcggttgttgcatagctctttctacatcatcggtcatcgttttgacgaactgttaaggggtcccnntagagcgaaccgcaggcagcaagcagc

SEQ ID NO: 287 - DNA, 1930 bp, H. influenzae
taccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccattgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaacaaataagatatgttaaaaaagccatactgttatattgaacagtatggcttttttatttaaactttatgttatggaataatcaaaagattttttagcatattgctaaaaacgagaaaccccgtctcgtattccaaagagcggggcttatcaggagtaagtaaaatgaaaaaaattgcctttttcattttcttgattatctgttgtttagttagctgttccggaacagttatctaagataatcgcaaggggacgatgtaggagttgtccccaatgcctccaatcttaaagaattctttccttgattgcaagggcaattattgactttgaacctttctccacaaatctttactgtaaatgacaccgacagaatttacttgagcacccattatactcggtgcaagataaacaggcgtactatattgaaaaatgggtaacactaaatgctcttgttgaactatcccttttaattttgcgtaattttctaaccgcacttttccggatgtcgtcgtcattgcactttcaaataaacgatcaaattccgcatttttatagccatttttgttatctgggctttttgaatagaataaatttagaaatgctgcaggatcattaaaatcagcacaccagccagaacgaattaattgaaaatcgccttttgtgcgggccgtttgcaattcttgccagctcatcccttgattttcaactcgtaataaatcagattgtgataattgatgatttaatcgcattgcaatggtttgattcagagatgaatcatcataacgaatacgtaatttcaatggacgagtttcactaatttgattttgggaaaagagctgttctgcaacaactggctcccaaacagattcttgctcacctagcatagattttggcaaaaaagtattgttaggataaagatgagcaatatctgcaaccaaattattggtagaaatcatcgaaacaatcgcttttcttaccgcacttttttgtaacacaggatcggaaagattaaactcatagaagtaagtacaaagttgcggataatcttggatattctgatcgacttttttcggattcattacaacatcaaaatcagacaaatctgcatctgctgcaattttttgatacttcacttgctgaaatatcactttttctttcgcccaataataaggattggtagttaaaatatgctgattttcagcctgactttgtaactgatatgcgccattactgataaatatttcagtcgatttagcatagtgaggcaaaagactgacatgtgccagcatagaaggtaaatatggcgatgctttatctaattcgatgcgtaaagtgcggtcattttcagcaaacaatcctagggattcaacaggtcacgctctttccaatactgccttccgcatttttaagattcataaaaggccggttatttctaatgtgggctttccgaacgagaaagtgttcgccaagattggacaaaatttgaggcagcgttaggcttgtcattgtgacctttatccgttttacgcaatgggaaactccacgtgttattgggcttccggtccgcaatttcttggctacagttgggacgatgattactttcgccgaaccaggctgtttatct

SEQ ID NO: 288 - DNA, 2240 bp, H. influenzae
  misc_feature (2210)..(2210): n is a, c, g, or t
  misc_feature (2231)..(2231): n is a, c, g, or t
gtgcaaaaacaggcgttacttcctcctgcaacaatggaattgtaagaaggaaatcttgcgcaatggcgattaaattcatgcaaaatatcgctttcaatttcatattcaaagcgatttgggcgtgttgtttgcatcgctttaatatgcccaagtgccgtaatttgtcccgcttgttgtattaagcggatttcattcggcgattttataaggcgcatttcgctgagcattggtcgccaatctaaaatctcgctaaaattcaccgcactttctgacaccaatgtatcaccccaagtatgaatttctggcacatggtaaagtgcggtcaaatttttcagtatttttggcagtacggtagcgaattcttcaatagaataggcttcatttacattaagttgctgtggtgcacgctcaacacctaatcggcgaccattccacgtttcaagtaacggatcgcatggacgaagaaaaataatggctttttctacttgttctgttttcagtaataacagtgctgcattcggttcattaaagcctgttaaataccaaaaatagctatcttgacggaaaggataggtacaatcattattacggcgtttttcgatttcagaaaaaagcaataatgctgaattaggttgcatttgagcgaatactcgtgtgcgacgttcctcaaattcttctttaggcaatttagccatataagtcaattccatcctagatctccttaatgtaatacaggtttgctctcaatttctccttcgttgaaatgagaatagaataacattgcaatggtgcgaacatattcaatgatttcttctagtgcttccgcaagctcttcttcattatcatcttcattataaccaagttggcaaatatcttgtaaatcatctaccgcttcgccaatttcacctttttcttttgctaattcaggttgtgctaagccaagaccaagtaagaattggtttgcccagtcagataggctatccgcttgtgcaaagacattttcatcttcggttaaaccaagtccaaaggtaaatccttcaacatctgataaggtttgactaattttttcataaagttctgtaacgggttgaactaatgctgttgggtaagcgtgattatcattgctgaattgatataagagcggcagccaactttgatcttttaatccaccacaaagtaaaccgcttaaaaagccgtgtagttctgttgcattaaagccgattccagcagatttaagttgttggttaaggtcacaatgagaaatgagcataatagatttcctgagtaaatgtcaagctagcgtaaacctttggacataataaagccatcgcttgaccaattaaatagattaagaggctgggggggcgtcactgcttttaacgctagaaatgaacctaatttaagatctggtaatgacattttatataaaaaaatggtttattaaatttaacctctgtccattgataatattgctcgcttgctttttgaattccgccgtaatttgccattcaggatgatttaggcgtatctggtaaccattgggtttctagtgctatgccagaaaaatcggcatataattcgccatttctcgttggtgtacctgcaagataattacccgtataaacctgcaatgcagcttgcgaggttcttacttccaaacttaaatcgccagttggagaggttagtaacacacaaggcttttgccaagctttattgacaataaaggaatgatcgtaaccttttgttgcttgctgatccccttgtaaaaaatcttgcttgatgggtttagcaatacggaagtcaaaacttgtattcaccacgtgctttaatggagaattaggaatcccctcattatctacaggcagataaaaatcagcatttaaacgtaatgtatgttcacgcacgtcactgccttgcgctgcattttctaaattgaaataagcatgattcgttaggttcaatgcagtatccttatcacaaatccctgcatattcaatttttacgctattatcatctgttagcgtataggttacagacacatccacattaccaggaaaaccttgatcaccatgctctgactgtaatgaaaaacacacaaaattctcaccgcactcttgaattttccaacgacgtttatcaaaaccctctccaccatgaagctggtgctttcacttgattactacttaatttaataaggtcgccatcaattncaggataccgaggctgatatncgaaaacag

SEQ ID NO: 289 - DNA, 1425 bp, H. influenzae
  misc_feature (1396)..(1396): n is a, c, g, or t
gtatatcggctcggtaccccttactcttgcttgataaaaaatttcagcaatctgtataggcttgtataaatgtactcttgctttctttataattttatctaaagattcttttgctacttgaatatcgttcatttttagtccaataatgaaagttgaattgcttgatttattttaggcgttgccatatttaaactattaatcattgaaccagcaatagccctaattacaggaatactaactgaattgccagcaactttacgtacctgagaataaggtatattaatttcaaaagtatctggaaatccttgtaatcttagcatttctcgcccagttaatcgacgtaccccatttacaactagataattataacttcccccagctcttaatgcacaagagtatggaagagcagaaacatttcctgaaatattttcatgccaaattgaaggataaggcacatctttagtaattgaacttaatcttttccgttttagttcatctgaaagaaaataattattaggaacaacatcatcactctctaatatattagaaagttcttcatactttcctataggctttggaaattcaaaatgcaatttatctaaaaaacccacaatgtaaattcgctctcttttttgtggtaatccaaaatcaagggtatttaatactttatgatataccgtatatcctaacttatttaatttatcgttaataactttaaatgtattaccattatcatgtgttgttaatctttttacattttccagcaaaaaagcttttggttttttagctttcaaaattgcttctatattaaaaaataatgttcctctagtatcagcaaagcccaatcctttaccagcaatactaaatggttggcaaggaaatccagcaagtaaaatatcatgatctggtatatcgctaggagatatatcattaatatctccaaaaggtttttcgccaaaatttacttcatacatactttgagcatacttatcccattctgatgaaaatacgtttttacatccaaatgcttcaaaacctagacgaatgccaccaattccagcaaacaaatctattgttttatattctttcatacttattactaattaatacttatcaatcacatgcgcttgcacttcagcaccacgtttattaattgcttgccaatctggataaatacccgataaatcatcattcgccataccaaggcgtactgcttgatcaacaatgattcgagccacatcaaaatgacgagaaagtggataattttccagttgttcttttaacactaaactcaaatcaatcggacggttattttcacgataagcaatcagtaagccttgcatatgctctacaatttgatcgtgtaaatcagaaagggattcgtatgggggtctcntagagtcgaccgcaggcagcaagcatggc

SEQ ID NO: 290 - DNA, 2815 bp, H. influenzae
  misc_feature (372)..(372): n is a, c, g, or t
agttaggccaaaaccgaaaaaaagtttataccccccgggtcagccagtacccaaagcgaaaaccccccaaagctcatgcggtaaagcagggattaaaaatccccggtcggggggtcgattccgcctcaagggccacatttcctccttagttcagtcggtagaccggtggcctgttaatccatatgtcgcaggtcgagtcccgcaggaggagccaaatttagaaaggccgctaaagagatttagcggcttttggctttcttatatataaaatatataatcttctctagtctggtaactataactaggcatcaaaattcaaaatggtgtatcaatgagcgagagccttcttatttttgatgttagcaagcgacntaagtcgcttgcgtttaacttaaagaagaaaaatgaatcggcttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccacggaatacaccgcctaatcccgcaatgcgagttccttgaatatcaactatgcgattgtgtaaattgcgtgattgccacttagaaccccaaattgcattaaaagcactaatggttttgctatcatgatttccatgaataaaccaaatatcacaatgttgcgcaagtttatccaactcatctgctgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggagattcaatctctatataaggaactttatatttatctaacagttttttgagtagttgctgaaattgttggcgttgtttttgtgagcctaagctgcgcaagccatcatccacccattcagtattatttttaagtaaaatagggacatcgaaggatattctttaatcattgagtctaaaaaggatgagcttttccttcatattgaatgcagaacgcttgcgtggtaatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggttgcggacacattaaagaaagtgcggtcaggatcgactaacgatacttctaaacctaagtatttctcgtaaggcgctttatcttgaggctcgctactaaatacgattgaaggttcaaaatgtttttcatgaaatagggttttaactgcttcactccaagattgccagccgtttggataacttggaataccgtcttcaatcaaatgatgaataaaaatctgatttttttgatatttgaaaatttgctgcatccaacgcaaacgatcttgcacggttggcatgcgtttcattttactatcgtaaaataatttcaaatcgcgcaccgtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatggaaatatttttcacgttctgatttagtgcctaggtattttgcgttatacttagctcgcattctcagggcagggtgaaattccctaccgggggtaaagcccacgagcgtttaaaagtgcggtcaatttttgccaaatttttcctgcgaaattgtcctgattttcacttttaaagtcagcagatttggtgaaattccaaagccgacagtaaagtctggatgaaagagaatataacgagttcgggtcccaaaacgttcattttatctgcatttctccccctgattttgcctttaattgcaacccccattaccacctccctcttcaatccgcccgttctatctcttttcggaatcccggcttaaaatccgtactttatggcacaattcctttgaaaccccggaatggtgactccgcttttcatgtccgtacatccctctatcgaccctgattcaccctctttccttcatattcctggtgaatcccttgttcctttagtcgccttcgtcggccccgatccgttccttgttcccctgttatttttccccg

SEQ ID NO: 291 - DNA, 2125 bp, H. influenzae
aactgactatccgcgcacgtaatctattgcatcgcacaatgtcgcatcaagaaaagaaaatacatttggtcgagaattctatcgttttaatggttggaaattagacctaaatagccacagtttaattacaccagaaggacaagaattcaaacttcctcgcagtgaatttcgtgcaatgttacatttctgtgaaaatccaggaaaattgcaaacgcgcgaagaattgctgaaaaaaatgacgggacgagagttaaaacctcaggatcgtaccgtagatgtcacaattcgacgtatcagaaaacattttgaagatcatccaaatactccaaatatcattatgactatacatggagaaggctatcgcttttgcggagatattgaatgaagtgatttttctacataaaaattcctttttgaaattcatttcctgttttgttagaattcgcacacttttcaatatctaatggaaagtgagttcggatgaaggtagctggagagcggggaattgaccccacaccgacgatgtaaaatctttcaggtgcgatggcagggactgttactggacgaacccttggagagatccattttagaaatggacgccgaaggcgcaaaagagcggttaatttttcaatcgtttttcaaacgctcaggcaaaaggacaggggcaaaagacaatctattgtaagtgtggaaattattcatttttttaccgcactttcttttcacattgtatcttttcgtcttcttgtcgtgtttatttttgatttaaacgacgaggaatcacaatgacaattgagtcaattctttcagctattgatagctttatttggggcgcacctctacttatattattatctggtacaggactctatttaacgttacgcttaggctttattcaaattcgctacttaccgcgtgcgctaggttatttatttaaaaaagataaaggtggaaaaggagacgtttcctcttttgctgcactttgtactgcattagcagcaacaattggaacgggtaatattgtgggcgttgcaactgcggtacaagcaggtgggccaggggctattttttggatgtggctggttgctttgttaggaatggcaacaaaatatgctgaatgtttactcgctgttaaataccgtgttcgcgataaaaatggctttatggctggcggcccgatgtattacattgaacgcggactaggtatcaaatggctagcaaaattatttgcattatttggtgtgatggtggcctttttcgggatcggcacattcccacaggtcaatgcgattacccatgcaatgcaagatacttttaatattccagttttagttactgcaattattgtgacgcttttagtcggcttaattattcttggcggtgtaaaacgtattgcaaccgcatcatcggtaattgtgccgtttatggcgattttatacgtcacgacttcactggttattatccttttaaatatagaaaaagtaccagatgcgattttattaattattgatagtgcttttgatccgcaagcagcattaggcggtgccgtagggcttactgtgatgaaagcgattcaatcaggcgttgcgcgcggcattttctccaatgaatctggtttaggaagcgcaccaattgcagctgcagcggcacaaactcgtgaacctgtgcgacaaggcttaatttccatgacaggtacattcttagataccatcatcgtctgtacaatgacaggtattgtattggtattaacgggagcgtggaacaatcctgaattagcgggtgctaccgtcacaaactatgcctttgcacaaggcttaggcacatcaattggtgcaacgattgtaacagttggtttattattttttgcattcacgactatcttaggttggtgatactacggggaacgttgctatgcttatctcgtcggaactcctggcgtagaactatatcgtctagcttatattatgttgggctggtttacgggctttcttacacttaaatttaaattgcatttcccccgatattggaaatgagaggatggctttcccacatctatccgcctattggatggccaaagggacctttgaacaacataccttatctccaacgtcaaaatttatccatt

SEQ ID NO: 292 - DNA, 1853 bp, H. influenzae
  misc_feature (1845)..(1845): n is a, c, g, or t
cgggcctcgggtaccccaattacaaccgtattagcaaaaattacggtggtgcagcgcgtgcatttgaccaaattgataacgcaccagaagaaaaagcgcgtggtattaccatcaacacttcacacgttgaatacgatacaccgactcgccactacgcacacgtagactgtccgggacacgccgactatgttaaaaatatgattactggtgcggcacaaatggatggtgctattttagtagtagcagcaacagatggtcctatgccacaaactcgtgaacacatcttattaggtcgccaagtaggtgtaccatacatcatcgtattcttaaacaaatgcgatatggtagatgatgaagagttattagaattagtagaaatggaagtgcgtgaacttctatctcaatatgacttcccaggtgacgacacgccaatcgtacgtggttcagcattacaagcattgaacggcgtagcagaatgggaagaaaaaatcctagaattagcaggtcacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggcgataacatcaagatgacagtaagcttaatccacccaatcgcgatggatcaaggtttacgtttcgcaatccgtgaaggtggccgtacagtaggtgctggcgttgttgcgaaaatcatcaaataattgatgaactcttgaatgtcttaaagataaaagacagaagaagtaaaaagaaaagtgcggagaaaattctccgcatttttttattctatatctgatactttgcttgagtatttactaaattatttgatttttatagtgatagctgtggtaaataattttcagtgattccaacaagttcttctattgatattaattttatcttgctactttgaggtaaaagtgcggtgagatttcttgctaaaatatcttgttttaatatcatgcaattccctttacatttggcaaaataatcaggatattttattgccaataacacaccgtcttgccatagtactaccgcatctttttctgtaatatatgaaaaatagtcatctagttcagttttgggataatctgattgagaaaatgtataaagcataatattccttagaaagtaaacaatttttctgcttgattaagcttttctagcaataaagagcggtcaattttttcacaagataggataagttctctattatctaatttaaatttctgcaaagacgctgtgcagataaagcgttgttctacatcatataaatctaataatttaaaggctctaatgaaatctttttgttgaatgatttcgggttgttggttatcgataagatttaatacgccatcatcgataaaaaatatcccaatatcatgggttcacaaaaagctgtcgcggcaagaatggggtaccgagtccgaattncggaaaca

SEQ ID NO: 293 - DNA, 1450 bp, H. influenzae
aaccgctcaaagacaagccttgagagccgtggattatagaatatccttattttcaaatcaaacttttttctaggctttttgatttgaaaagattaaaatgtgaaccaattttttatcacatctattaatataataaaaaagcaggaacaaatggaatttttaattggattttttactgaatatggttattgggctgttctttttgttttaattatttgtggatttggtgtgccgattccagaagatatcacgttagtttctggcggtgtcattgcggggctttatccagaaaatgtcaattctcatttgatgttgctggttagtatgattggtgtgcttgctggcgattcctgtatgtattggcttggtcgaatttatggcacgaaaattttacgtttccgaccaatacgtagaatcgtaacattacagcgtttaagaattgtgcgtgaaaaattcagtcaatatggcaatcgagtactgtttgttgcacgatttttacccggtttacgtgctccaatttatatggtatcaggtattacacgccgtgtaagttatgttcgttttgttttaatagatttctgtgctgcgattatttctgtacctatttggatttatcttggggaattgggggctaaaaatttagattggctacatacacaaattcaaaaaggtcaaattgtgatttatatatttgttgggttacttgtactattctttttttggaaatggaaaaaatctaaaaaatcaacgcaataatagaataataaacggctaaaaatatttctatttttagccgcactttttaattttcttctttattttcttctttattttctttaaataagcctgatgcaccatccgaataatctctaggctgttcattttgagatttatctgttgcagtaattaactgttgggtgaataaacctttgtgatctttttcgcccagtaaattattggaggaagttgcgtagtggcgataaagtttttgataatcgttaattaaggttttgaataactcagcactttctgcaaaatgtttttcgatttgcgccttttgtgtatcaagctgggttttgactgtttttaattcagcctctgttttagcttgatgttttaccgagcctttggttaaacgcacaataatgtaaccaataaataacccaacaataaaagcgataccaattgctacccaaatttcatttgtccaattttccataatattctcctgtttattcggcttaaaaactaacaagttgcaataataacaatttcaactttccaacgaggatccgctaatttagcttccactgtcgctcgacttggggggctaacatgatcgacccattcatcccagcttgatttaattgacataatcttgcatatctgccaagaaaattgcgcagtaaaaaattgcttttattggagcaatttctgctaacaattataa

SEQ ID NO: 294 - DNA, 1679 bp, H. influenzae
  misc_feature (246)..(246): n is a, c, g, or t
taagtaaggcccaaagattttaccccagcgattggcaatattaaatctaagtatatcagtaagaaattttccaggaaagaatcaatagggtcaataaataccctatggtgaaccccatatcttaacaaatcccctgaagtccagagagagaacgcatcgtataggaggatatcactatttcagatgcccacccctaatatgcaaatggctaaaaaaatgagcccgcttgtattgaagtttgctttntgcccggcttcaatagccaacaatgcagaagcaataaccgccaatccaaatccaaactgcgctgttctagagattttttcttttagaatccaataagacattaacgcagcgaaaacaggaaagagagatgaaagcggtgccgcataatagatcgttaaataatgaatgcttaataaataggcagacattcctattggcccacctaatacgccagataacgcaggttgccaaaaaacgccttgaaaatctaccgcactttttcgccataatgttatgccgataactaataacgagcaaaaatcaattaaaaaaagcaatgaaattattttccctaatgcatcatattcacttaatggcaattcattatataacaatccagataatgcccaaaatacagcggacagtatgccaaagagatagccacgcattatggcaattcctctaacagtttaaatgctgcgtctaagcgttttaatgcataatcgccaaaattctcgccgtgttcttcttttacttttgtccataaaaaccacaatacattttggcaaaagcgatggatttttaaccgtttgtgagcgatttgaaattctgtcttgtgatatttatttgtctgattgcaataggtttctaatagaaaatcagcagcttctttcgataaatgagcttcctcaatgatagtagctatatcaaatagcggatcatttaagcccgaatattcccaatcgataaaaaatagccgatcatcttgtaataacatattttcagggactaaatcattgtggcacggacgtaaaattatctctttattgatttcttcaaattgccaaaatacagctgaaagtttatccattctagaatcagcttgataaaaagcggatttgttttctagcaatgaaaaatattggcgaaactcatcgaatacgctaaatacattacggaaaacaaattcactattgtgtaaacgatataaattattcacaacttgagacaaacaactttgttcgtttaattgtatctggcttaaagtattactattttctaaataacgagtcagttttacgccacttttggcatctaatacgggagtttctacattcaagccagcacgatatgcctgagcattattgaatgcctcatattctcgatttataagtgataaatttacggcattagggatccgtaatacaaacttaactccagaaatattaagtagaacattttgattggtcattcctccaatggaggaaaaaggaatggaatgctgatgaagaaaatgaaatacttcttcaggcttgtagcaagttttaacaaatcctacaatttgattgattgattgattgattgattgattgattgattgaatgaatggatggatggaatgaatgcttaacatttttggataatttttatattaaaattggttggatttaacc

SEQ ID NO: 295 - DNA, 1488 bp, H. influenzae
  misc_feature (1212)..(1212): n is a, c, g, or t
  misc_feature (1225)..(1225): n is a, c, g, or t
  misc_feature (1412)..(1412): n is a, c, g, or t
  misc_feature (1415)..(1415): n is a, c, g, or t
  misc_feature (1438)..(1438): n is a, c, g, or t
  misc_feature (1457)..(1457): n is a, c, g, or t
taaggaaactccctgcattacccgtttcatttggatcaggtaatttactttgacggatatgacagacttcatcaaaaatttgtttagccgtgatagtttttggatcgaagtctacaagcgaaccatattttagaataggctgccaatcttttttaagctttaatccaaccgctgtaatcacgtaaccttgctgataacgatgtttaaaagtactttcacgataaccaaattcacattgttctgtgtcgagtctaaaggtttcattcgtgtttaaattaagtacatccacataatcgcacacatctttaaattcaacgccataagcaccgatattttgaataggcgcagatcctgcacagccaggaattaaagccagattttctaagccataaataccattattaatagaccattccaccaatttatgccaattttcgccgccattgacgtgaagatagtgaaaatttgcatcttgttcgtgcgtaatccccattaaacgatttaaaaccaccacgccattaaaatcatccagaaacagaacattactgccttgacctaaaaaaagtacgggtaaattttctgatttagaattcgcccacacttgttgtagctgttcgatactatgtgcttcaataatttcacgagcattagactgaatgtggaaagtgtgaaaaggttgtaaattttgcattttgatgtcctaatataatgtatgtggcaaggtaattttgacttgtgtgccgccttgttctcggcgatgaatatgcaattgtgcattaagctgacggcaacgttccgccataatattcaagccgtaatgcccttcaggctcctcaaggtttggaatgccaaccccatcatcttcaactaaaatttcatactcgccttccgcattaattcttgcgctaatttcaattaccgtgccttgagaatgtttgatcgcattggtggtggcttcacgtacaatttgcagaacgtgaaccagctgttgagggttcaaactttgcgatggtaattgacaattcacattcatttgcattgttgtttgtgagcgtaatgaatcaatcacttgttttagtgcaagctgtaaattcgcttcttgtatagttaaacggaaagtggctaaaagctcacgtaactgtgcataaccaccagaaagggcttgttcaaaattggcaataattgccaaactcttttcttttgattgttcgncttctttcttcangttatgtttgagcaaagtaagttgaatttgtaaaaatgattagacttgagcccaagaatcgtgcaactctcgcgcattattggagcggtccttcattataaaatctggtctttctgacgaaaatttttatggaaataagcgcacgacagcattgcgctaatttgctatttcggggatctggcactgnaanctgctgccagacataccctaatncttttatcaaaaaggtttngattggaattcttatacccctgctacccagg

SEQ ID NO: 296 - DNA, 2679 bp, H. influenzae
  misc_feature (2307)..(2307): n is a, c, g, or t
agggagagagggtcggcctaccaaaagagcgcaagtgagggagagggagaaatgatggaaccggtagagctgagaggacaattttataaagcgatcattgtacataccaatcgcgtcaatgagaccagcccggagatcctgagattgacgctgtgggtagacgatttgacttttgcccccgcacttttccagtaaagagaaagtgcaactatggtaaaaccgtctcggtttgctttgccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttattcagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgagaaagataaaaagatgaattaagtgttagtgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaataccggcaaaagcccaaggagaaccaccacgttgaatatgccctaaaacggttgcgcgaggtttcgtgacctacgcgagcttcaattttctttgccagagaatgaacatcagttaaaagttcagtgatagcaataatagcgtggcgtttaccgcgaataatgctacgttcaatttgttgaattaattgttcgcgattaaattcaatttctgatgcgacgatatattcacaaccgccagcaatgcccgcagaaatcgttaagtcactacaatggcgacccataatttcaacgatagaaatacgttggtgtgagcttgatgtatcacgtaaacggtcgattgcatccactgcagtttgtaatgcggtttgatagccgatggtatagtcagtacctgcaacatcattatcaatagtaccgggtaagccaacacaagggaaaccgtgttcttcggttaataatttagctcccatataagaaccgtcaccaccgataaccacaagtgcatcaatgccgtgagaacgtaaaatttctgcacattttgcacgaacatttggatctttaaattcaggaaagcgtgcagaacctaaaaaagtaccgccacgattaattacatcagatacgctatagcgatttaattgtttgattttattattgtataaaccttggtaaccatcatagataccaaacacttctaagccttctgcaagtgcagagcgtactacgccacgaattgcggcattcatacccggcgcatcgccaccacttgttaaaactgcaatttttttaatcataatttacctacttttaaccataattgaaaatgggcataagattacatcattcaaagaatctgctctagcaaaatttgacgagattttgatctacattatttttcacaaaacagttgccatttcaaattttgtaaatgttttctttctatatccacaatgtatttttgcaaatgttgttgtactttatcgacagataaatgtttagaatgcgttggttgctgtattttctgcgaatattgaaattgcacaaagccacattggggcaattgtcgtcctttcatcacattgacttgccaagatggattttcctttgttggcgaatagatgacatatccatttaattcatttggattggtcgaattttctggaatagtatcaaaatgaaaatctttcacgtctgtattgcgataaatgcgttctcttaatgcaatacgttctttaatagaacggtcggattgattgcgatcaaagagaatttcaatttcagattgccaattttctagcgtatctggcttagatattacgcatagcgtgcatgggttcctaaatcttggctgccaganagtccataatgttggcccatatattctacctgcggtagcacattttaattgggccagcctaagttgcacagcctgaaagtataagggccgtcaaaaataacaaaattttattctttatatatcccgcttaaggacaaatccaagttcaggggaggaagctggattcaaccatacccccctatccaaatcttttactggtcaatgcgcgttaacgaattgaaaaaaaaacggcccttaatcctccgcttttttacctaaagcaaatactttgatttcccttttattggcaaaaaaccgctgaatattgggctaaaggggttttttcaaattaaatttctcagagctggtgggaaccttttcgcttggccaaaa

SEQ ID NO: 297 - DNA, 1138 bp, H. influenzae
ttgtttttgttgtttaaggctatgccctgcgcttcgcaccaagcggtaatttcttgctcggtttgggctaaaaatccggcgttgtaaatttgttcgccatattgccgataaagatattgcatcggctcaaacaaagccttgtcaaaccgtaaaggcgagatattttcggcggtaaattgggcagaacggcgatccgggcgttcgatggtgactttgtaatagccgaaatcttgattgtcaaaaatctgcgaagccaggccgactgcttcattttggctgtcggtttcgcgcgctttggcagtgaaatcaagatagttttgggtaatttcggcgatatgttcaggtacaaattcgcagtttttatcgccaaggtttttacgcaatttgcggaataagaggctggcatcaatgagctgaactttgcctttgcgtgcttcaggtttgttgttggacagcaaccaaatataagtggtaatacctgtgttataaaacaggttgttaggcagctgtacgatggcttcgagcaaatctttttcaataatatggcgacgaatgttgctttctcctgaacctgcatcgccggtaaacaggcttgagccgttatgcacggaggccactcggctgccgattttgttgtcattcggcgatttcattttgctgaccatttccattaggaatagcagctgtccatcgctggagcgtggggtagcatcaagggtttctacattgccccagtaatctggtaaggtaactttaaagcgactgtcgataacctcattgccgtctttgatataggcttgatctttgctccagcttttgccatatggcgggttggaaagcataaagtcaaagtgattaccttggaagctatctgtagcaagggttgagccgactttgatgttttcgggattatcacctttaatcatcatgtcagatttacaaatggcataggtttcatcattggtttctttaccaaacaaaaagatggaacgctcgccttgtgattcagatagcggatatttttgctcaataaagttttgcgactcggtcagcatgccaccgctgccgcaagctgggtcgtaaatcgtaataatggccggaatttggtatttgagcggatcaaagactaaatgcgtct

SEQ ID NO: 298 - DNA, 1768 bp, H. influenzae
  misc_feature (1739)..(1739): n is a, c, g, or t
gccagcttgctgcctgcagtcgactctataggaccccctataacgtaatttttgccactctcgagcaagcatacgaggcacatccctcattatatccacgagactatcatcattaatattttcctccgtcagcattttttctactttttccgccaacaaaccattaaagggggctgcgataaagccagaaaacgtggtaaaagtaaaataaaagagcaataaaatcgttaaaatcgaaagtgtcagtaaaatgacactgagaaaactaagccaatctggaataaaattcatcacccaatcaatagcactgctgatttggctaataaaaagccaaaataaaccacaaagcaaaatggtattgagcaaaattggaataataacaaaccgacgcaaacctttttgtgtgatgaaatgccagcccatcacaaaatagtggaaaccagattttaattcattaagatttaacatttttctttcctttcaataaaaatatgcttaaaacagaccgcacttttcctttaaaattccacactttgaagtattttttcacctactgaaatatggtagcattagcaccatttatagtactctcgccgaactatcgcgcgtaaggaataaaaatggatttaaatacaattttgattattgtgggtatcgtagcacttgtcgccttaatcgtacacggattatggtcaaatcgtcgtgagaaatcaaaatattttgataaagccaataaatttgaccgcacttctccaacatctagatcccatacgcaagaagaaatggtacagccaaacaatatttcgccgaatacctatgtggaaaatgggcatacaccaatttctcaaccgaccacagaaaaattaccatcagaagctgaattgatcgattatcgccaaagcgataaaagtgtggatgacatcaaaatttctattcctaacacgcaacctatttatgatatggggaatcatcgttccgagccaatacaaccaacgcaacctcaatacgatatgccaaccgcaaataatgtcgcaagtatgaccttagaacaacttgaagcacaaagtcaaaatgttggttttaatggcattaattcatcatcgccagaattaagagtgcagcttgcagaattatctcacgaagaacatcaagtagactacaacctctcgttcaatgaaccaaaagcagaaacgacagctcagccaaaacaaacaactggctatattcaactttatcttattccaaaatctagcgaagaatttaatggtgctaaattggtgcaggctcttgaaaacttgggttttatcttgggtaaagatgaaatgtatcatcgtcacttagatttaagtgtggcaagtcccgtgctttttagtgtggcaaatttagaacaacccggcacattcaatgcttataacttagcggaatttaacaccataggaattgtattatttatgcaattgccctctccaggtaataatcttgctaatttacgtatgatgatgcgtgctgcccatacattagccgaagatttacaaggtgttatactgactgaagaacaagaaatttttgatgcaaatgcagagcaagcctatcttgctcgagtgtaaattcataccttaaatttaccgcacttttatattcatttagacaggctttgtacctgtctattttcacgctaaatacatagaaaagtgcggtcatttttctccgagaattttatgacaaatatcggggtctcntagagtcgaccgcaggcagcaagtctggc

SEQ ID NO: 299 - DNA, 1607 bp, H. influenzae
tttaacgccgtatttagaacgaccttgtttacgatctttaacgcctgcacagtctaatgcaccgcgtactgtgtggtaacgcacacccggtaagtctttaacacgaccaccacggattaatacaacactgtgctcttgaaggttgtgaccttcaccaccaatataagaagttacttcaaaaccgttagttaagcggatacgacatactttacgtaacgctgagtttggttttttaggagttgtagtatatacacgagtacatacaccacgtttctgcgggcaagcctctaatgcaggaacgttgctttttacaacctttttcacacgcggtttgcgtactagctggttgatagttgccattaaaaaagctccagtttaaatgttattcaataatagaatgttgttcaaaaaatctacttccatatagaaatagacggcgaattttaatagttttacgctttattgtcaataattaaacaatatactctaggcttaaaactagattaaaatttaccgcacttttgttttttaataaaaaactttattccccacgttttagcatgccttgttttttcaaattaaccagaataattgaaatagcagcaggcgttatacctgaaattcggctcgcttgtccaatggaaaccggacgatgttgttctaacttcgcacgtacttcattagataatccagacactttactataatcaaaattagcaggaatagccgtattttcatggcgtttttgtttttcaatttcttcttgttgatgctcaatatagccttgatacttaatagcaatttccacttgttctacggcttctctatcttctattgcgggcttgtatggcgttaaagaagtcaaaatatcgtaggtcatttctggacggcgtaataaatcttcaccgctggcttcacgcacaagtggactgccaagcactttattggcttcttctaaatattcagaacgcggatgcagccaaatgctgcgtaagcgctggcgttcttgctcaatcttttccattttttgattaaagcgtgcccagcgagcctcatcaatcaaacctaattcatgggcaattggcgttaaacgaatatctgcattgtcttcacgtaataacaaacggtattcagcacgagaagtgaatacacgatacggttctttcgtaccgagcgtacaaaggtcatcaaccaatactccagtataagattgatcacgacgtggataccatgcctctttctcttgtacataaagacctgcgttaatccccgccaataagccttgtgccgctgcttcttcataaccggttgtaccgttaatttggcctgcgaagaataaacctgaaatagcttttgtttctaacgttggttttaaatcacgtggatcaaaataatcatattcaatggcataacccggtttaatgatgcgagctttttccaaacctttcatggaattcacaatgcccatttgtacgtcaaacggcaaactggtagaaatcccatttggatacacttcgttactggttaatccttctggttccaaatagatttgatgtgaattacgatccgcaaaacgcatcactttatcttcaatagatgggcaataa

SEQ ID NO: 300 - DNA, 1459 bp, H. influenzae
tgttatcgaaatcggactcggtacccctttacaaatttgttcattagatttctcctaaagagttttttatttagttaagtatggagaccaagctggaaatttaacttgaccatcacttcctggaagctcgccttatagcgaccatctgcagaaaccaattgtagcacctttcctaagccctgtgtagaactataaataatcataattcccatttggagagaggctgggacttttcgcctagaaaagatgtactaagtacctctgaaacgcccgttgtgagatcttgttaaactacattattgttaccattaatcatcacaagtgtttttccatctgcactaatttgcgcgctgccgcgaccacccactgctgttgcactacctccgcttgcatccattcgataaacttgtggcgaaccacttctatcggatgtaaataaaattgaatttccgtctggcgaccacgctggttcagtattattacccgcaccactcgtcaattgagtaggtgtaccgccatttgctcccataacgtaaatattcagaacaccatcacgagaagaagcaaaagctaaacgagaaccatctggcgaaaaggctggtgcgccattatgcccttgaaaagatgccactactttacgtgcgccagaatttaaatcctgtacaacaagttgtgattttttattttcaaacgatacataagccaaacgctggccgtctggagaccaagctggagacataattggttgggcactacgattgacgataaattgattatagccatcataatctgctacacgaacttcataaggttgcgaaccgccatttttttgcacaacataagcgatacgagttctaaaggcaccacggatcgcagttaatttttcaaaaacttcatcactcacagtatgcgctccatagcgtaaccatttatttgtcactgtatagctattttgcattaatacagcccctggcgtacctgatgcaccaaccgtatcaattaattgataagtaatactataaccattacccgatggaaccacttgtccaattacaattgcgtcaattccaatattcgaccaagcctcaggatttacctctgctgctgaagttgggcgttgaggcatttgagacaccgcaataggattaaacttaccactgttacgtaaatcatctgcaactattttgctaatatcttctggtgcagaaccaacaaatggcacgacagcaatagggcgcgcaccatcaaccccttcatcaatgacaatgcgtacttcatcgccagcgaatgcattgctttcaacagcaagtacaatcgcaaatacgctcactaaacggtttaataatttcattttgttaccttttaaaattaacattaaatctttctacagaatatcgaaaatttaagccataaattggggattataacccccatacattttttcggggtgcatcttgat

SEQ ID NO: 301 - DNA, 1526 bp, H. influenzae
  misc_feature (1470)..(1470): n is a, c, g, or t
tctttaattactgaaaccactaattatgtgcttcggattatatgcgtaatgcgaatgaacgccgtggcaatattgaggctgcattagaatctcgtcgcgagtggtataaagcaaaagcagagcagaatttatctcaacatcgtttagttgatttaagtcgagaagcggctgaattggcagaaaatgaacgtactttagaagttgatcaccaaagtgcggttgatcatcttaacttagtgttaaacgctttgcgtcaccaagaaaaaatcacgcgctatcaagaagatattgcagaactcaccgagcgtttagaagaacaaaaaatagtggttgaagatgcgaatgatgcgttagaagaaagccaagcccaatttgagcaaactgaaattgaaattgacgctgtacgagcgcaattagcagattatcaacaagcattagatgcccaacaaactcgcgcacttcaatatcaacaagccattactgcactcgaaaaggctaaaaccttgtgtggcttagctgatttaagtgttaaaaatgtagaagattatcacgcagaatttgaagcccatgctgaaagtttaacggaaactgtgcttgaacttgagcacaaaatgtctatttctgaagcggcaaaatctcagttcgataaagcgtaccaattagtatgcaaaattgccggcgaaattccacgctcgagcgcgtgggaaagtgcgaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgcagagcaagaagcgttgattgaagatatttcagcaagactttcagaacaagtggaaaaccgttctacgcttcgtcaaaaacgtgaaaatttaaccgcactttatgatgaaaatgcgcgtaaagcaccagcatggctgacagctcaagctgcattagaacgtttagagcaacaaagtggcgagacgtttgaacatagccaagatgtgatgaactttatgcaatcacaacttgtgaaagaacgtgaactcacgatgcaacgtgatcaacttgaacaaaaacgtttgcaattagatgagcaaatttctcgtttaagtcagccagatggttcagaagatccgcgtttaaatatgctggcagaacgttttggtggtgtactgctttcagagctttacgatgacgtaaccattgaagatgcgccttatttctccgcactttacggacctgcacgtcatgctattgttgtgcgtgatctcaatgcagtgcgtgaacaacttgcgcaattagaagattgccctgatgatttatatttaattgaaggcgatcctaccgcatttgacgacagcgtattgnccgcacaagaacggggtcctcctagagtcgaacctgcaggccagcaaagtcaaggc

SEQ ID NO: 302 - DNA, 1621 bp, H. influenzae
ctgttaaattccatacaacaaaaaaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataattcatattgatttacttattttaaagcccttatttataagggctttttatttatcaaggattattctgtaaaaaatatgttaaataccttaacctggagatactgccctgccttatttctatcggataggattccgtagaaccacccaacaattggcattataaggacccaaatggatcccctccgattatccccccatgaaggcgctttctccggagattgggctccccttgttaacaccccttcgcgtaatgcaacaccgcggggagccggcgtaggtgattttccccgtcacccctctc

SEQ ID NO: 303 - DNA, 2437 bp, H. influenzae
  misc_feature (2252)..(2252): n is a, c, g, or t
  misc_feature (2300)..(2300): n is a, c, g, or t
catcctcgtgtacaaaagaagcggtatgaataattcaccaaaagtagcacaagtaatgaattagatcttccaaacctaaagagcgtgctgcgagaactgcgatcaacgggcggatccgcttaccaccaccttgaacaatataaaaacctaactgtcctattagcggtacatctgaattaagctgagcaagaatattttgattaactttttgcatatctggatctgctagtatctggatctcgtctatgctcataagatcttgtttcttcatttttcatcatttatcagtcaaaagtgcggtgcattttacccgaattttcagactttctgaaatcaatccgcaaatgaagggaatttttttattttattataaataaattcttgccataggtaggatttttccgtagaatttgcgacctatttatgtgaatttttaagtgtggactgctaaaaagcaggaaaacacaattaagcggagtatttatgtacgcagttttccaaagtggcggtaaacaacaccgtgtgagcgaaggtcaagttgttcgtttagaaaaacttgaacttgcaactggcgcaacagttgagttcgattctgtgttgatggtcgttaatggtgaagatgttaaaattggtgcaccagtagttgctggcgcaaaagtagtggctgaagtaattgcacaaggtcgtggcgagaaagttaaaatcgttaaattccgtcgtcgcaaacacagccgtaaacaacaaggtcatcgtcagtggttcacagaagtgaaaatcactgggattcaagcataatttcagaggagatcaagtagatggcaactaaaaaagctggtggttcaactcgtaacggtcgcgattctgaagctaaacgccttggtgttaaacgtttcggtggcgaatctgtattagcaggtagcattattgttcgccaacgtggtactaaattccacgcaggtaacaacgtaggaatgggaagagatcacaccttattcgcaactgcagatggcacagccccactcgaagtaaaaggcgagaaaagccgtatattcgtaagtattgttactgaataatttaaatctattccattgaaacgccctaaattttgtggggcgttttgtctttttaatttcacataagcgagcaagcaatgaaacaacaacctttattaggctttacctttgcgcttattaccgctatggcttgggggtcattgcctattgccttgaaacaagttttgtctgtaatgaatgcgcaaactatcgtatggtatcgtttcattattgctgcagtttcattattggctttacttgcttataaaaaacaattacctgaattaatgaaagttcgccaatatgcgtggattatgcttattggagtaattggtcttactggcaattttctattatttagtagctcgctgaattacattgaaccgtcagttgcacaaatttttattcatttatcctcttttggaatgctcatctgtggtgtactgattttcaaagaaaaattagggttgcaccaaaagatcgggcttttcttattgttaattggtctaagtttattctttaataatcgttttgctgtattttctggactaaatcagtattcaacaggtgtcattttaagtatagggggcgctcttatttgggtcgcttatggaatggcgcaaaaattaatgttacgtaaatttaattcacaacaaatcttgctaatgatgtatttaggttgtgccatagtctttatgccgatggctgaattctcgcaagtgcaagaactcacacctttagctctgatttgttttatttactgctgtttaaataccttaattggatacggctcttatgcggaggcacttaatcgttgggatgtatcaaaagtcagtgttgttatcacacttgtacctcttttcacgatcctattttcacatattgcccattattttagcccagtagattttgcagcaccagaattgaataatattagctatattggcgcatttgttgtagtatgcggggcaattttatccgcgattggacataaattattaccgcataaaaatcattaaagtgcggtttattttggagaagttttaatgaaatttattgatgaatcccttattcgaattgaggctggggatggtggtaacggttgcgtaagtttccgtcgagagaaatttattccgaaaggcggccctgatggtggcgacggtggcgatggtggcgatgtctatttacaagccgatgaanacctcaataccttaatcgattatcgctttaataaacgctttgccgcanagcgtggagagaatggacggagttcatattgtacaggacgtcgcgggtaagatattatttaccttgtcccggggaactcgggctattgtaacgaccccaagaaccttggggattaacccacctggcaaaaaaggtgc

SEQ ID NO: 304 - DNA, 1380 bp, H. influenzae
tggtatagaatatcgactcggtaccccacaggtttattatggcgaatttgccagatattttagtttatgctcgagtaggaaatggcatggtaagccgccgtcgtggcgtcaatcaagctaaagcagaaatggcgtttgttcaaattgaaataccgtttgggaattcagggtttgttatctggattatttacttttgcattgcgttttggttctcgtttattgccaacctcgttattgaaaaaactttatcaaacttttttacgtaaataggaaatacgatgaaattaaatattttatttaaaattttgtttgatttgaggttattttagttcagaaaacaataaatataagtattgaatttacgtattatatctctgaattatcccagcgtcgctaatataatttgctcttgatcaatgtgaatccaaacctgttgcccgatttgccattgatttggctggtggaccgtggcacaaaattcaatgttgctttcagcaaattgaaggatggcttcctcttcattgagtgatttgatatttacagagaactgattcggttgatttactaatggttgttcactgatttttacccaaggtgccttgaacatcagcatcacttctttttccgtaatcagtttcaaacgagccgagctttttgtggtaatagaaacttgcaacggcgttggtaatccttgcacattcacatccacaacgcaacgagagtcaatgattcgttgttgtgccactcgcccaaaaaattgattgcgtgcgctactttgtaaagaaaaacgtgcggttgccgtgagtaaactatctaacggtacggattcatcttgtagaatatgaaacgcgtgttcttgcgtacgttctaataaatcataaagctggagcaaacgctcggcataagtggtaagcaccgtgcctccgccattttttccacctgtatttcgttccagcaatgggcgagggctgattttattcatggcttctaaatgatcccacgcacttttatagctcacttttgcatttttcgctgcttgattaatcgaaccgcattgttgaatttctttgagtaaacgaactcgttttggatcgataaaaagtgcttgttgaagtttaatcgtgagtaaaatttcggtgtttttcattttgctgtccctaagtaatcctaagtggtaagcctaagcgttatatattttactaaataatttttcttttgctatatgattgttatttatttcaatatataatcaagtaaataacgtttaatcataggagattattcatgaaaaaattaactaaaatttcaaccgcacttttaatcgcgggattaggctttttttttgcggcatccgctaaagtgactgtatttgcagccgct

SEQ ID NO: 305 - DNA, 2482 bp, H. influenzae
aatcgcagagcgtgaattgcacgacagaatgaatgattatgacccagattaatggaggggcgagatgacaaaccaagtccaacatcaacaaaataaacagccacctgcacttaaaacattttttgaaagtgcgaatgtgcaaaataagattaaggaacttgttggcaaaaatgcggcaacctttgcaacaagtgttatgcaaattgccaatagcaatgcaatgcttaaaacagcagacccaatgagcatttttaacgccgcttgtatggcagcgacattgaatttgccactacaaaatggcttaggctttgcctacatcgtccctttcagaaacaacaaggaaaagaaaaccgaagcgcaattccaaattggctataaaggctttatccaactggcacagcgtagtgggcaatttaaacgcttagtcgcattgcctgtgtacaaaaagcaacttatcaaaaaagatttcatcaatggttttgagttcgactgggagcaagagcctgaacaaaacgaaaatccaatcggctattacgcctattttaaactggtaaacgatttttcggctgaactctatatgagtcacgatgacatcgtcaaacacgctcaacgctacagccaaacattcaaaaaaggctatggcgtatggcacgataacttcgaggcaatggcattaaaaactgtaactaagttattgctatcaaaacaagctccactctctgttgaaatgcaacaagccgtattagccgaccaagccgttgtgaaagatgtagaaaatcaagagttcaactacaccgacaatattcaagaagcggaatttttagcggttgttgatgaagccacattcgaacaatgcaaacaaagcattgctaacggcgaaaccaccctacaagagctttgtgatagtggggcttatgaatttagccaagagcagattgcggagttggaggcgattgagaatggaaatgtaccaactcaaagctaaatgctctggcttggctgatttaatggtaaagcctaaaagcggtaatggaatatctgctacagcaaaaagtgcggtgagaaagatagtgaaatttgatttattcggttatcgagattttgaggggaataaatacaccgagaaaggcattgcactagaagaacaagccattaagttaagcggtcgtaaacgtggattacctcttaaaaagaacacggaaagacgtgaaaacgattggattacaggcgagtgcgatatttatgtgccaagccgaaaattaatcatagatactaaatgttcttgggatattggctcacaccctttttttgctgatgaggcggaagaaaaagccaaaaaagcggggtatgacgcacaaatgcaaggctatatgtggctatgggattgtagtgaggcgcaaattgattttgtcctcctccccaccccttacgaccaattatcaagctatgatgacccaagtcgatacattgacttagttgagcaaatcccccaagaaaaacgtatcaccaccgtcacaattaaacgtgatgagaaagtcatcgagaaaatcaaagaacgagtagaaattgctcaagaatattatcaacaacttatacaggagatgcgctaatggcacgtaataccaacaccgtgatattagtcggtcatttaggcagtgacccagaaatccgccaattccaaaatggtgggcaaattgccacatttaatctcgctatcggtgatgattaccgagataaacaaggtaatacagttaaacgtacgcattggatacctattgtggtgcatggcaattctgctgatgtagcaagacaatatctgcaaaaaggctcaaaaatctgtgtaacagggaaactggtacaggaaagctggcaagaccaaaacggcaataaccgcaccgcacttaaagtagcgacacaatcctttgaaatgctagacagcaaggcaaacaatgaaacacaacagccaagcaaagacaaagaaaaacccgacccattaagcgcagcggcagaacaagatgggtttgatgatgatattccgttttgagttacaccacaagccactaaccaatagtggcttttttattatctaaatttgagaggcaaaaatggctgaagaaaacaaagaaattatagcttataaagggtttaagcaagactggacttgtcgaggttatcagtatgaggtaggcaaaacgtatgagcataaaggtaatgttaaggcttgtgagagtggattccacgcctgcgaatacccgcttgatgtgcttagctattacagtccagcggtaagtaaatttgctgtagttaaaatgagcggcgaaacatcaaaagatagtgatgatacaaaattgcatctgcaaaatcacgatcgaaaccgaaattaacttaccggaaatgataaaaaaagccgttgaatggataaaagtaaaagtgaatgtgatgcagcccaggtttcattaagggcgattgggcggagcaaccc

SEQ ID NO: 306 - DNA, 2025 bp, H. influenzae
  misc_feature (1164)..(1164): n is a, c, g, or t
  misc_feature (1829)..(1829): n is a, c, g, or t
  misc_feature (1980)..(1980): n is a, c, g, or t
  misc_feature (2010)..(2010): n is a, c, g, or t
aagcgcttatcgcttgtcttgctccaaaccgtcgtgtagaaatcgcggtaaacggtactaaataattttagtatttgtttaacgaaagattaaatacagaaaaaggcttaaacttcggtttaggccttttgttttaaatgaatataaaaccaagcatttcaatcaagttttaacttgtgataaaatgcttacctcgtttatttatagggaacattatggaaaccttagacaaaatcaaaaagcaaattagtgaaaatcccattcttatttatatgaaaggttcgccaaaattaccatcttgtggtttttctgctcgtgcatctgaggcattaatgcactgcaaagtgccttttggttatgtggatattttgcaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaatcacagtggaaaaataaaacccgcaataagcgggttttttatataatatgtttccctttcattattaaataatagattaagcaaactttaataccttagaaagtgcggtgaaaaatttatcgttttcttcaggtaaaccaatacttatacgtaaatgatttggcatgccataaccagcaattgggcgaacgattacgccttctcgtaacaacgcatcataaattggtgcggcaggttgtttgaaatcaatggttataaaatttcctttagagggaatataatccaattgatttttttgacaaaagtcttcataacgtcgcatttctattcgattattttcagcgactttttcaataaattcatcgtcattcattacggcaactgcagcggttaatgccaaagaattacagttaaatggctgtctaactcgatttaataaatctgcgatttctggattagataccgcataaccaatgcgtaagcctgccaagccataggctttagaaagagtgcgtgaaataattaaatttgaatatttttttaataaactgaaagagtccactcgttcttcagatctagtaaattctgtgtaggcttcatctaataccacgattacattttcggngacttttgctaaaaaatcttcaatttcttgtgatgttaaaaaattacccgttggattattgggattagcaatgtaaatgagctttgttttatcagaaagtgcggttaaaaatccttgtaaatcgtgtccccaatttttagctggaatttcttttgcaattgcatttatcgctttagtcactaaaggataaacaataaaagcatattgtgaataaatgatttcatcgccttccgttgcgaaagtgtgagcaaaaagttctaataaatcatttgagccattaccgagtgtaatttgatttggttgaacgccaaatttttttgcgatagtttgttttagttcaaagccattcgcatctggataacgagtcagtttatctaattgttcgaaaattgctttttttgcactttctggaaaaccaaatgggttttcgtttgaggcaagtttaacgatattggaaataccaatttctcgttctaattcttcaatcggtttaccagcttggtaaggtgataaggattttacgccacgattggcaatgttaatgtactgcatagtgttatttgtaaatattgatatgggttagtatgtatttttaaataaatttgggcgtagtaaatacgcccattggaaatatttttcctattgaggaagattttcagcttcanattttttcataaatgaaatgagtgcctcaacaccattttgcgacattgcattataaatagatgcgcgcattccaccctaaaccttatgaccctttcaaggcttgcaaacccgtagcagtagattctgcgacaaattttgcatctaattcangattacctgtgatgaaagtgacattcatgntgaacgtttttcttt

SEQ ID NO: 307 - DNA, 1803 bp, H. influenzae
  misc_feature (1443)..(1443): n is a, c, g, or t
atcccctctactgcagttcaagttactactggttctaaaaaagcgaatcgtgtaactaaacctgaagcaggtcatttcgtgaaagcaggtgttgaagctggtcgcggtttatgggaatttcgtactgaaggtgaagaattcactttaggtcaagaaatcaatgtagacatcttcgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagcataagtctaggagatagagatggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcgcaaaaaactcgtgctgaagtgtctggttcgggtaaaaaaccttggcgtcaaaaaggtacaggtcgtgctcgtgctggtgatattaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaaaactaaagttttagtacaaaaattaaaagatttagccgttgaagatgcgttaattatcacagcaagtttagatgaaaatctattcttagccgcacgtaacttatataaagttgatgtacgtgatgttcaaggtatcgatccatttttcttaatcgctttcgataaagtgattgttactgttgatgctgtgaaacaaattgaggagatcctagcatgagtcaagaacgtttgctaagtgtgctacgtgcaccgcacatctctgaaaaagcaactaacaatgctgaaaaatctagcactgttgtacttatagttgctttagatgcgaccaaagctgaaattgctgctgcggctgctcaattatttgaagtaaaagtagattcagtccgtactgaggttgttaaagggaaaactaaacgccgcggaaacaaattgggtcgccgcaccgactgggaaaaagcttatgtaactttagccgaaggccaaaacttggacttcgtggacagtgcacagtcatcggaggagattagagaatggctatcgntaaatggaagccgacctccgctggtcgccgtcacgttgttaaaatcgggaacccctgtttacacaggggttaaccttacgcacctctgctaatactaaatctcaaatggggggcgaacaactatggtcgtattactactcggcacattgggggcgggtcccaacagcactcccgtttatatgattcagaccgtacaagtacgcattccagcggtgggtgggcggtaaaaaaagaacccacccgtcggcaaccctgtttaagggcttaaaagaggggcacgccgtatattttaccctaagggttgccgggggcgatcagtcctacgcggtcactacccatgagagggggccttctaccagc

SEQ ID NO: 308 - DNA, 1326 bp, H. influenzae
attcccctcatcttgaatgtttgatacgcaattaattacagaaaaactttgtgatgggaacgaataattttcctttgatggctattcctttctttatgcttactggagaaaataatgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggcaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatttttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcggattttttcctggaattggaaattgttccaatggattggttatcttgattattaagggaagttgcctcatgaaaaaattaccttttatcgggagtgtatggagggacttcgtgggaaccccttgtcggcaatgtggccaaattttggtgggggatacctctaattcgtcgatttatgttaggcgaggc

SEQ ID NO: 309 - DNA, 1366 bp, H. influenzae
cgaattacgcaatatgtcaattttaatgatcgcgcttggcacgcaggcgtatctaattttcaaggacgagaaaaatgtaatgattttgccattggaattgagctggaggggagtaatgaacagccttttaccgacgctcaatatttttcattgcaagagcttactaacgtaataatgaaaagttacccgaagattacaaaagatcgaattgttggacattgcgatatttcgccaggacgtaagatcgatcctggtcaatattttgattgggaacgttatttatccagtgtaaaacaaactgtataaaaattaaacatcaaattttgatgtattctgtgtattataaatgcgttcactcttttaattctaactagttgaattaaaaggaataaatttaaatctgaaattttattaaaaaagttaatttgagttatacaacattatagattttctcaaccacaattttatccacagaaatattgaataactcaaagagatgataaaaagatcttttgtgaataaaactgttttaaaaattgtatttttttaccgcactttcttccattttgaatgtgaaaagtgcggtttatttttgtttaagatcttttggttgtaaataactcaatttattttgaagtttgatgtgataaggatctttgcctgtttttacgagatcaattcacaatcagaaatccgttattcacaatgttatccacaacataggtacttttcgtcatataaacaaaataagaatattttgttgtctagaagtttcccctctccgtaaaattgtgtatttttaaccgcactttaggttcaaacccaatgtgcagttatttttattgattttcctcttttcgctttttgctcttttttttaaaatatgatactttttcgccgtcaataagacatcaaacacaaatcaatatgaacgacgaacagcaaaattcaaaccaacctgaaaatacgaaaaaaccttttttccaatctttattcggtcgcttttttcaaggcgaattaaaaaatcgtgaagaacttgtggaagtgattcgcgattcagaacaaaacgatctaattgatcaaaatacgcgtgaaatgattgaaggcgtgatggaaattgcggaacttcgtgttcgtgatattatgattcctcgttcacaaattatttttattggaagatcaacaagatttaaatacttgtttaaacacaattattgaatccgcacattctcgttttcctgtgattgccgatgccgatgaccgcgataataatcgtgggcattttgcacgcaaaagattattaaatttttacgtgaagatgccgaagcatttgattaatcttcttattgccccccgccggattgga

SEQ ID NO: 310 - DNA, 1400 bp, H. influenzae
tggttacgatatcggctcggtaccctggttttcacgaacttgccgatgcgcaagacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgcttaaaggtaaaagtgcggtaaaaattgttatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtgactaaagcgtatccttttccgcgtaaagttttaaaccaagagggcttgttttttcgttctggtaatttgcgtcttaaattagagatgtgcatatcaagagaacggtcaaatggagtgagtggtttttccatcacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgcggtattatttgaaggagatacactacgacgcaaaatcgccttaattcttgcaataagctcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgcggtgaaaataaaaagattatttccagaatttccaccagcttgattttggtttctcacctgtttcaataatggtgttattttcgcccttgttgtgaaacctgtggtaaaggttttcaagatggggttttctgggtaccgaaggcccgaattac

SEQ ID NO: 311 - DNA, 1544 bp, H. influenzae
tgttttcgaattcggactcggtacccggcccctctggcggcgatatccatacagggcgtgcaaatgcaattaaagtgttagcgcgagtattagcaaaactttctcaaaatcaaccgcactttgctctctctgatattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagcactcaaacggttattaacgcactcaacgtattaccaaatggcgtaatccgcaatagtgatgtagttaaaaatgttgtagaaagttcattaagcgttggcgtattgaaaacagaaggtaatgttgtaaaaagcactattttagttcgttcattaattgaaagcggtaaatattacgtaactgaaatgctcagctcacttgcaatcttagcaaatgcaaaagtcgagttttctgcaccttatccgggctggcaacctgtaaatgactcaactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatccgaaatgctcactcaccagatgaaaaagtggaaatcgcaacagtacaaacctattgggatttattgacaagagtacttgccgatattcctgcgaagtaatctaatattaattaaaagtgcggttaaaatttcttttgttttaaccgctcttttatttttttcgtttcgctcttgggtgcgcctgatcgtacacttctgctagatgttggaaatttaagtgagtataaatttgtgtggtggaaaggttgctatgcccaagcaattcttgcacggcgcgtaaatcagaactggcttccaacatatgcgtcgcaaaagaatgacgtaatttgtgcggattaagatggctatttaagccttgacgaataccccaagtttctaaacgtttttgaatggctcgatgagaaatacgatttccaagctggctaacaaataatgcctcatcttttgggttaaataatgcccgcacttttaaccattcttgaatagcatgcgaagcataacgtccaaacggcacaactcgttctttgttaccttttccaataacgcgtacttcccgcacacgggtattaatgctgtttaaatctaagccttgtaattcagataaacgcaaacctgaactatacattaattccaaaatagcacgatcacgaatatcaataggttctttgctatcgttggcaagcaattgttgaatttgctcgccatccatatttttcggtaaatgccagcctgtttcggtgcagaaatgcctgtggcaggatttacttttaattcgccttgttgcactaaaaaactgag

SEQ ID NO: 312 - DNA, 3226 bp, H. influenzae
  misc_feature (3219)..(3219): n is a, c, g, or t
  misc_feature (3223)..(3223): n is a, c, g, or t
ggaattcggctcggtaccccgaacaatattaccgctcggcggtaatgtattcccataaagcaacggaagaatacccagaaattgccttaatgagctattccttcacattctatccggggtcagaaacgtggaacttgaaaaaacttgctggcgtatcttattcgccgttaatggaaggcgaatacttagcttgctcgaagaaaaacgcaacgacatttgagaaatttaacgatagctttgcggtaacgcaaggcggcaaagtcgcagctggggaatggatcgatattatccgtttccgtgattggttggtgcaggaagtgcaaattaatgtgacatccgtcttaatcaatgcttacggtaaagtgccttacaccgataaaggtattcaattaattggtgcagcagtgcgtcaggcgttagatttaggtgtagcacgtggcggtattgcgccgacagaattggatgataataacaaggaaattccaagttatgtgatttcccttccactggcggcaaaggtatcgaataacaataaaggtaagcgtttattgcaagatgtgaaatttacggcacgtttagccggtgctattcacttgacagaaatcaagggcaatctggcttacagtctttaatcattaaccgaccgctaaagtgcggtcattttttaggagaattttatggctttagcaacttatgcgcccgatgaagtaagcattgtgatcggggcgagtattgtttctggctttgcagatggaacctttattgatattgaagaaatgtctgacggcgtatcatctgttgctggtgcagatggcgaagtagcacgtgcaaccagtgccgatccacgtaaaaaagtcacattaacgttattacaaaccagtgataccaatgatgtgttaagtgaactctatgcagcggataaagtgagtaaaaacgcaacctttccaattgcggtaaaagacttgcgtggtcgctcattattcgctgcaagcacggcgtggggtggttaaatcggcgaaacttgagcttggaaaagaagtgggttctcgcgagtggacgcttgaaactgcggacggtaaattatttgtagggggaaatgactgatggcacgcagtgaaattcaaattggcgaaagcactttttttgtgcaaaagttttcggtaatggatcagttacgcatttttggcgatttgcagaaaacccttgtaccgtcactggcgaaagtaatcggatttagcgatgaaaaaccgaaagatgcaacgtcagctcagttagccgaattagcacagaaaagtgcggcgaattttgcgcaaggtttacaagatttaagccagcaattaagcggccaagagttagttaaactagctgatatgctaatcaaacctgaactagtgacggtgcagcgtgatgatttcaacaatgggacagataaaaaacttagcaaaactgattttgatttggtgtttgatgatatgtcggagcttatcgagttggtaattttcatcttacaacttaatttcagcagtttttttacgaaatttcttgcccgtcttgggtcggtgcaagagcttgtgaagaaagcgtaagcgttggtaaatacagcgaacagacgctaagtgagatgatcgcttggcgtccttttttagccggtaaagttacactaacagagcttaatacggcaggattgacggatatgggcgagcttttgaagattaatcgcttactagatgcggtagatgcgatggaagcaaaacaaatggagaaaaaccgatgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattttgttgggctaatggtgctgggcggtatntttnccg

SEQ ID NO: 313 - DNA, 1955 bp, H. influenzae
gagacccctcagtttcgattaaatacataaattttttaattgctgtctgatttggtttaagccgtttaaacgcatttcacttaaacgttgtgaaatgccgagttcgctaaaaaaggcaataatatcaaatgtattcaattcatccgctgttttgccattgatttgattgaataaaatccaaagcaagccattcataattctggcttcgctaaatccgctgaattgaaaagtgcggtcatgtttaggcataatttgaaaccacatttgtgcttcgcagccagtaataggttgcatttgagcgagttcattatcgcttgggcgaggtaaatttttgcctgcttgaataatcaggcgatagcgatcttcccaatttttagcttgttttaattgttctatcattgtaataaatccagtgctttatctaaggcggtaaagaatgcctctacatctttttgcgtattataaggcgcaaaagaaagacgcaatgtggtgcgttcgcctaagcgtgctaaataaggctgggcgcaatgttcgcccacacgaagcgcaatattttgttcgctcaaaagtgtagaaagatcagaacagtcaatgccgtcaaatacaaagcaaacgacagtgcttgcttgaggagaattgaataatcggcaattctcgtaagattttaaccgcactttgacggattcagccaaggatatagcgtactgttctgctgcggtaaaatcccatttttgtagccaatccagcacagcattaaagccaataaccccagcaatattgggtgtgccagcttctaaacgataaggcaattcggcaaaagtaatacgattatttgacacacgttcaaccatttttccgccaaaaaagagcggttgaagttgagaaagtgcggtcaattttcctgttaaaacgccaagtccatttgggccataaattttatgggcagaaaatgcgaggaaatcggcatctaaatcttgtaaatcaattttaatatgactaatcgcttgtgctgcatccactaaaaccaacgcatgactatgttttctaataagttgaatcaggcgtttaatcggctgttctgtgcccgtgacatttgaaacaaaattcagcgcaacgagttttgttttttcagaaagggtagaaataagcacattttcatcaattagccaattatctaaaatcggtaaaactcgaatttttgcaccgcactttttcgccgtttcatgccaagtgacaaaattggcatgatgatctgcttggctaatcagaatttcatcttcggcgtttaattgcggcagcaatccatttgccactaagtttattgcgtgagttgtacccgaagtccaaataacagcgtgtttatcttctgcatgaacccattctttaacctgtgtgcgagcctgttcatattgcacagtttgggcagcatcatattggctgcgatgcaccgaacctgcagacgcataaaattcagcggtgcgatcaattaacacttgaggttttaacgcggtggcggcgttatctaaataaataacagaatcttcacgttggaaatagggaaattcttgacggaacgtttgataatcaaaagccatattaatttttctcttgtctgcgccattgacttggttcaatcggattattatctgcccaaagaccaattcctttggcttgtgcattttcttgcgcttgaagataaatcggatcatgggaatattgtttataagcccatgccataccctgtttaaccatttctaaattaatatttttatcttgataataaacaatcgcgaaagggtcgttgatagcgaatctttccttttagtgaaagacgtacgtttttttgataaaccagatagacagggttttttcgatttttgccaaaggcttgagatttttctgcgcatcaattccggtaaacgaccttaatggattatttgctttaggaggcaggg

SEQ ID NO: 314 - DNA, 2368 bp, H. influenzae
  misc_feature (2340)..(2340): n is a, c, g, or t
ctttttacagtttaactcgctatgatgatctcaattagatcatctttttctatgctataatccctcaaaattttcaaaatcggtacctaaatgaaacaattatttgcaacgacttctcgtggctttgaagaattattaaaagttgaactcactgaacttggtgcgcaagaggcaaaagtggttcaaggtggcgttcattatcaagcagatgacgaaactttataccgcactttactttggtcacgccttgcttcacgcattttatttcctttgattgaaactaaaatttacagtgatttggatctttatgcggctgtttcaggctttaattggttagggctatttgatgaaagagttacattctttgtcgattttaatggaaccaaccaagaaattcgtcatactcaatttggtgcgatgcgcgttaaagatggaattgtcgattactttgaacgtcaaggtaaagctcgtcccgatgtagataaaattcagccggacgtgcgtatccatgcttatttgaatcgtgaaaatttagtgatttctttagatttaagtggggaagcattacatttacgaggctatcgtgaagatgcaggtcaagctcctttacgtgaaactctagctgcggcaattgttctgcgttcaggttggcaagtgggttctccattagtagatccaatgtgtggctctggcacgcttttaattgaggcggcacaaatggaagccaaaattgcaccgcaactttatcgtttacattggggatttgatttttggaaagcgcataatcaatcggcttgggaaaaagtaaaaaatgaagcgattgaattagcagaagaaaaacaacgtgaaattcaaccgcacttttatggatttgacctcgatcaccgcgtattaaaaaaggcgcaaaagaatgcacaaaatgcaggtgtttcacatttaattaaatggcagcaaggtgatgttgcagcgttgaaaaatcctcgtttaaatgaagtcggtacggttatctgtaatccaccttatggggaacgcttaggcacaaccccagcattgatcgcgctctattctgtatttgggcaaagacttaaaaaagaattttgtggttggaatgtttctgtttttagtagcgaatccacattacttgattgtttgagaatgcgtgccagccgacagtttaaagccaaaaatggcccattagattgtgtgcagaagaattatcaagtttcagaacgaaaatctgacgaaattaccgctgaaaatgaactagaatttaaccgcacttcggaggttgcaaccgattttgctaatcgattacaaaaaaatattaagaaaattagtaaatgggcaaagcaacaaggattagacgcttatcgtttatatgatgccgatttgccagaatataatttagccgttgatcgttatgcagattacattgttgtgcaagaatatgcagcaccgaaaaatattgatgaaaataaagcgcgtcagcgtttgttagatgcggttactgcaactttgcacgttacaggtgtagaaacgaataagttgatcctcaaagttcgtcagaaacaaaaaggtactaaccaatatgagaaattagccaataaaggcgaatacttttatgtgaatgaatatggcgcgcagctttgggtaaatttgacagattatttagacacgggcttatttttagatcaccgtttaacaagaaaaatgattggagcgttggcaaaaggtaaagatttcttaaatttatttgcttatactggttctgcaactgttcatgcggcacttggtggcgctaaatcgacaacgaccgttgatatgtccaatacttatcttaattgggcggagcaaaatcttattttgaatgatattgaaggtaaacaacataaattaattcaagcagattgccttcaatggttagaaaaatgtgatcgtcaatttgatttgatatttgtggatccaccgacgttttcaaattctaaacgtatggaagacagttgggatgtgcaacgagatcatgtgaaattaatgcgcaatctaaaacgagttttgtcgaataatggcacaattgttttctcgaataataaacgtggattcaaaatgaatttagttgcgttggaagaattaggtttaagtgcggtagaaatttcgcataaaaccttaccgttagattttgaacgtaataaacaaattcataattgttggatgattcaacatatataatgatttgccaagttgtaaaaatagtcgaaaaaatagtgaattttaaacaaactgaataaaaaactatcgctcaaacatttttttcaaaaagtgctagacaaggttttatgaatncgggtaccgagtccgatatggtatacca

SEQ ID NO: 315 - DNA, 2385 bp, H. influenzae
  misc_feature (2344)..(2344): n is a, c, g, or t
agggggatccccatcaggtaattttacagaaagtgcggaaggcgatttatctgcactaattagtaacagcgtttttccgcttgctttaattcgattgaatagatcaaaaatagctaattcccattcatcatttcctatgacgctttgtaaatcatctaagcataccaattcttgctgttctaaattttcaagaactgcggtagaaaaatattgagatttgctaaggggtacataaatagcagtacgttgattgattaaatattcgttactgaatgctctaagtaaatgggttttaccagagcctttatctccccaaatgtagaaaaacggttgttttaaatcagatgaatttttgcgtaaagaatcaagcaataaaagattattatcgccgtaaaagttttctaatgtggcatcattaatttgatgaatgggtaagggaagctgtttattcaaatgtttatgtagtacagattaagtaagaaagggctaaatgataatttaaccctttgaaatgaggattattctacttcattttttgctttcggtaaaacaaggtttaagatgatagcaacaatcgcacataagctgataccttttagtgatacgttacccacatctacaaacatattgccgataccaaatgtcattacaacagaaataatacatagattacgcgcttcggtaacatcaactttgccacgaattaaggtgctaatgcccacgactgcgattgaaccgaaaacaagcatcataattccacccattacaatcgttggaatggttgataggaatgcgcctacttttccacagaatgaaatcgcaatagcccaaacagcagcccaagtcataatatttgggttaaagttgcgtgttagcatcacagcaccagtaacttccgcataagtcgtattaggcggaccgcccactaaagaagctgcagcagtagcgacgccatcgcctaataaagtgcggtgtaatcctggtttttttagaaaatctttacctgtcacagagctaatcgccataataccaccaacgtgttctacggcaggggcaatagcaattggtaacatataaagaatagcttctaggttaaattcaggtgtcgttaatttgggcaaactgaaccaaggtgcatcaataactggttggaaattaattaaacccagaaacaaacacaaaatatagcctacggtaataccgaacattattggaataagtttcatcaatcctttggcaaatacagccacagataaagtggtaagaagcgttaccattgaaactaatactgcgtcgttataagcatagttactggttttacctaatgacatatccaccgcaataggtgcaagccccatgccaatgataataattactggcccaacaccactggtgggaaaaaacgttgtagtgcttctgctccccgtaattttactaacgtactcaaggcgaaataaacaagcccagtaaacgctaaaccgcccatcgtagtcgcaataccccaagtttgaacaccatattgaatgggcgcgataaaggcaaaagatgatgccaagaaaataggcacttgtttgcctgtacaaaattggaaaagtagagtgccaacgcctgctgttaataatgccgtattggaatcaagtcctgtaattaatggtacaagaacaagcgcaccaaatgcgacgaagagcatttgtaggccaacgaaagattgttttaatttgctttgattttccgaaggaaaagaagaagtttggtttgtcatttagtttcaactctctgtttgaattaacttaaaagtgcggtcagtttttcttgtgtttcacgcacggaaaaaagacggcttaaatgccgtcttgttttggggattattttgtcccaaaaattttatcgcccgcgtcaccaagacccggaataatgtaaccttgttcatttaaatggctatcaatagaagcgcagtagagttcaatgtcagggtgcgcagcctcaagagccttaattccttctggtgcagccactaacactaatactttgatatgtttacaaccttttgcttttaaaagatcgagggtggcaatcatagaaccgcctgttgcaagcattggatcgacaacaattgcaagacgttcttctaaatcgctagctaatttttgaaaataagggactggcttaagggtttcttcattacggtagattcccactacactgatacgcgcgcttggtacatgttcaagtacaccatccatcatacctaaaccagcacgtaaaattggcacaaccgttacttttttacctttaattcgatcaatttctacagggccattccaactgggtgatcgttactttntcagtttctaaatcagaagttgcttcatagggttataggct

SEQ ID NO: 316 - DNA, 1721 bp, H. influenzae
ttcaagtgctgatactctacgacgttatcttgtttagtcacaccgatacgacgacaaaattcacgtaacgaagctggtgtataaccacgacggcgtaaacctgaaatggttggcatacgtggatcgttccaaccatccacgatttcatcatttaccaatttcaataatttacgtttagaggttaaagtgccttctaaattcaaacgtgagaattcatattgatgcggtaatggacgttcaatactgatattttccaacacccagtcatataaacgacggttatcttggaattctaatgtacagattgagtgtgtaatacgctcaatcgcatcagagatacagtgcgtgaaatcgtacattgggtaaatacaccatttgtcacctgtttggtgatggctggcaaatttaatacgataaattactggatcacgcatgaccataaatggcgaagccatatcaatttttgcacgtaaacttgctttaccctcggcaaattcgccatttttcattttttcaaataacgctaagttttcttcaatagtgcggtcacgatatgggctgtttttaccaggttcggttaaggtaccacgatattcacgcatttcatctggagaaagctcatcaacataagccaaaccttttttaattaattcagcggcatagccataaagcgcatcgaagtaatcagatgcataacgcggttcgccctcccatttaaaacctaaccattccacatccgctttgatagaatctacatattccacgtcttcttttactggattggtatcgtcaaaacgtaggttacataaaccttggtattcttttgccaagccaaaattcaagcaaatagactttgcgtgaccaatatgcaaataaccattcggctctggcggaaaacgggtatgaacgcttttatgtttacccgaagctaaatcttcatcaataatttgggtaataaaattatgagtgcgggtattttctgcacccaaagatgtctctgtatggctcatcattttctctcgttaaaataaaaaaatattcggctattctatacaaatctaagggaaaataaaggttcatctcctgttcttgccatagaaatactagatttaaataaaagattgtaaaaacttgccataaaaaaccgccacgaaattatcgtggcgatgtataaatgcacaaagtgcggtaagttttttgaatgtttagcttaccaaacccagccagctcccatttgataggaaattttgctgtttttgcctgcattcacggcgataccgctttttaatgtgatgtagtggagggaggcgtatcaactaaagctgcctaattttacgtcatatagataaaatataaaggaaatattgtttttataaataaaaagtgcggtgaaagtctcaaaaatttttaccgcactttattgaaatagagtttacattacaaccacatcaaactgttcttggttataaaactggtactgcttttacttttactcggtttccaataaacatttccacttctggcagtaaaccgtgagattcttcattaataagatattctgaaactgctggcgaggcataaacaacaaattggtcactactgaataaatgatacaccccgataatttcacgcataatttcgtagcaaactgtctcaacagttttcacccgaccacgtccattgacagtttggacattcatcgcataacacgtgtttcaagg

SEQ ID NO: 317 - DNA, 2200 bp, H. influenzae
ccagacttggcatgcctggcaggtcgactcttggagatcccccaagttaagaaaatcaatgcaccaatagaaagcataataatttcaatggtatgtgccattcccattggttttccatcaaaaacaggtcgaatagaaggagctgcacccattaacacgacaagtaaagctccaaataagaataaagaaacagaaattttagctgttttgctcacttctacttctttgactaaagtggtagaagcaaaaatatctgcatattttggatcattcaaacgacgttgatattctggatcatcttttaattctttacccattttattaacaaataagcaagcaaggaaaagtcctagaatagttgaaggaatggttaccattaaaacatcgccaagatgaataccttgtggctcaaggtaagcaaccacagccaccactgctgcagcgattgggcttgctacgatagcaaattgtgatgcaattaccgccattgacattgggcgttcaggacggataccgttttgacggctcacttcagcgataactggcaatacagaatatgccacgtgaccagtacccgctaagagagtgaataaccaagttactgctggcgcaataaacgtaatgtgtttaggattacgacgtaagattttggttgcgattttgatcatgtagtctaaaccgccagctgcttgcattgctgccgcggctgccactacagccataatcataaacataacatcaataggtaaacctgctggtttcaagccaaagccaaaagaaagaatgggcaagacctaaaccaccaaatacacctaaaccgataccacctacacgtgcacccacaaagatacacattaatacgatggccaaattgcaggaggaacattgcagacatactgaccccctaagttaatagaaaaacactttattttatttgttgaaacggcgtgtaatatagcaacaaataggtagagattccataacttggatcaataaataatgttgaaaaattctgttattttccatcagctgaaataaagataatttaatgtattctatattttgaatatttttttgaaagataacccaagtgcggttatacttgagccctattttgacgtacttaatcagtagagaaaacaatgcaagaatttatctcaatggcaacagagtttgctcaaaaacatacgcttttagcagtttcttggtttgcgattttcgtgatggtgatttataccttctacaaaggcgcaacgagtaaatttaaagtaattacgcacaatgaagttattcggttaataaattccgatgaagccattgtggtagatttacgtagtcttgaagaatttcaacgtggacatatcattaatagtattaatgtgcttccaagcgaaattaaaaatcaaaatatcggaaaattagagtcgcataaagagaaagctcttatattagtcgatacaaatggtacttcagcctctgcttctgcagtatttttaaccaaacaaggttttaattctgtatttgtgttgaaagaaggcctttccgcgtgggtagcagcaaatttacctttagttaaaaaacataaataataaggaatagaaaatgtcagaacaaaaacaagacgttgcagcaacagaagaacaacaacccgttctccaaattcaacgtatttatgtgaaagatgtgtcttttgaagctccaaatcttccacatattttccaacaagaatggaaaccaaaacttggttttgatttaagcaccgaaacaacccaagttggcgatgacttatatgaagtggtattaaacatttctgttgaaactacacttgaagatagtggtgatgtcgcatttatttgtgaagtaaaacaagcgggcgtattcactattagcggtttagaagatgttcaaatggcgcattgtttaacctctcaatgcccgaatatgcttttcccttatgcacgtgaattagtgtctaacctagtcaatcgcggtacgttccctgcattaaacttatctccagtaaactttgatgcattgtttgttgaatatatgaatcgccaacaagcagaaaatgcagaagaaaaatctgaggaagaacaaactaaacattaattaaatggtaaaacaaaaggcaagctagaaatgatctgcaccccaaaagctggactaaataacgggtaccgagtccgaatcgtatacc

SEQ ID NO: 318 - DNA, 1413 bp, H. influenzae
cctagtaaagctacacctaacattggcaaagcggctatttctatcggagcctgccaacgtgttacagcctcaataaaaatccaaatagcgacccaaactaatgaaattccattgattaaagctaaccatttttgccattttagacttaaaaataacccaatccatgctaaaaaaatagataaactatcatttgccatatgcccagcatcagccatcaaagtaagggctgttaaaccaatatccccctagaaattcacaccatataaaaggtaataattgcaaaactgatgcctaataccattttatttttagaaatttgactatgagggcaagatgcatgctgctgatattctttaggagtataattttttactagagaaacttctttcattttatttccttaactatttgatttgaaagaagcataaaacctgtagtaactacaaagtcaaatcataaaacttacatttaataaaattaattatttaaaaaaagctaaattatagagatttcaataaaaattcatttttatctgtggataactcataaataatctgtcataaaactgtttttactcacttgataactttgagaaaaaataaagttgttaataactttccattttacacacaagatttttaaagaaaatgatcgcattttcacaagatctttagatcctataacaccagtttccgtaaggatctaataagtttactcacaattacaaaggatcttaatagtaacaataataagatctttatatataaaaaaagagatcttatttactaatacaaacctgatctttcaaaggatcaatagatccattctttttttgtcaggtgttttaaatttctgtagaataacgccaattttttgatccgaataaatagagatagatatgttttacactgaaacttatgatgtgattgtgatcggtggtggccatgcgggtacagaagctgcgcttgcaccagctcgaatgggattaaaaacccttttattaacacataatgtagatactttagggcaaatgtcttgtaatcctgcaattggtgggatcggtaaaggtcatttagtaaaagaagtagatgctatgggtggtttgatggcgcatgctgcagataaagcaggaattcaatttcgtactttaaatagtagtaaaggtccagcagtacgtgctactcgagctcaagctgacagagttttatatcgtcaagctgttcgtacagcattagaaaatcaacctaatttagatattttccaacaagaagcgacagatattctaattgagcaagatcgagttacaggcgttagcacaaaaatgggattaatttttcgtgctaaatcagtggtattaactgcaggtactttcttagccggtaaaatcatatttggtttggaaaattatgaagg

SEQ ID NO: 319 - DNA, 2207 bp, H. influenzae
  misc_feature (2121)..(2121): n is a, c, g, or t
cagtgtttttatcgcccaagcccgtaccaagatacgtgaacattttgttttgctgtcgcacgccaggtacgcaccaagcgacttttgtaatttgaaaatgctgacaggaaacgcatatttggcacgtgtggtccacggcacatatcaatatattctaagtgatgatataacgcaggcgttgcagtacgttcaatgttttcatctaaaattgccattttgtatggctcgccgcgtttttcaaaggtatcacgcgcttcttgccaagtaacacgttttttcacgacgtcataatttgtttttgccaattccaacatacgtttttcgattgcatcaatatcttcttgggttaaagagcgatctaaatctacatcataatagaagccgttttcaatagttggaccaattgccatttttacatctgggaataattgtttaatagcgtgtccgagcaagtgagcgcaagaatggcggataatctctaaaccgtcttcatcttttgcagtaataatttctaacgttgcatcttgctcgataacatcgcacgcatcgcgacgttctccgtttacacggcctgcgatagtggctttagcaagacccgcaccaatatcttgtgcgacttcaagaacagaaacaggacgatcgaattgacgttgggaaccgtcaggtaaagtaataattggcattgttttttccttatacagtggtcacccatacgaaaggtgacgtgttcatttaaaattctatcaaaattaaccgcacttttgccctacttggcttcattcctaccattgaacgagcgaaattaggcaaaaaatgcgtggcgaattctatcactttcttgaagtattgttaaataaatgcccatattttacaaaaaggaaataatgtttttctgactaaaggctttatctcttaaaaataaagactagaataaccgcacttttaactaggtagcaaggaataaaaatgagcaacgtattagtattaaaatctagcatttcaggaaataactcgcaaactaatcaattagctgattatgttatcgaaaaattacaaggtaataacattgtagtacgcgatttatcccaacaacctcttccatattttgataccgcagctgcaattgctgtgcgtggagaaccaaaaacaacagaagaaaaacaacttctggcgttgtctgataaactaatcgaagaattaaaaaacgcacaaacattgataattggtgcgccgatgtataatttaaacgttccaacacaattaaaaagctattttgattttatcgcacgtccgcgcgttactttccaatatacagcaaacggctctgagggtttattaaaaggcaaaaaagccattgtgttatgtgcatttggtggattgtatgatgaagaaaatctagtgacacaatatatgaaatcaattttaggttttattggcatcacagatgtgcaatttgtttatgcacaaggcattggattcgggccagaggcgattgaaaaagcccaagcgtccgcaaaaaataaaattaatgaaattgtagcagccctttaatcctcagataatctaaaaaatataagaaaatgtattaaaaacaaaaaagtgcggtgattttaccgcacttttcttcttatttctttcgttcaacccattttccattggtgaaatcaacaatccatttagtcgcttttccctctttttcagaagtgacatattgttttttctctttgcgactaaaacgaacaatcgcttcattctcttctgggtctttttgtggagcatcggctaaataagctaatttttcaggtaaacgctcgcgatattgcacaagttcagcgattttaactgggcgtgtttcgcgggattttgggaagttatgtgctgacataaataccccactcgcaccatcacgcaatacaaaatatgcatcagatttttcgcattttaactcagggaaatgtactggctcttctttcggtggtgcgacctcgccacttttcaaaattttgcgcgtgttatcacaatttgtacatcccatatacttgccaaaacgaccaagttttaaatgcatatccgcaccgcatttatcacactcaacaacagggccatcataacctttaattntgaatgagccttcttcaattaaatatccatcacaatttggattattaccgcaatatggattttacgatgtgcatcgattacatagc

SEQ ID NO: 320 - DNA, 1964 bp, H. influenzae
tggtatacgaatatcagactcggtacccttctaaactgtcacgtttgctttgcgtttaaacgtggagagttcggcattgacacttgccatgccctcaattaaggcatcttgtaaacgttgtgtagtaatggtgccgtctgcacggtattgattacgaaattgggaaagtgacatatcggggaagaaaccatcattactgataatgtcatctgacgtatcgtaatcatttaactgttgctgcacttcgcccatttcataatcaggggccagtttgactgatattgcgccgtcgctcattgatttacccttataaaaaaagtcgggtgaggattaaattaagcacggccaataaatccgtcagaatttgaccgcacttttaatccgcccgacggctgcgtggtttgctcggtttatattctttcttgtttgtgcaagaaagaaccaaagaacacaccccgattaaatcgcttttctgccctttgttgtcattttcttaacggaaaatttttaactcgctacgctcaaacaagaaaaattttcctaaaaatgccaagtcggtcaggcgatttagacggggcattaaaacaacatcaacattcagtcgctgataattgtttttttagtttcttgatgtcgcctttcacgccaattttttgatctaaacccaaagcacgttctaaatatgccagtgcttgctcagggtgtttttcaaccaataacaaacccaattcacgcaataatcgcgctcggctttcatctggcatatcgcaatcggcggtgatgcgttggacttgctctaagtaagccacttcgaacggtttattggcagcttgtgcggctttggcttggtcggcaaattcttctgctaacaaggtgccaagtgttcgagtgaatggctcgggcaagcgtaaatcatgaaatacggcataatcggcaatttgtaaggcgagatgatattcgccacagtcaatcgcccacacgcaccatgtcatcaagacattatcttgtttaccacttccgaccgataacgccccttcaatccatggtagatagtcaggcaaaatttgctttttaaatgcgcctttgcgttccgtcgattggatgtttttcaaatcctttcgatggcgagcaagaatacggcacattttttcatattccgtaaagtcgcttagatcttcggtttctgccgcattagcgatagcggcagaaacttccagaaagtggcgtttagttgggcgcataattgattccgttatgcagccactggcgaaataggcgtaggtgcttcaagaatggtgatatttttcgccatggcgactgcctcgtagttttccacaacataggcttcgtttgacgataaataatcttccacacgattgcgttctggtacatcttttaagtgacgacgtactttgccttcctgcacgtagattgacaagttatcaagcgatgtgactaacactgtgcctttcgggaagaatgggacagatacggcttgtaacccacccacacgtttttggctaatgacggtatcgcctgccaaaatttcgcttggtttttcttggttgattaatgggaagtatttatccgctactaatttctcacccattatcgttaccggttttttttattcccattctcgcagctttagttaatccctctttcgctgtgttccttcctcgcttttttttccccccgtctttttctttccactcgttttctcctctcttttttctccgtctcgtcccctttcctttcctcttcctgcttatcgtttgtcccccttcctctcttttcccctcttcttttactaaatcccctctgcgcgcttctttcctttgtttccccctttccctccccttttctcctatccccttctatcctaatctttccccgcccttatcttttccatttctcctttacacttttcccttccttttccctttatttttattccttttctt

SEQ ID NO: 321 - DNA, 1782 bp, H. influenzae
tgttttcgaattcagactcggtacccttagtttggaaagccggtttaggcggcttgatgaaacaagcccaacaaatgcaagaaaaatgcaaaaatgcaggaagaaatcgcacaactagaagtaacgggtgaatctggtgcaggtttagtgaaaatcacgattaatggtgcacataactgccgccgtattgacattgatccttctttaatggaagacgataaagaaatgttagaagatttaatcgcagctgcttttaacgatgcggtgcgtcgtgcagaagaattacaaaaagaaaaaatggcatcagttaccgctggaatgccattaccaccaggaatgaagtttccgttttaatcgaacacttgtcttcccctgcttgcgagggaaggtgtcgcaaagcgacggaagggggttccccctaagtcttcggtattcccccgtaaatagagggagcggaaagtagccttatatttcatctcaaattatgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagctatgtctaaaattggtcattgttcacaatgtcgagactttacggaagaagacacttgcaacatttgcaataatccacgccgtcaaaattcaggtttgctttgtgtcgttgaaatgcccgcagatattcaagcgattgagcaaacggggcaattttcaggacgttattttgttttaatgggacatttgtctccacttgatggtattgggcctcgtgaaattggcttagatttactgcaaaaacgcttagtagaagaatctttccacgaagtgattcttgcaacaaatccaacagtggagggcgatgcgacggcaaactacattgctgaaatgtgccgccaacataatatcaaagtgagtcgtatcgctcacggtatccctgtcggtggtgaactagaaactgtggacggcacaacgcttactcactcttttctaggtcgtcgtcaaatcgactaatcttctcataccattatgcgtttatttatcgccgaaaaaccaagcctagctcgtgctattgcagatgtgctacccaaaccccatcaacgtggggatggttttattaaatgtggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactaatccatcaagcggatacacttgttaatgcaggagacccagatagagaaggacaattacttgtagatgaagtcttcagttatgccaatttatctgccgaaaaacgcgataaaattttacgctgcttgattagcgacctaaatccaagtgcggtagaaaaagcggttaaaaaattacaacccaaccgtaattttattcctcttgccacatccgcactcgcacgagctcgtgccgattggctttatggcattaatatgaccagagcttataccattcgaggtagacaaactggctatgatggcgtgctttctgttggacgagtgcaaaccctgtgctagttttatatgtccgtcgagatttagaattgagcatttccagccaaagacttctttgaagtcagcttgggttc

SEQ ID NO: 322 - DNA, 2279 bp, H. influenzae
  misc_feature (2226)..(2226): n is a, c, g, or t
  misc_feature (2239)..(2240): n is a, c, g, or t
ttccgttccaaggtttcgaccatgatagatgttggatcagccacaccaatcgcataagaaagttggatttcacaacgatctgctaaacctgctgccacaatattttttgcgacataacgtgcagcataagccgctgaacgatctactttagatggatcttttcctgagaatgcgccaccaccgtgacgagcagcaccaccgtaagtatccacgataattttacgaccagttaaaccacaatcccccatcggtccaccaataacaaaacgaccagtcgggttgatgaagaattttgtttctttagaaagccattcagttggtaatacaggtttgataatttcttccatcacaccttcgtgtaaatctttttggctaacttcttcagaatgttgagtagaaagtacaaccgcatccacaccaacaattttattatcttcatattttaacgtgacttggcttttcgcatctgggcgtaaccatgctaatttaccgcttttacgcacttcagcttgtttttccattaaacgatgtgcataagtaatagctgcaggcattaatacatccgtttcattggtggcataaccaaacataataccttggtcgcctgcaccttgatctaatggattttcacgatcaacgccttgattaatatctgcagattgtttaccaatcgcattaagcaccgcacaagaatgaccatcaaaacccatttcagaatgttcataaccaatatcacaaatcactttacgggttaaattctcaatatcaacccacgcagaggttgtgatttccccacccaccaatgccataccggtttttacgtaagtttcacaagctactcgtgcttttggatcttgttttaggatttcatcaagtactgcatcagaaatttgatcggcaattttatctggatgcccttcagagacagattcagatgtaaataaatagctagacatattttctctcttcttcttttaaatttggatgtattgacgtatagacggctataatacgcatttttgcttaataagcaagcggtattatgggttagttgagggaggaatcgccaaccaattacgcaaaattttctcgccaaagtctgacatataagattctggatgaaactggacactataaattggcaaagatttatgttgcattgccatcaccacgccttcatcgcaaagtgcggtaacttctaggcaatcaggaaaatcttcttcctgtacgccccaagaatgatatagcccgatattaaattcagttggaagatcaaaaaacaatggagaatttgaccgcacttttaatgttcgtttctgcccgtgacgaacattctctaagttatacaatgtaccaccaaaaaattcacataaggtttgatgccctaaacacacacctaaaatagatttttgctgataatatttttccaacatagaaaaaagttgtggataagcgcgtggtatatcaggccctggcgaaatcaatatatgactatatttttccgctgtactttcctttaaatcttccacgtttaaaacatcataaggcacatttaattttcgaattaaatccaccaagttaaaagtaaaagaatcgtgattattaatgatgagtaatttcataacagttcggtattcgttataatcaggtcattttacgcaaaatggcacaaagcacaatgcaacattttattgaacaggctaatcattatggcaaacaacgcacgccatttttctttcttattgattttgaaaaagaaaaacccttgatttgtcctctcgaaaattctgcacaacaaggcatttattttgatattttaggcaaaagaaattgcacgatttctccacaatctctccctcttaatttcaccaaacatccaatgcctttctcgcattatcaacaaggttttgaacttgttcaaagtgaattacaaaaaggtaattcttatttattaaatctcacctaccccactgaaatttcaggtaatctgtcacttgaacaaatttttcatcaaaccaatgcaccttataaattgtggttacaagatcaattcgtttgcttttcgcctgaatgttttgtcaatattcatgacaacaatatttttacctatcccatgaaagggacaattaatgccactctgcccgatgcagaaaatcagttactcacaaatgaaaaagaacaacgcgagcattacacgattgttgatttaatgcgtaatgatttatnccatggtggcagnnaacaccatgggtaccgaaggcccgatattcgtataccat

SEQ ID NO: 323 - DNA, 2965 bp, H. influenzae
caagatggctaccacaatattgtcggcatataaacggccgcgcaaacccactctaaaaatcaccacatctaatttgcttgcttaaataaatgcaatgcagaaagggtgctaaattcaaaataagtcagcgattctgtttgttttcatcaataaaagcaaaagaggcggtatgtgcttcatcgggtaaatcttgattttgaatgcgtactcgctcgttataacgcaataaatggggcgaagaatacacgcctacacgtaatccgtgattaagcagaatcgtttctaacaagcgacaagtcgtgcctttaccattcgtcccccccacagttatcacataaggggcgggatgaagtaaatccaatttttctgccacggattgaatacgatctaaaccgagatcaataggtttaaaatggcttttttctaaataagaaagccactcagcgagtggcgaagtggctttaagttgcatattattcatcttctgaaatgagttcaggttctacaaaaggagaaggttgattcgttaatttactcagtacacttgctaaagtttgacgcatttctgaacgtttcacgatcatatcaattgcccctttctcaagtagaaactcactacgttggaaaccttctggcaatttttcacgcacagtttgttcaataacgcgtggccctgcaaaaccaattaaggcttttggctcggcaatatttaaatcccctaacatcgcaaaactggctgatacgccgcctaaagtcggatccgttaatactgaaataaatggcacacccttttcacgcatttgagcaagtacggcactggtttttgccatttgcattaaagagaataatgcttcctgcatacgagcaccaccactcgcagagaaacatacaaacggacaattcatttccatcgctttttcagccgctttaacaaattttgcaccaactacagaacccattgaaccgcccataaaagcaaagttcgatgcagccacaacgattggcatattataaagtgtacctgtcatagtaattagcgcatctttctcgcccgtttctttttgcgccgcattgatacgatctttatatttctttaaatctttgaattttaaaatatctttctggttctaaatctgccgcaatttcttggcttgaatcttcgtccaataaatttaataaacgctcacgagcatcaatacgcatatgatgaccacatttcgggcaaacatacagattacgtttgagttcttcactataaagtacttgttcacaagcagtacattttgtccacacgccttctggcacattggcttttcgagtggaagaagaaggacttttactaaaaattcggttaatccagctcattttttgacctttttattgactagaaaattgcgcgtattagaacataaatttatagaatttgctacttgtaagaccgtttttgtactgctccgatttccttttaaacaagataatttgctctcctcttattgaacattttttttatttttttgtcttacagaccacgttatctgaaatttattttggagtatttatgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccggcattacaagatgggcgtgaatttaaagcaaaatagtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaattctatttattagtgcaataatctgcttgatatattaaga

SEQ ID NO: 324 - DNA, 3520 bp, H. influenzae
  misc_feature (2522)..(2522): n is a, c, g, or t
  misc_feature (2598)..(2598): n is a, c, g, or t
ctttattaagccaaaaggtaaaaaatgaaaattgcattaggcattgagtataacgggcaaaattattatggttggcagagacaagaaaaagtccgtagtgtacaagaagaattagaaaaggcactttctcacattgcaaatgaaaaaattgagatattttgtgcaggcagaacggattctggcgtaagtggaacgggtcaggttgttcattttgaaaccaatgcggttcgtccagagaaggcttgggcttttggtacgaatgctcatttacctgatgacattgcggtggcttgggcaaaacaagtcgatgatgaatttcacgccagattttccgcaacagcacgccgttaccgctatattctttattgtaataaattacgctctgcgattttagcgggaggaataacccattgccatttagatttagatgcggaaaaaatgcatcaggcagggcaatgtttacttggcgaacaggatttttcctctttccgtgcggcacaatgtcagtctcatacgccttggcgtaatgtgcatcatttgaatgtgtctcgtatcggaaaatatattattgttgatattcaggcgaacgcttttgtgcatcatatggtgcgcaatattgtgggaagtttgattgaggtcggtgctggaaatcagccgattgaatggatgcaatggctacttgagcagaaaaatcgtcagcttgctgcaccaacagcaaaaccagatggattgtatttggttgatgtgatttatccacaaaagtttgatattcctaaacgcccgattggtcctttatttttagaggatggtttattaaatcgtactttgaagtaaagcgtaatttcatgttttaaataaccatatctgaaaatattcttcataaaaaaagaccgcactttaaaagtgcggtcaatcttaagtgagttttatattaattttgatattccataattcactaaaaatccaccaaccattagccataaataaattagtgttcctaaaacaagtggttttaatcctgcctttttgattgcgcttgcttgtgtcgttaagccaagggcagccatcgctgaaattaataagaaagaatcgatttcaactaataatttcacgagttcttttggtaataaatcaaaagaattaaaaatcgcaacgccaataaaaagtacagcaaaccaaggaattgtaattttgtgtgatgtattttctgatactccattactacgtgttaataaccaagaaagcattaataaaaatggtgcgagcatcatcactcggatcattttggaaatgacggcagtattcgccacgataggatcaatattttccccaatcgcatacacttgagccacttcgtgtacactagaaccaacataaataccgaattgatgggcgttaattaaatcttgtgaccacgtgtagaacaaggggtaagtaaaaatagcaagcgtcccgaaaatgaccactacggcaatcgctactgaaactttatgagattctgctttggtaacaggctctgccgccataaccgctgccgcaccacaaatactacatccagccccagtgagataaaccaattgtttatccatttttagataacgaatgcccaaaagtgcggtaagaaaaaaggttgaaattagcataatcgcatcagtgacaacagcatttaagccaacatcggcaatatcgccaaaagtaaggcgaaaaccatacagcacaatgccagtgcgaagaagcgtgcctttcgcaaataacacgcctttttccacttgtgttgaaaattgcggataaatggtattgccgattgccattcccagcaagatggcaataattagagcactgatatgataatgatgggaaaaatcagtgtttcctaaatagtgagcaagtatagcgataatcgcaataaatataagtccgaaataaaagggacgagtgttcatttttcctttccttagtgagtgtttttgtcttttacccaagcggtttcatctaaaattttgccaaaatagctttcgactaagcgacgagtaacatcagtttgtggatcagtaaaaagattttgagggctgccatattcaatcatttttccgtcatccattacgataatcgtatctgcaatatgtttaattacaccgagatcctgtcccacataaatataagatatacctaaacgttgttgtaaatcaagggttaaattaagcaattgaatacgtacagaagcatctaaattgccaattgcatcatctattataataatttctggtgctaaaattaatgcgcgtgctagggcaacccgctgcttttggctgatagagagatgcttaatattgagatttgtgtaatcaggataaagtccaacaagagagagggtctcaaagattttttcattacgttgtgtttctgtccaatctgtcgctaggcttaatggttcgtctaatatttgtccaatatttaaacgtggattaaatgcagagttggcatcttggaaaaccatacgaatatgtttagctctagattgngcatcctgatattgtaattctcgatcattaaataaaattcgacccagagttggcggaataatgcccgctatcattntcactagaggtgatttaccagagccattattgccaatgattgcaagtgtttgtttactgttcaagggtaaaactcactttatccactgcattgaattgatttcgaccaaataaactggcgtgacctttaaaagttttagttaaatcttccacttgtaataagggcattattcatttcctttgcaattaagtataaaaggggtggcggttgttttttctttgaaatttttttctcggagattaataggataatgacaagaaaattcgtgttgttttattttcaatcgtcttggtttttccatacattttttttgcgcaaaagggcatcttggaccaagactatctgccttcggtatttgctctataacattccctgtaccttcctccgttccctttttatcttaaatttcatatctttttttcttttctatttctctttttttttatttttttacagcgttccctcttgattcaccgccccttatccttccagcatgcccggcttgtattttcatttgccccttatcccggtcttttctgcctgttttttccttctgttttttcttccccctcttttctcccctctctccggcctcctcgttcttttcgcttttttcccttgcccatcttttttttcttatctttccacatccctttgtatattgttatcttctctctattctttcccccgttattctcccgttttctttcctcccctccctccctttcttattgttttttttcttttttgtcattttcttttatttctctcttttcactccgttatctttttattttttatatttctcttttttttttttgatttcttcttcttttttgtgtctattcttatttttctttttattctttcttctatccttggagtgtttcttattgttacattttttgtttcttcctctttt

SEQ ID NO: 325 - DNA, 1073 bp, H. influenzae
gccctgactttgcatgcctgcaggttcgacttttagaggaatccccctgcgataagaaaagaacttttctttttcgttgaatgtacagtgatttccaccataaatttgcgtaatacctagattgtttaatcgctgagttgcaatttgataaagattactcaagtatttaccttcttcgattgcatcaggttgaaaggcgagtttggctttttcatctactgcaacaaacttttctacaacatcaatcccaacttgaaaggcctttggacctattgcagggccaaaccacgcaataatatcttcaggtttagcttgaaaatatttcactgtttcttctagtacgccatcgcataaaccacgccagccagcatgtgttgcagccacttcattgccagatgttgtagtgaatagaactggcaaacagtctgcagtcataacaacgcaaacttgattgggaacatttgtataaactgcatccgcttcaagattttgtcctgaataaggtaattgaagtactcgagtgctgtgtgtttgcgttaaaaatataggtttttgtggcaagccaaatttttcgactaataaagtgcggttagtttttaccgcacttttatcatcaccgacatgatcgcctaagttgaaactcaaataaggcgctaagctcacgcccccttcacgagtagtggtaaaggcatgaatattctttggaacattccaatttgggttaattgcttgcatattaataatctaactcatcttgatgtttgagatagtcggctttgagtgcattaagcaattcaacaaagtcatctggtaatggtgcataccattccataatttcccctgtgattggatgagctaagcgtaacatgaccgcatgtaaagcttggcgtttgaaattacgcaatacttccataaagtcttcactcgcatttttgggtggacgagggcgtccgccataggtttgatcgcctagcaatggatgggcaatatgtgccatatgaacgcggatttgatgcgtgcgccccgttctaaacgtaaacgtaaacggggtaccgagtccgaatcgtatacca

SEQ ID NO: 326 - DNA, 2322 bp, H. influenzae
  misc_feature (2286)..(2286): n is a, c, g, or t
  misc_feature (2300)..(2300): n is a, c, g, or t
acaggtagagccgtaaaacataatcttctgaaagttgaatgttggaatccaagaaattttacattcgacaagcataaaactgtggacgatcgcccttatggtggtggcccaggaatgctgatgatggtgcaacctttacgggatgcgattcatactgcaaaagcagcggcaggagaaggcgcaaaggtgatttacctttcgccacaaggacgtaaacttgatcaagacggcgtaaccgagcttgctcaaaatcagaaattgattttagtatgtggacgttacgaagggattgatgaacggttgattcaaactgaaattgatgaagaatggtcaatcggcgattacgttctaactggtggggaattgccggcaatgacattaattgatgctgttgcacgttttattcctggtgtattaggcaaacaagcctccgcagaagaagattcttttgcagatggtttattagattgcccgcattacaccagaccggaagtgttagaaggattaactgtaccacccgtgctgatgtcgggacatcacgaagaaattcggaaatggcgattaaaacaatcgctacagagaacgtggttccgacgccctgagctcttagaaggcctagctctgactgacgaacaacgtaagctgttaaaagaggcgcaagccgagcataacagttagtttcagttacatctaggatcaataaaggatcaaacaatgtctaacattatcaaacaacttgaacaagaacaattaaaacaaaacgtacctagcttccgcccaggtgatactttagaagttaaagtatgggtagttgaaggtagcaaacgtcgtttgcaagcattcgaaggcgtggttattgcaattcgtaaccgtggcttgcactcagcatttactttgcgtaaagtatctaacggcgtaggcgttgagcgtgtattccaaactcactctccagctgtagattctatcgcagttaaacgtaaaggtgcggtacgtaaagctaaactttactacttacgtgaacgttcaggtaaatcagctcgtattaaagagcgtttaggcgcataattccattatatttaatgataatctaaaaaaccttgggatattccaaggttttttgctatgtggatcatggtaatttaattaatcattaggatgatcgattaaaattccttattttacttcaacaacgatatcggattctgatttaggtttcaatttacccacttcatataaatcaatgccagtatctttggctatttcaattatagtttgaacgctattaggctcaacagccactaataaaccacctgatgtttgaggatcgcacaaaatcgctttttgttcttccgttaatgcgccaactttatgtccataactttcaaaattacgccctgttccaccgggtacgcaaccttgagcaatataatcttttactccgtccaaggttttaattttgtccgaaaaaactaccgcacttagatttgaaccttcacagatttcaattaaatggccaagtaaaccaaatccagtgacatccgtcattgctgtgacgccatccacttgggaaaattgactgccaatagaattcatttggcacatagcggcagtggctaaaccttgatgttctggcttaagttttccttttttctccgccgtcgtcaaaataccaataccaagcggttttgtcatataaagcttacaacctgattttgcagaagcattacgttttactttttcagtgtcaatcacacctgtcacggctaaaccaaaaataggttcaggcgaatcaatggaatgtccacccgccaaagcaatacccgcttgatggcaagcaaaacgaccaccatcaacaattttctgtgcaacttctgcaggtaatacattggttggaaaacctaaaatagcgattcccataatcggcttaccgcccatagcaaaaatgtcactaatggcattggtcgcggcaattcgtccaaaatcaaaaggatcatctacaatcggcataaaaaagtctgtggtactgataattgcagttccattaccaagatcatacaccgccgcatcgtctgcagtttcattgccaacgagcaaatttggatcataaaatttttccagttctgaatgtaaaattgtccctaacaccttaagcgaaattttacagcctcaacctgcaccatggctgtattgcgtcagcccgaatttttcttccatttcttatttaccttattgaatatcccgtttcgagaaatgactttcaaccctattttttatcgtaagaagctnaacatctttcctgnacggcatatttgcaaatccaaa

SEQ ID NO: 327 - DNA, 2078 bp, H. influenzae
tgtttacgattcggctcggtccctaccacggttgcggcctttgtgaactttacggaattttgtacgttttggttgcaacatttagcgtttctccttacttacgacctttaccgcgaggagcctttttaggcttgtcggcaggttgttgttctgattgcgcaacggcagccattccaccaagaatttcacctttgaagatccacactttaacgccgattacgccgtaagttgtatgagcttctgcagtgttataatcgatgtccgcacgaagagtatgtagaggtacgcgaccttcacgataccattctgaacgtgcgatttctgcaccacctaaacgaccgctaacctcaactttgatacctttagcacctaaacgcatagcactttgtaccgcacgtttcattgcacgacggaacattacacgacgttctaattgagaagcgatgctatctgcaactaatttcgcatctaattcaggttttttcacttcagcaatgttaatttgagcaggaacgccagcgattttagacactgcgttacgtaatttttcaacatcttcgccttttttaccgattacgataccaggacgagctgtgtgaatagttacacgaatacttttagctggacgctcaatagtaatacgtgaaactgaagcatttgctaattctttatttaagaatttgcgtactttgaaatcgccttcaagattgtcagcgaagtcttgtgtattcgcgaaccaagtagagctccaaggtttaacaatacctaggcgaataccatgtggatgtactttttgacccattgctattcctctacttattaacgatctgacacaaccacagtaatgtggctagtacgttttaaaatacgatctgcacgacctttagcacgtggcataacacgtttcatgctaggaccttcatcaacgaagattttagcaactttaagatcatcaatatctgcaccgtcattgtgctctgcatttgcaatagctgattctaaaactttcttcactaaagctgctgcttttttgttagtgaaagttaaaatttctaatgcttgcgcaacttttttaccacgaattaaatcggcaactaagcgagctttttgggcagaagtgcgagcgtaacgatgttttgcgatagtttccatctctttacctcttatttcttagctttcttatctgccgcgtgaccgcggtatgtacgagtcggtgcaaattcaccaagcttatgaccgatcatttcatcagatacataaacaggaacgtgctgacgaccattatggactgcgatggtcaatccgatcattgatggaatgatcattgaacgacgggaccaagttttaattggttttttatccccgctttccaccgccttctctaccttcttcaacaagtgtaggtcaaggaaaggacccttcttgagagaacgtggcatggctaatcctctttaatttaatctattatttgccacgacgacgtacgatatatttatcagtacgtttgttgtgacgagttttcttacctttagtttgaacgccccaaggagttactgggtgtttaccaaagttacgaccttcaccaccaccgtgtgggtgatctactgggttcattgcagtaccacgaactgtagggcgaatgcctctccagcggttagcaccagctttacccaatacgcgaagcatatgttctgagttaccaacttcaccgattgtagcaacacattcagctaatactttacgcatttcgccagaacgtaaacgtaaagttacatagttgccttcacgtgcgatgatttgtacataagcaccagcagaacgagcgatttgaccgcctttacctggttttaattcaacgttatgtactgttgaaccaactgggatattacgcattggtaatgagttacccactttaattggtgagtttatgccagcttggatttgatcgcctactgacaaacctttaggtgctaaaatataacggcgttcaccatctttataaagcactaaagcaatgttagcagaacggtttggatcatattctaaacgctcaacaaccgctggaatgtctaacttgt

SEQ ID NO: 328 - DNA, 3454 bp, H. influenzae
  misc_feature (663)..(663): n is a, c, g, or t
  misc_feature (701)..(701): n is a, c, g, or t
taagttgtttgccgccgtaaagggcattaactaatgcgcgagttccagtaatcgcggtaaacatagaaatcgcaacaccaagtgaaagcgtaatcgcaaaaccttgaattgggcctgttcctaccgcgtatagaataattgcggttaagattgtggttaagttagcatcaaaaatagaagtaaatgcaccgttataaccttcattaatggcttgctgaattgaacgaccattacgaatttcttctttaatacgttcaaaaatcaatacattcgcatctactgacatacctaaagttaaaacgatacccgcaatacccggcattgaaagtgtcgcaccgggtaaaatagacattaatcccacaagtaatacgatattaataacaagtgcaaaacttgcaatcacaccaaacattttgtagtaaaacaacataaaggcaataacagcaactaatccccaaagactcgcattaatcccttgctctacgttttgtgcacctaatgatgggccaattgtgcgttcttcaacaatttgaattggtgcaattaatgcgccagatttcaacaaggtagaaagattatgtgcttcggcaatactatcaacaccagtaatttggaaattagaaccaaaacgacctgaattgtgcaacattaataacttctttnctgcttttctaaaatggttttgccattttcatcttttntgccattatctttatattcaacataaagcgttgccattggttttttgtaatattttttagtggtctgagacataatctcgccaccttcgctatccaaggttacactcacttgcggcgtgcttgaatgctgatctaaaccagagcttgaattaatgatatgctccccacctaatacggcacgtttaaataatgcaacaggatgcccttggcgatcatatttaacttccgaatcagctggtaacatattacgagaaatagcatcagctgtaacattttgatttacgatacgaaactcaagtgttgccgttgcccctaaaatttcttttgcgcgtgcagtgtcttgaacacctggtaattcaatcacaatacgttcagcaccttgacgttgaattaccgcttctgcaacacctaattcagcaacacgtttacgtaaaatcgttaagttttgctcaatggctaagtcgcgtgcttcatttaatgctgcagtagatagccctaaattaatactatcagcatcaggctcagtaatgtctaatgttggatgtaattggcgaataattcgctcagctttagcacgctggctcacattagctaaggttatcaacgtaccaaaatgctctgtatttttaatggcagtatattgaattttttctttgcgaagttcgccacgcaaactgtcttgtaattgctcttggcgttttacaagtgcggcattcatatcgacttccatcaaaaaacgaaccccaccgcgtaagtctaatccccatttcataggattcgcaccaaacatacttaaccaagctggagtggctggagcaagatttaatgcggtggtgtaattattgccaagacgttcagcaattttatctttagcaagaagttgatcatcggtattagtaaaacgagctagaattgagccattctcaagcacgatagatttggttggaagattattggttttaagcacatcttgaacttgtccaagcacgctagtatttgcttcttgaccgcgcgtaccggaaatttgcaccgcaggatcttcaccataaatatttggaagagaatataaaatcccgatggccacaataaaaataaccatcaaattcttccataatggataacggtttaacatagttttccttttcttttctaacgcacagagccacaatgcgtggctctggaaaataatttaacgttactcttaaagtgattttaatgaacctttaggaagaacgctcacaatgtagttacgattaatcgtaatttctgtcgtgtcgtttaacgcaatcacgatgctatcactaccttcggttactttagtaattttgcctattaaaccaccagcagttaaaacttcagtaccttttgcaagctcagacatcaattttttgtgttctttattgcgtttagcttgcgggcgataaatcataaagtagaaaattaaaccaaagatcacgaaaataaatagcgtggacattggactttgtgcttccattgtgttttccttattaatttaagttaaaaattttgcgtaaaataccataaattgcttcattgggaaaggcgaactaagcccaatatcctacgttatggcgattaattttattttttcaagataacgataaattctttttccgaagcgtaatattgctcgactaaagcaacagaattttcttcggcaaaaatagaaaaattttccaccgcactttcaaggtttaagatcaacattagctcatcatttttattcaaattttttaaggcttttttggcacttaaaagaggaatggggcatcgaagtgcggttaaattgagctgatatttcattctttaacttgacgacgagcactcatgcgcttgcccatttcagtcaaaatatccgcacttaagcattcacgccccatttcaaataacggctcttctaacgcaatatgacgatcataaccttgaataaagcgttcaattaaatattcatcaatattttgacgttgttcagaaataagctcttctaactgcacagataatgcattccaattttcatgcaaatattcgtgctgtttttctaattcatcaatggaagtttgtgcttgcggagccactttgactaattgagggaaaaaatctgattcttcatcatcgtgatgtaacggtgcggcacgattgaaataagttaaaatttgctcaacatcatttaacacagcctgagtatagccgtgtttttctagataatcaggcaaaatgcttaactgacgacaaaaacgttttactttactatgacaagcataaagcatttcaataggttcattccatgtggcgaattgttgaggttcaagaatttgcataaggtttcctttgttaaaaagtgcggtcaaaaaacgcttcatttttctaccgcactttcatcaattatgagttatccgctaattgtaatggtggaacaggtttgcccatgcgagcatagaattccaccacaaaatcatcaaaacgatcatcttcaatcgcttgacgaatttccgccattaaacgttgataatagcgtaaattgtgaatggtatttaagcgtgcacctaaaatttcaccgcatttatctaaatgatataaatacgctttggtgtagtttttacaggtgtagcaatcacattcaggatctaacgggctggtatcatcacgatattttgcatacggattttgacaatgccgtctgtcacaaataaaggggtctcatagagtcaactgcgaggcatgcaagtcaaggc

SEQ ID NO: 329 - DNA, 2455 bp, H. influenzae
  misc_feature (2421)..(2421): n is a, c, g, or t
ctgtatacgatatcggctcggtaccctacgtgttttcaccgtgcaacgtaatgactctcgaattggttcgcgatcaacccaatgtaattggctagcaatcaatccttttgaaaataaacgaggatgatcgtgaccttgcgcgacaataagttcattattttctacatctttatctactacataccaagcttcatctcccgcattttttagaccaccaatgcccaatcctttgcgttgtcccaatgtgtgatacattaatccatcatgacgaccaataatttcatcatctacagtgcgaatattacctggttgagctggtaaatagcgtgctaagaaatccttaaatttacgctcaccaataaaacaaataccggtagaatcttttttcttcgccgtaattaagccaagatcttcagcaatagcgcgaacaatgggcttctcgatttcaccaacggggaataaactttgccccacttgtttatggcttaaagtataaagaaaataactttgatctttattggcatctaaaccacgtaatagttttgcattttcattatctcccgctctacgtacataatgccctgttgcaatataatctgcaccgagatcttcagctgcatattctaaaaatgctttaaatttaatttctttattacatagaatatctgggttcggcgtgcgtcctgctttatattcagttaaaaaatgctcaaagacattatcccaatattctgccgcaaaattaattttatgtagtttgatccctaatttatcgcatactgcttgagcatctgcaagatcagctgcggcagtacaataatcagagtcgtcatcttcttcccagtttttcataaacaggccttccacttgatagccttgctgttgaagaataaaagctgacacagaagaatccacgccaccagacataccacaaatcactttttttgtcgcatttctcgcaagctgttcttgcgtcagttgaggaaagtgttgattataagtatttgaaattaacatagttctcccgtaacttcggttaaggcgaagcacattggtcattgaattagaaaacggcaaaataattttgccgttaattttattttgcacataaagtgcggtcagttttgagcaagttatttcacttcataaaattgcgagttatcatcttttttcgcaaatttttgctcatattcagcttttgcttgttcatcgcctgcatctaattttgattgaagcgtgtcgcaaggtttatcacaatcacaagctttgtcaataccaaggctagataaaccaccgcagctgccttttaaactttgttttttgataataaagccgatagacatcaacaatataattgcgacgaaagcgattaaagtaaaaaataaagtttgcataactattcttttgtttctgttaattttttgaaagcagaggatgatttggtaacaaaaccattatctgttctaatgattaaataaacggcaagattatttttctcagccacttctaacgccttgtcttcccccagcacaaataaccctgtagataagccatctgcagtcattgaggttggtgcaagtcccgtaattgaggctaaatgatgctgaatgggataccctgtttcggatcaatttcatgagcaaagcgtttgccattttcttcaaagtaaatacggtaatcgccagaacttgccattcccatattgttaatccaatgacagcttcagccgctctttcgcctgttgtagttggtttttcaatggcaatctgccaaggtttaccttcaatattttttcctttcgcacgaatttcaccgccgatttcaaccatgtaattctgagcatttagttgttctaacttttcagccacctgatcaacgccaaaacctttagcaattgacgataaatctacgtaaacttgaggaagtgctttgcttaatgtcggttttgcaccactcatatcaagggcaattttatcaatgccaacccaggcttggcgttcagctaattgttctggtgtaggttgtttttcggggcgtttttcaggaccaaatccccataaatttacaactggaccaacagttacatccaacgcgccttcggtcactttatttaaacgaatcgcttcagctaatactttggcaaaatctgctgaaatctcaatcggtgtgttcacttgggtattttgattgaagcggctcaattccgaatcttttttgtaagtggacattttcgcattcacatcttttaagattgcttcaatttcttcatgcgtcttttcagatgttgcttttattgaaccatcatcaaggtatttaacatgataagttgtccccattgttttaccgcttaaagagataactttgttcttttgacaagcagcaagacttaatgccattgctaccgctatgatggggatcccntaagagtcgacctgcaggccagccaaggcatggc

SEQ ID NO: 330 - DNA, 2983 bp, H. influenzae
  misc_feature (2816)..(2816): n is a, c, g, or t
ggatctcggaataggttttaacgggaaccttttagctttgccccgttttcatatgacccacgggggtaattttccccgagttttgttttctgctacggatttgttctttacgggatgctctaaatccgtgattctgctttacgaagtgagtaacgtgtgaattattacccagtttcgatgtaagttagcacctgaaattttgttgatacgacttaattcaacttcttcaatttcgccaaatttactgaaatcaacttttggccatggcaataagcctaatccagcaccatttgctacaccattgccagtagcttgtgctgttgcaccgctttcataagctttaactgcggtcttcacataagcttcaatatcttctttaacgatacgacctttacgaccagtaccttttactttatctagatttacaccaaattcacgagctaaacgacgaataactggtgttgcgtgtgcatatcctgtacttgcttctacttgttcttggcttaatccagatacgttgttatttgattgagctgcttgtgcagtagtatcaggagctgctgcctgtggtgcttgtgcagtagtagcaggagctgctgcctgtggtgcttgtgcagtagtagcaggagctgctgtctgtggtgctgatgttgaagctgatgctgatgctgctggagctgcacctagtacttcaaaacgcataattaatgaaccagttgaaactttatcgcctgatttcactaaaatttcttttaccacaccgccgaatggtgcaggaacttccattgaggctttatcgccttcaacgctaattaaagattgttcttcagtgattgtatcgccaactgcaaccataatttcggttacattgacttcatcgccaccaatatctggcacatttacttctacaatagctgaagccgttggtgcggtagcaaccactggtgcagtaggcgcatcagctactggagcagtaggctcatcagctgctggagcagcacctgccgcttctaatacaagcattggagtaccagttgaaactttatcgcccactttcactaaaatttcttttacaacacccgcttctggtgcaggcacttccattgaagctttatcgccttcaacgttaaatgatagattgatcaacagaaatggtatcgcctacgtttaccatcacttctgttacggtaacttcatcactaccaatatcaggaatttgaatttgttttgacattttttgttccttttaaagtgcggtcataaaacacaatgttttttgaccgcagttttcatcaattacgcataaagcggattgatacgatctacattcaaaccgaatttcgcaatcgcatctgcaaccacttggttagatactgtaccttctttcgctaattgagaaagtgcagcaaccacaacataacgtgcatcaacttcgaagtgttcacgtaagtttgcacggctatctgaacgaccgaaaccgtctgtacctaatacatgatagtgcttacttggtacaaatgcacggatttgatcagcataacctttcacatagtcagttgaagcaacggttggtaaatcagctaatacttgagcaacgtatggtacgcgttgtgtctctgttgggtgtaataagttccaacgtgctgcatcatgaccttcgcgtgctaattcattgaatgaaggcgcagaaaatacatctgaagtcacaccgtagtcatttgcaagaatttgtgccgcttcacgaacgtgacgcataatcgcaccagaacctaataattgaacgtgacctttgccttttttaccttccactgtttcaaatttatataaacctttacggataccttcttccgcaccagcaggcattgcaggttgatccatcacttcatttaatgtagtcatataatagaatacatcttcttgtttttcgccgtacatacggttgataccgtcttgcataataacagcaacttcaaatgcaaatgatggatcgtaagtaacgcaattaggaataacgcccgcttgaatatggctgtgaccgtcttcgtgttgtaaaccttcgccatttaaggttgtacgaccagaagtaccccctaccataaagccacgagctaattggtcgcctgcagcccacatcatatcgcccacacgttggaaaccgaacattgagtaatagataaagaatggaatcatcggttggttattgacagagtacgagttcgctgctgctaaccaagatgcggttgcacctaattcattgataccttcttgtaatacttgaccatcttttgcttcacgatagtaagccactaaatcacggtctgaaggtacatagttttgaccatgtgggttataaataccaacttgacggaataaaccttccataccgaaagtacgtgcttcatccgcaatcattggaacgatagttttaccgatgtttttatcttttaataagatgtttaatgcacgagtaaacgccatagtggttgaaataccacgaggttgttcttctaataatgctttaaactcttctaatgcaggaactttatattcaacatcaaatttagtacgacgagcgggaacataaccgtttaatgctttacggtgaccatgtaagtattcatactcaggtgtgccttcagcaaatttaatgtattctaatttttctacttgttcatcggttaatggtaattcaaagaagtcacggaaacctttaaggctttcgtaagacatttttttagattggtgagcggtatttttactttccgcttcaggaattttataacctttaacttgatgcgctaaaatcacaactgggnttcggtgcattttgtgcttttgcataggctgcatataatttttcgctatcatgtgcaccacggcgtaatgcccagatttctcatcgggcatatcagcaactaatggcgcaagttcttggatacgacccaagaaatgtttcgcgatatatgccccatcctttaattaa

SEQ ID NO: 331 - DNA, 2726 bp, H. influenzae
gataaaagagggggaaaaaagaaatacgggaagtggaggggtgaaaagagggagagaaagcagtaaaagaagaggaagaagaagaagagggtaataagaaagaaagaccgagaggtgtgggagagccgggtgttaaaggcgaacaagaatggccaaattaggagtaggacccggacaaacaataagagcaagttgttttaaacataagatccattctgataaccgtttttcatgggtaattttaaatgaagaatggtttctcggaaccgaccattcaacaaccatttgccaatcaataccgaaatagggttgggttggtccaccaatatcgcagactaaccaatccccttttttccttttgggggctgaaatttaaaaccgtcttccgcgcaatgttcaatgcaccccgtatcatgcaaactcgccgccatttttccgtgatcaactgcataaacaaataaacctcgtttgactaattgatacgtccaaccgccagggcaagcccctaaatcaacgccaatcatattttcatttaaacgtttattctcttctttacgcggaataaaagtcaaaatagcttcttctagttttaacgtagatcgactcggcgcatctgcaggaaattttaaacgagggattcccataaaatgggaggaatgattatccacataagaatatcccacatagcagcaattcggttttacaaaaaaacaatgtaaaaattgaccgcacttttgactcgcctttgccgaaagccaaccttgttttttcaatgcctgacgtaaaggcacggtaaacttacgacaaaaagtggaaagctcctttgcttcatttgtgtctgcagtttctacaaaaagctcgctagattgagcaaaattaacttgttgtgataatttcttcaaatgccgccacgatgggacttaatacgatcagcgggatctaaatcttccaagaaatcggaaataaccattcatctgacgagcaaaaatcaaacgattaaaaggaatgtatcgggcaaggcgatctgcctcatcaggttgataacattcaaaaatcacgtagcccgaattatcttgcactcgagcaaaacccaaatacacctaaatgacttgcttgatcggtaatctctgcggcgacttctttctcaaaacctgggcgacaatataatgcgagtttattcattttcttcttgtttaattgagttaataatccactgacggaatgcttgaattttttggtcatcaaggcgatcaagatgattgaccacataaaatgattttggatcaggcaaattagtcggcaacactgcttgcaatgagccattttcaatttcttgcaaggctaataagcgattagctaatacaataccttgcccgtgaatagccgcctgtaacgccataaatgtatggctaaataacggcccttgctgaatatttaaatcatctaactgtaaatgatttgccatcgcttgccaattatcacaggtatgaatgtgaattaatgtgtgtttttttaaatcttcaggctgaataattggattttctgctagcaattcaggtgaggctaaaatcaataaattttcttcgcaaagacgatctacttgaagattctgccaatttcccaaaccataataaatagcaagatcaatttctttatttaacaaaccttcatcttgatccacgcctgttaaacgaacctcaatttgcggataaagctgattaaattcacttaaatgtggcactaaccattggataccaaaagtttgtggcacgctaatatttaaatgcggatccgtttttaacgttaataatcgctctgttgcttcatttaagcgacgcagaattttattaatatcaacaaaataagctttaccaagctccgttaattctaaagaacgattctttcgcttaaataattcaatccctaaaaattcttctaataatttaatttgatgactaaccgccgcctgtgtaacacaaagctcatctgctgctttagtaaaacttaaataacgagcagccgactcaaaagattttagtgaattcaatggtggcaaacgtttatacatatagtatttccatttataaaattttcgtctataatggacaagatttatttcaaattagtttttctaatacctaaaataaaaaaacgtcacttgtcctttcctacccttttccttacaatacaaccatacttaatgattggtaatttcttactagttaatgagtttcagacttaagtatgatgttgtgtttgcatatagttcgggaaaccgaacttgagtaacaatttgttactcatttacttcctgtatattattaaaccgatttggttaaacgctgctctcattgagtggcgtttttttcatcccgattttagcataactatattgttatttcctgccctgtttccaaaatttcattattcctttttagttggctaaaaattgcatcatttcgagaatttattatttaaatcacttcaggaatggtgtagattaagcgaaatttcattcaaaaaataatattaaggaagtaaaatgaaagacttagactggaataaccttggttttagttatattaaaacagattaccgcttcatcgctcactggaaagatggcaaatgggacgaaggaaaactcccccagacatactttactatcacgaagttctaccgccttactcggccacatgctttgaagcttaaagctaccgtgcagatgc

SEQ ID NO: 332 - DNA, 3687 bp, H. influenzae
  misc_feature (1427)..(1427): n is a, c, g, or t
  misc_feature (3656)..(3656): n is a, c, g, or t
  misc_feature (3659)..(3659): n is a, c, g, or t
tgcagcgggcgcggacgacgaagaaacacctggtgcgccggacgggacaaacaagcggcaggaataggcgcgagaaagaacttaccacggagggagcgattggcaaaaagacgaacggaaaatagtagatgggggaagaagccaaagggacggtagtaataaaaaattggcgcgagaaaggggatgcgaggatgaaggtgaaaaaggtagaccaccgatgggtggcaaaaaagatagggtcgattggaacaaggctttacccaagtaggtatgccacacaggtgcaacgccataggaacgatagcgtaaaaagattattgtgtaaataaagctctaagatttcttgtgggtgagggtattttcaatttctgccgcaagcaccgcttcacgggctttacgaataatggttttttctggggttaagaaaaagttacgcgctaattgttgagtaatcgtacttgcaccttgtgatgcaccgccattactcactgcgacaaacaatgcacgagcaatgccgatagggtctaatccgtgatgatcgtaaaaacgattgtcttccgttgctaaaaatgcgtcaattaagcgttgtggcacatcggctaatttcactggaatacggcgttgctcgcccacttcgccaattaatttaccgtcagccgtataaatctgcattggttgttgtaattcaacggttcttaatgtttctactgagggcaattccgattttaggtggaaatacaacattccgccagccactaaacctaaaatacataaagttaatagggtgtttaatattaattttgcgatccgcatcgtaaaattctcgcttggttaatgaatattcttgtcaagagacctatgatttagttgttaagtataaaagattcagcctttaaagaataggaaagaatatgcaattctccctgaaaaattaccgcactttacaaatcggcattcatcgtaagcagggttattttgattttgtgtggtttgatgatcttgaacagccacaaagttatcaaatttttgttaatgatcgtgattttaaaaatcgttttttacaacagctaaaaacacaatatcaagggaaaacctttcctttacagtttgtggcaagcattcccgctcacttaacttggtcgaaagtattaatgttgccacaagtgttaaatgcgcaagaatgtcatcaacaatgtaaatttgtgattgaaaaagagctgcctatttctttaaatgaattatggtttgattatcgttctacctcgttaaagcaaggttttcgattagacgtttctgcaattcgtaaaagtactgctcaaacttatttgcaagattttcagccatttaaaattaatgtattggatgttgcgtcaaatgctatttgggtgcatttcagtattttgtgaaatgaacaagtgcggtcaganaataccttatttttatttcaagaagatgactattgtttggcgatctgtgaaagatcgcagcaatcgcaaattttacaatctcacgaaaatttgaccgcactttatgaacaatttaccgaacgttttgaaggacaacttgaacaagtttttgtttatcaaattccctcaagtcatacaccattacccgaaactgtttcgagtagaaacagaactcccttttattgcgcttggcaacgcgctatggcaaaaagatttacatcaacaaaaagtgggtggttaaatgtcgatgaatttattgccttggcgtacttatcaacatcaaaagcgtttacgtcgtttagctttttatatcgctttatttatcttgcttgctattaatttaatgttggcttttagcaatttgattgaacaacagaaacaaaatttgcaagcgcagcaaacatcttttgaacaacttaatcagcaacttcacaaaactaccatgcaaattgatcagttacgcagtgcggtgaaagttggtgaagttttgacatctattcccaacgagcaagtaaaaaagagtttacaacagctaagtgaattaccttttcaacaaggagaactgaataaatttaaacaagatgccaataacttaagtttggaaggtaacgcgcaagatcaaacagaatttgaactgattcatcaatttttaaagaaacattttcccaatgtgaaattaagtcaggttcaacctgaacaagatacattgttttttcactttgatgtggaacaaggggcggaaaaatgaaagctttttttaacgatccttttactccttttggaaaatggctaagtcagcctttttatgtgcacggtttaacctttttattgctattaagtgcggtgatttttcgccccgttttagattatatcgaggggagttcacgtttccatgaaattgaaaatgagttagcggtgaaacgttcagaattgttgcatcaacagaaaattttaacttctttacagcagcagtcggaaagtcgaaaactttctccagaactggctgcacaaattattcctttgaataaacaaattcaacgtttagctgcgcgtaacggtttatctcacatttacgttgggaaatggggcaaaagcctattttgcatttacagcttacaggtcattttgagaaaacgaagacatttttaaccgcacttttggctaattcgtcacagctttcagtgagtcgcttgcagtttatcaaacccgaagacaacccattgcaaaccgagatcatttttcagctagataaggaaacaaaatgttacatttggtttttcctgattatattattttttatgaattgcagttggggacaagatcctttcgataaaacacagcgtaaccgttctcagtttgataacgcacaaacagtaatggagcagacagaaataatttcctcagatgtacctaataatctatgcggagcggatgaaaatcgccaagcggctgaaattcctttgaacgctttaaaattggtgggcgtagtgatttctaaagataaagcctttgccttgttgcaagatcaaggtttgcaaatttacagcgttttagagggcgttgatgtggctcaagagggctatattgtagaaaaaatcaaccaaaacaatgttcaatttatgcgtaagctcggagagcaatgtgatagtagtgaatggaaaaaattaagtttttaaaggaagattatgaagaaatattttttaaagtgcggttattttttagtgtgtttttgtttgccattaatcgtttttgctaatcctaaaacagataacgaatgtttttttattcgtttatcgcaagcacctttagctcaaacactggagcaattagcttttcaacaagatgtgaatttagtgatgggtgagaggttagaaggcaatatttctttgaaattaaacaatattgatatgccacgtttgctaaaaataatcgcaaaaagtaagcatcttactttgaataaagatgatggggtttattatttaaacggcagtcaatctggcaaaggtcaagttgcaggaaatcttacgacaaatgaaccgcacttagtcagccacacggtaaaacttcattttgctaaagcctctgaattaatgaaatccttaacaacaggaagtggatctttgctttcttctgcggggagcattactttgatgatcgcagtaattgctggttatcaggagaaccggggtnctntaagtaaaccgcaggcagcaagaaaggc

SEQ ID NO: 333 - DNA, 2378 bp, H. influenzae
aaaataagttaactcgaaactgggtaagtaaattacggcggaatacataaagagggcgaggtaagaacagtaaaaccctttcatgtgtggggtatctcgcgagtaaaaaaagcgaattcgcgtgccgagttggtttcccaccattcaaagggaaaatggtattatttgagggaggggaaggtccgataatatccacgaagtggtgtgcaaaattaacgtggtctttgtgatccaataagataaatcttacggcccttagcaatattatcaaataaggtgaagcggcgctttaagaaagtatcagccaatttttagcagtttgctcactatttacccgtaatgcaagatgatcgatttcatagtgagacagatctattgtcatttctttggctaaatgctgaatttttctttcaaatgttgctaaatctgctgaaagtgcggtcaaattttcctgtaaatttgtcattttgtccctttgagaaatatacaaagaacggtatcataaccgattatttttattattcaatttgaacataggaaaaaacgtgaatattcaatctattctatccgataaaattaaacaagcaatggttattgcaggtgctgatcaatcttgtgatgcgcttgttcgtcaatcaggcaaaccacaatttggcgattatcaagccaacggtattatggctgcagcaaaaaaattaggtttaaatccacgagaatttgctcaaaaagttttagataatcttcaactatctgatattgcagaaaaattagaaatcgcaggtccaggttttatcaatattttcttaaatccaacttggctaacaactgaaatttcagctgcactttcccacaaaaatttaggtattcaagctaccaataaacaaacagttgtgattgattattcctctccaaacgtagcaaaagaaatgcacgtaggtcatttacgctctacgataatcggcgatgctgtagctagaacccttgagtttttaggtcacaatgtcatccgcgctaaccacgtaggcgactggggaacgcaattcggaatgcttattgcttatcttgaaaaaatgcaaaacgaacacgccagtgaaatggaattacaagatcttgaagccttttatcgcgaagccaaaaaacactacgatgaagatgaaatattcgctgaaaaagcacgtaattacgtcgtaaaattacaaagtggagatgaatattgtcgaacgatgtggaaacgtttagtcgatatcactatgcaacaaaatcagcacaactataatcgcttaaacgtgactttaaccgaaaaagatgtaatgggcgaaagtctttataatcctatgttaccaagcatcgtagaagatcttaaaaaacaaggtttggctgtggaaaatgatggtgcattggttgtttatttagatgaatttaaaaataaagatggcgacccaatgggtgtaatcgttcaaaaaaaagacggcggtttcctttatactacaactgatattgctgcagcaaaatatcgttatgaaacattaaaagctaatcgcgcacttgttttttcagatactcgccaaagccaacatatgcaacaagcttggttaattactcgtaaagcaggttatgtaccagacagtttctcgttagagcataaaaactttgggatgatgcttggtaaagatggcaagccatttaaaactcgtactggtggcacggtaaaattagccgatctattaaatgaagccatcgaacgcgccactgtattaattaatgaaaaaaataccaatttatctaatgatgaaaaacaagctgtgattgaggctattggtattggatcggtaaaatatgcagatctatccaaaaaccgcaccacggattacgtttttgattgggataatatgttaagtttcgaaggtaacactgcaccttatatgcaatatgcctacactcgaattcgttcgatctttaataaaacagatataaattcaaccgcacttttggctgcacctttaactattaaagatgataaagaaagaacgcttgcaatcaagcttctacaatttgaagaagccgtgcaaactgtcggaaaagaaggcacaccacacgtgctttgtgcttatttatatgaacttgctggcatcttctcgtcattctatgaacattgcccaattttaaatgctgaaaatgaatctataaaattaagtcgtttgaaattggcattattaacagaaaaaaccttaaaacagggtttaacgttactcggtattaaaaccgtagaaaaaatgtaatttagataattaaaatccctttctcaggaaagggattttttatacttgtttactgaataaaaaaagtgccccatggggcactaccggaaaggggatttc

SEQ ID NO: 334 - DNA, 1938 bp, H. influenzae
  misc_feature (248)..(248): n is a, c, g, or t
  misc_feature (1829)..(1829): n is a, c, g, or t
cgaaggtcccgtatattcccgaaataaaacctcttatgtagacgataaaaatcaggtagaattgcctagaatgtttaactcaaaaaaaggaaatcttatgttcgttgttatttttgggtcgtcctggctgccctttactgtgtgcgtgcaaaaaacccttgctgaaaaattaaaaggcgaagttgctgattttgactatcgttatgtggatattcatgcagaaggcattactaaagaagatttatcanaatcagttggtaagccagtagaaaccgtaccacaaatctttattgatgaaaaaccaattggtggttgcactgactttgaagcattaatgaaagaacaatttggtatcgttgcttaatttttcttttaatttacaaaaaagccactttcaatcgaaagtggctttttcatagaatcgttttaaccgttataacgtttaaaaattaatgtcgcatttgtaccaccaaaaccaaagctatttgacatgacagtttgtaatcctgcattttctttcgtctcagtaacgatgttgcaaccttcagcggcttcatctaaggtttcgatattaatacttggcgcaataaaatcattatccagcattaacaacgtgtaaattgcttcgtgtgcacccgccgcccctaaagagtgacctgtcattgatttagttgaagaaatcgctgggattttatcgccaaatacatttttgattgcacctaattctttcacgtcaccaactggtgtagatgtaccgtgtacgttgatgtaatcaattggggtatctacagttgccattgcctgtttcatacaacgctctgcaccttcgccacttggtgcaaccatatcgtaaccgtcagaagttgcgccatagccgacaatttccgcgtagatttttgcaccacgagcaagtgcgtgttctaattcttccacaaccacaacagcaccaccacctgcaataacgaaaccgtcacgatttgcgtcataagcacgagatgctttttctggcgtttcattgtatttagttgaaactgcacccattgcatcaaactcagtagcacattcccaagataattcttctgcaccaccagcaaaaacgatatcttgtttgcctaattgaattaattcaaccgcatgaccaatacaatgtgcagaggttgcacaagcagaactcatagaataattcacaccacgaattttataaggtgttgctaaacaagctgaaacacttgatgccatggttttcgttacagcgtaaggaccaatcgcttttacaccgcgagggccacgaaccgcatcacaagccactaattgattatgtgcagagcccgtacctgcaccaatcactaaaccagtacgatcattagaaacttgatcttctgttaagcctgcatcttcaatcgcttcacgcatagaaagataagcataagccgctgcatcacccataaaacggaacactttacgatcaatgtgctcgcttgggtttaatttgattgttccggcaacatggctacgcatattcatttctacaaactcaggcacaacttcaatacctgatttcccttcttttaatgaagccaatacttcttctttgttgttaccgatacttgaaataatcccaaagcctgtaattacagctcttctcattgcttcttccttattggtttatatgtaaaaataacggcacaaaattactacgaaataaaaatatttcaagcaataattcatttgttcgaccagttcagaaaattgcgttattatacgcaaatttcattaggcaagaaaggaataaaatgacctttagcgtgcgacatgctgagattcacttncatcgaaaccatattcccgtttcagatcattcaaaggatgcctatttttttaccgaaagggattacccgaacagaatatggtttctaccagtaatcaactttgggaaga

SEQ ID NO: 335 - DNA, 2314 bp, H. influenzae
  misc_feature (1752)..(1752): n is a, c, g, or t
acgtaaagccggttctttggataatttagcttttttaagtaaagcgcctccggtcccccccaaaatgcgttccaattcgcataattaaaaccttctaaatcgttttcgccaagtcagctcaagcaacatgtcgctggaattctaaacttttcgtagccattttgtccgtgccaaagcattaagtttttagcagtttgtgggaaatagttgatgcccctcggattcctttgttagatttttcgttataccgaattgctcgttggatagcctcaaaatcaaagcctaaatgttcaaaaaaacgctgatcttctgatgaaatcacagctaattgaatgtttggagagatattttctaggctgacccagttatattggatttgatatcgaaaatcgccttgtaaaagattagcgattttttgttgtaccatataagcggaaaatggaataggtacaaagcgaaaaatcagcaacaaagcaaaaacggcgaaaaaaaaacaaaagacaactcgctgccagttttttttccaccatttaggactaaataagtgagaaagtgcggtaaaaattcgcttagtttttttcaatgagatcaagatgttgtttcatccattgcataaaatcaggatccatcgttttaatcatattggaacctcgagtgattgtggcggcacttgtattcagattttgttgaatttcacgctgaggcatatttttatcaatcagctgagagacaatctgcaagcgtaatcctacagcatctcgttcgtctgcagttaataataaggttagaaattcctgtgctttgttttcttcaaaggcgatttttagcatttgaagaaatgcattccattgctctaaattacggctgatatacataattatgctcccatttcacactattaaactagtgcatttagtatagccgattcaattcttcttggctaaagatttgtgggttttctttattttgcaaaatttgatagtaaaaatcataagcgactacattttgcacataaccacgagtttcataaaaaggaatagatgcaacaaattcatctaatgctaattttccactcgcgcgacttaaccatttttctactcgatttgctcctgcattataagcggctgcaatcaatattcgattattaggatattttccattgagttcattcagatgtgcggtacctagcaaaatattattcaatggtttgaataaatcttgttcgccttgataaggtagttgattattctctgctgtcaattttgccgtacttggcaaaagttgcattaagcccctcgcatttgctgaagattgtgccattggattccaagcactttcttgacgagcgattgccatagcaaaagttttgctgatattcaaattctgtaatgcagcattgaagtattcagaataagcatttggcagacgaagagacaggtaaccccacgcttttgctacaatagaagcatcaacagctaattcaaaccattgctgatttttggcatattcagaaagttttagctgagttgtgaaatcaacattatcaagtaaaattcgccagcgttgttttgctaaaccatttcgtccaagttctcttaattctgtaatcattgcaaaaacttgcttaaaaggaagttgttcagcttgagtaaaacttgacgcaatagggacattcagttgatatgcttgttttaattgtgtagccgctaacattggataaaagccacgctcttttgaaagtgcggtcagttntttggtattttttaatatatcttgtttagcttcccaataacgccattcttgcttactttttgattcggcagatagcaaatttagccaagaggttaattcagtttttttgccaaatagccattcgtatacggcgttcggttaaattatcagtctgtaattgtcggatttgttcatcacgccatttttgaaatcagtgtttcattatcaaaaagcgatttaaaaggcgatttccactgtttgatttcatcttctgagagctgcagtatttgccatttttgatagattcaaacttatgttattcatttgttcaggagcgttttaagatacgtggaaagcatcattaatacggttttatctaaagtgttaggatcacttttcttacatttcagcagttgtttagattttcacctgattttggccttttggaacctgtattttcttaacatatctgaagtgctgaggttggtggtcgtatactgggaatagtttgtttaaggtagaatgctgtggcaaaagggtattttttgcatttccctggacttttattggtgggtgtttcttg

SEQ ID NO: 336 - DNA, 3906 bp, H. influenzae
  misc_feature (1106)..(1106): n is a, c, g, or t
  misc_feature (3878)..(3878): n is a, c, g, or t
tgtttccgaattcggactcggtaccctaccttacatccaaagccgctccgcctaaatgccccgtttttaacgcatcaactaaggcaagttcatcaatcaaaggcccacgccctgtattaatcaaaaatgcaccttttttcattttggataaggtttctgtattaattaaatcctttgttgtttccgttaatgggcaatgcaacgtcacaatatccgcttgttttaatacttcatcaaaaggcgtataaccttcacggcaaacagtagcatctttatgttctgcataaagcactttcattcccacggcattagccaaacgccccacttctgttcctaggcaacctttaccaaatacgcccaacgttgaaccgcgcacatctgtaattggataatcaaaataacaaaattgtttgctttccgcccattttgcttccgtttgatcgcgtaaccaacctgccaaactgtgttttaaagaaaaaatcagaccgattacgtgttctggcacggttgtactggaataacctgtcacattacgcacggcgatgcccatttcttctgcagccacaagatcaacattatttgtacctgtcgcagtaatcgcaatcagctttaattttggcagttgttgcaaagtttcacgatcaaaaatcactttgctggtaataacaatgtccgcatccttcgctcgctcaatggtttcggcagaagacgtatgatcatattcagtccaagtatgttcaaaacttgggcgaggaattgaaatatgtttaggaatagccgtgctatctaaaaatacgattttcattaattgctccttttttatatacaaagtgcggtcaaaattaaccgcacttttgatgaaatttaaattgaggtatccaattctggaaaagattttactaaatcatcgatggctttcatttgggaaacaaagccttcaagcgcagaaagtggcaatgcagaagggccatcacattttgcttgatttggatttgggatgtgcttctaagaataaacctgcaatgcctactgctaaacctgaacgcgctaattcggttacttgcgcacgacgaccactcgatgctgccccaaatggatcacggatntgaagtgaatgggttacatcaaaaataacagggctacccttagaggcttttttcattacactaaagccaagcatatccacaattaaattatcgtaaccaaaatttgttccacgatcacaaagaatgattttatcattaccacattcttcgattttttccacgatattgcccatttgacctgggcttaaaaattgtggttttttcacattaatcactgcgcctgtttttgccatcgcttcaacgagatctgtttgacgcgccaaaaaggcgggaagttgaataatatcgacaacatcagcaacgggctgacattgatagatttcgtgtacatcggtaataatttttaccccgaatgtatcttttaattcttggaaaatttttaatccttcttccatgccaggtccacggtaagaatgaatagatgaacgattcgctttgtcaaaagacgctttaaatacataaggcacgccaagtttctctgtcactttcacataagcttcgcacacttgcattgccatatcacggctttccagcacgttcattccgccaaaaagcacaaaaggtttgtcgtttgcaacatcaatattgccaatttttacaattttattttgcataaattttccttaaatcaatggaggggaaaagtatctttattaatctcgcctttaagttctaaaagttgcgtgcggataaacgccgccgttggatcttttggacaatgttccacaaaaaattctaaatctttcaatgctgaaggataagcccccatttgagctaaaactaagccacggtcacggatatgataaggattttcagcatcagtaatcattaaattcttaatatagtgatatgccatatcgttatgctcttcacgaataagcgcatttttcgccagttgctcaaagcgagaataaagtaaagaaagatcggctctatcaagttcttcgggttgaattttcgccccaaacccaaatgcaccttcataaagttgctgcaatttttcttgtgaaatataagtgccatcccaaggatcaataaaagccacttcatctctgacttcagcacgtaaaattaactgtgttgggaaatttactgggtaaattggcaaatccaatgcctcagctaaataaaacaccattgccccaagagtcactggcattccttgacgatgttcaaacacataaggcaaatataaattgcgagcataaaaataatcttctggatcgcaatgaaagccccaatcaccataaaatagctgtagtaactgatgaatctgctcttctttcggccaatctggcgaaatttttttacgcgctttacgcacaagcccacccatttttccccgaagttgtgcttctgagctgccatcatcagagataacaagataaaaatgcacaaatttatcgtataacgcacgtcgataatatttcattacttcttccaaaaacctaaagtgacacgctcattgtcgctataatcacgcacagtttcaaccatttcccaatgattttcttggaaaattgaccgcactttttctccttgttgccatccgtgttcaagcaataatacgccattagaattcaaataactcgatgctaattcaataatatgacgtaaatcagcataccctgcatcattggcaactaatgcagaaaggggttcaaaacgtacatcgccttgatgcaaatgttcatcttgcgcatcaatataagggcggattgctgacgataagatcaaacttccctgttatattatcaaaccaacggctctgcaaaaattctacatttagctgatttctttctgcattagattgagctaatgccacaacatcgggcataagatcaacaccaattatttccagcggaatatgccgcttttggcaaatgggctcaagctcggaagccaaagcgagggcgattgcgcctgtgccagtgccgagatcaagaatacgaaagtgcggtggattttcttccagtttttctaacgcaatttgtaatgctttttccactaaactttccgtgtctggtcttggaatcaatgtgctttttgaaacatttaatggtaacgaccaaaattctttttcaccaagaatataagcgataggttcgccttttagacgacgatctaaaagtgcggtcaattttaaccgcactttttcatcaatctcagtatcatcaaaagcaaggatttgcgtacgcgatttgccagtagcgtgttgaagaagcacaagtgcatcaattttactattttcagtgggatttttttgtgctaaatctacaatcgcttgtgccagccattctttataattcattatttttcgtcttttaacaccatcgtgccagccactaaatccgttaaagaacggcgatcatcacgcacaagtgcaacaataccgctaataatcaataagaaacttgtccatgccaataaaatatcaataatctcacgaccgatgtatttaccaaattcaacaggatgattggtatgataattaaatacgcgcaagcctaaccagcgttttgccattgtttgaccataagttttcatgaaatataactgaaaaccagcatatacaatcatccccactacaccggcaaaatcccccaatgcaaaaccgagaccagccatcacccaaagcacaagcccattaatcatactcgcaagccaacgtttaaaacggcttgcttgagcaggttgagaagatttgaaagcagaagaaaattcagctctttttattttcaatatcttttattcctttaaagtggggtctcntagagtcgactgcaggcagcaatctggc

SEQ ID NO: 337 - DNA, 2177 bp, H. influenzae
  misc_feature (2169)..(2169): n is a, c, g, or t
atccccagcttatcttgcagaacaaaagaaaagtgaaattaaagttgttgaaggcgtcaatgtactttatgcccttgcaccattaataccattagttattttagtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtagaaatagtaaaaaattgaccgcactttatttaagtgcggtctgtttttatagacttttaaaagaagaaaaaaatgaacttagatttaaatcaacttgttaaatggcgtcgtgaatttcatcgttttccagaaattggctggagtgaattttggacaacttctcgcattgcggattacttggaagacttagattgttttgaaatttttcttggcaaacaaattataaatccagactttgttcgtggacgaaaacaagccgtagtagataaaggcttagctaatgcaaaagcctatggagccaatgaaaaatggctcgaaaaaatggaagggtacactggttgtgtggcattatttgattcaggtaaaccagggaaaactattgcattacgttttgacatagactgtgtgaatgtaacggaaactcgctcaccagagcatattccaaataaagaaggttttgcctcaattaacgatggttttatgcatgcttgtggacatgattcacacattacaataggtttaggtgttgcattatggatcgctcagaacaaagataaactcactggaaaagtaaaaattgtatttcaaccagcagaagaaggtgttcgtggtgcagctgccattgcacaaagtggcataattgatgatgcagattattttgcttcttcacacattagtttttgcgcaaatacaggcactgttattgctaatccaagaaattttctttccactacaaaaattgatattcgctataaaggtaaacctgcgcacgcaggtgctgcgccccatttaggtcgtaatgctttattagctgcagcgcatacagtcactcaacttcatggtattgcacgccatggtgaaggcatgacaagaattaatgtgggtgtgctaaaagcgggtgaaggacgaaatgtcattccatcctctgctgaattacaattagaagtgcggggagaaaataaagcaattaatgaatacatgactgaacaagtcatgcaaatagccaaaggtatctccataagttttgatgtcgcatatgaaactgaaattggaggtgaagcagtggatatgaataacgatggtgaacttataaaactcatcgaagaaatatctcttaaacaaccacaaataaataacggaaattcagattatgctttcaatgcgggggaagatgcgactattttaggtagacgtggacaagaacatgggggcaaagctatttactttattcttgggggcgatcggacaggagggcatcccgaggctgaattcgcacgtggggggaatcaattacttactggggggtaatatttagcctgtgttgcggcgggcgctctttccctactgagcagaactgttgggcctccttcttgcaagaatccgcgcttctgttcagagaaaggggtgtgtggccggcctggtggggggctcgggggggtgcgggggggtgtggtttggctgggagcgcgggcggtggtgtggggtcgctcgccggtnggcggcgg

SEQ ID NO: 338 - DNA, 2702 bp, H. influenzae
tgcggaagaaaatgcgaaaggcattgatttaaaagcatcaacacgtacttataaagataacaatcataaacctgaaatgatgattgctttatctgatttctggttgttgcatggttttaaaaataaatcggatattatagaagcttgcaaaaaaattgcaggaacaagatttacctgatttttatgctgatattatgtaggcagatcaaacgctattgtaccaatggttttccccgattctgttagagaatcaagcagcttatgaggctaacaatcttgatttaattaatccagattattgggtgctttacactattgatgcgatgaatatttctttagataaattagatgcaggtttaatttgtttctatttgtttaatattgtacatctcaaaaaaggcgagggaatttcccaagatgctggcattccacacgcttatttgcgtgggcaaaatattgaactgatggcttgttcagataatgtaattcgaggtggtttaacgcctaaatatgtcgatattccagaattgcttaaaattgtcgattgccgtgaagtggagcctaaaattattccaacagcccctcaagacgcacgcatatttacttacgccacgccagcaaaagatttcgatttgcaaaatattcaatatgaatgtggcgaaacacatcatttaaaagcacaaagtgcgagtattttattagtaatgaaagggcagttaaatttacgctcagaaacgaccgcactttctttgaaacaaggtgaggttgcttttattactgcaaatgcttcttatgaagtggacggcttaattgaaggctatgcagtggtcgcaaaattgccttgataaagtcttaccaaaaaagtatagtcctcttaatcttttattaagatttatttgttttaatacacacatccaagcaatggtgcttgaaattaactaacttaaaaaggaaacgttatgaaaaaatttgcattagcaacaatcttcgcattagcaaccacttcagcatttgctggttttaatggcaataatagtcaaggtggttttcggcaaacagcgcctgctgcaattagcgtaaagcaagctttatatgcggctgataattcaatgattactttggtgggtaatattacacagcaaattgatgacgatgaattttggtttactgatgggacagggcaaatcaagattgaaatcaaaaaacgcgtttggaatggtttaaacgtagattcaaaggataaagtgaaaatttatggaaaattggataacgaagcctttgagaaagcagaacttgatgtattgcgcgttgaaaaagcagaataattatctttgaagatagcgggcgttagctcgctatttttgtctataaagtgcggtcaattttttatgagaattttattgatagaagacgataatctaatcggcaatgggttgcagattggtttaactaaacttggttttgcggtggattggtttaccgatggaaaaacaggaatggctgctttaacctctgcatcttatgatgcggtggtattggatttaaccttgcctaaacttgatggattagatgtattgcaacaatggcgatctaatcatcaagatgttcccgtattaattttgactgctcgtgatactttagatgaacgagttaaaggtttacaaagtggtgcagatgattatctttgcaagccttttgctttggctgaagtcgccgcacgtttacaagcccttattcgtcgtcgttatggatatcatcattctgtgatagaacaggctggtgttaagctagatcagaatcaacgttctgtttggctgaataatcaacccatttctttaacaagccgtgaatataaattgcttgaattatttatgctgaataaagattgcgtattgtctcgctcatccattgaagaaaaattatccagttgggatgaggaaattagcagtggcgcattggatgtgcatatttataatttacgccaaaaattggggaaacaatttattcgcacggtacacggtgttggatatgctttgggacaagttgaaaaatgaaaaatagaagccttacgttgcgtcttatttctgtgctttgtttaaccgcactttttgtttggctgggttctacgcttgtggcttggtggcaagttcgccacgatgtgaataaagtttttgatgcacaacaagttctctttgctgaacggctcgcaaattcagatttaagtactattttgttggaatctagcacaacgctaaataaaaattcacagtcggtattaaaaaaaagttatgacgatgatgccttagcctttgctattttttctaaaactgggaaacttttattcagtgatggacgaaatggaaaagattttatttttaattataaaacggggttttataatgcgaatatttatgatgatgacgataaatggcgaattttttggcgtatggcagctaatggagaattagttatcgcagtagggcaagaattagattaccgtggaagatttaattgaagaaatgattttggggcaaatgtggatttgggtttggccagttgcctatttggacattggtttaagaagggggattcataaagacttcgacccgattaacggtttaagcccagaacaccatcgaaaaatctgccggatgggctttgccgaacccgaggggtaccccgttcacatttccctttgaaac

SEQ ID NO: 339 - DNA, 2627 bp, H. influenzae
  misc_feature (1410)..(1410): n is a, c, g, or t
  misc_feature (2397)..(2397): n is a, c, g, or t
  misc_feature (2440)..(2441): n is a, c, g, or t
aattttcggtttatttaaacactttaaagtggtgggcgataccggtctcgacccagtgaccccctcctgtaagggaggtgctctcccaactgagctaatcgcccactagaagcgtttaaatataaagggaaagtttgagcggaaaggacactttagaaaagtggtgggcgataccggtctcgaaccagtgaccccctccttgtaagggaggtgctctcccaactgagctaatcgcccgcttggtcaaacttagtaacattaagaacactttttagagaagtggtgggcgataccggtctcgaaccagtgaccccctccttgtaagggaggtgctctcccaactgagctaatcgcccttaatgttgtgggttggcattatagggagaatgcattttcagtcaatacctttttattaaattttgtttaattgtcgtaaaaataagcataaaatccgcttttttatttagaagtcaaacaagtcgtagtagaataacgactaatattttattgaagataggttataaagatgaaactagatgctccttttaatttagatccaaatgtaaaagtgcgtactcgttttgctcctagccctacaggttatttacatgtaggtggcgcacgtaccgcactttattcttggttatacgcaaaacataataacggcgaatttgtattacgaattgaagacactgatttagagcgttcaacaccagaagcaacggctgccattattgaaggcatggaatggttaaatcttccgtgggagcatggcccttattaccaaactaaacgctttgatcgttataaccaagtgatcgatgaaatgattgaacaaggcttatcatatcgttgttattgtactaaagaacacttagaagaacttcgtcatactcaagaacaaaataaagaaaaaccacgttatgaccgtcactgcttacacgatcacaaccattcacctgatgaaccccatgttgtacgttttaaaaatccaactgaaggctcggtagtatttgatgatgccgtacgtggccgtattgaaatcagcaacagtgagcttgatgatcttattattcgccgcacagacggttctccaacttataacttctgtgtagttgtagatgactgggacatgggtatcacacatgttgtacgtggcgaagatcatatcaacaacacgcctcgtcaaattaacattttaaaagcgattggtgccccgattccaacctatgcacacgtttctatgattaatggcgatgatggtcaaaaactctctaaacgacatggcgcagtgagcgtaatgcaatatcgtgatgatggttacttacccgaagctttaattaactatctgtttcgtttaggctggggacatggcgaccaagaaatttttagtcgcgaagaaatgatcanctatttcgaattagatcacgttagcaaatcagctagcgcatttataccgaaaatttacaatggttgaatcaacattatatccgcgaattaccgccagaatatgtggctaaacatcttgaatggcattacaaagatcaaagcattgatacaagcaatggtcctgcattaactgatattgtctccatgcttgcggaacgttgcaaaaccttaaaagaaatggcaagttcaagccgctacttctttgaagagtttgaaacctttgatgaagccgcagcgaaaaaaacatttcaaaggcaatgctgctgaagcgcttgcaaaagtgaaagaaaaattaaccgcactttctagctggaatttacattctattcacgaagccattgagcaaacagctgctgaactagaagtgggcatgggtaaagttggcatgccattacgtgtcgctgtgacaggttctggtcaatcgccatcaatggatgttaccctagtcggtatcggcagagatcgcgtacttgtgcgtattcagcgcgctattgattttattcatgcacaaaacgcttaatatttaatcggataacaaacgcataataaaatcgtattgacagccacatagtcaaattttatcatgtcgctgtcttttatggggatatagctcagttgggagagcgcttgaatggcattcaagaggtcgtcggttcgatcccgattatctccaccaaattaataaagcaaggttatttaccttgcttttttattatcaataatcaatatcttagcgaattttaacaaaaataaaaactaaagcgtgctagaatagtgcgctttttattacatcgttcgaaatcatatcaaggaataattttgcgtccaaataatcgagaaaataatcaaccccgccaaattaaaattacccgtaactacccaagcatgctgaaggggtctgtgccttggtgaaatttgggacaccaaaagtgctttgtactgcacagntgaaaaatgctgtgccacgtttcttaaaggacaagggcagggnntggtaacggctgataagtggaatgtggcacgttcacaccatagtcgatggcaacgtgaggcggcttaaagtaaaccaaggtggacgcacaatggaaatcaacgctaaatgccccgtcttgccccccagggggggatctaagcactgggggaaccggcataccttaaaaaggggatgtatccaacgg

SEQ ID NO: 340 - DNA, 1883 bp, H. influenzae
  misc_feature (1454)..(1454): n is a, c, g, or t
  misc_feature (1507)..(1507): n is a, c, g, or t
  misc_feature (1597)..(1597): n is a, c, g, or t
  misc_feature (1601)..(1602): n is a, c, g, or t
  misc_feature (1700)..(1700): n is a, c, g, or t
  misc_feature (1702)..(1702): n is a, c, g, or t
  misc_feature (1726)..(1726): n is a, c, g, or t
  misc_feature (1728)..(1728): n is a, c, g, or t
ggtatcgaattcggactcggtacccttcacgttgtcatcagaatatcttcaatttctaccgcactttcatcgtcagaaatatcgtttgttaaagccagtttgataccgcgaacacctgttgctaaacgccccattgcacgcacggcattttcagcaaaacgcaccacgcgaccttgcgatgagaacaacataatttcgttgctgccatcagtaatatccacgccgattaattcatcttcgtcacgtaaattcaatgcgatgataccgtttgaacgtggacggctaaattcggttaaggcgattttcttcacaataccgccagcagttgccatgactacgaatttatcttcttcgtaagcagaaactggcaagattgcagtaatacgttcgttttcttgtaacggaagaatattcacaattggacgaccgcgtgcaccacggcttgcttgtggaagttgatatactttcaaccaatataaacgaccacggctagagaagcagaggatggtatcgtgagtatttgccaccagtaatttttcgatgaaatcttcttctttcatcttcgttgcagatttgcctttaccgccacggcgttgtgcttcatagtcagtcagtggttggtatttcacataaccttcgtgagaaagcgtcacaaccacgtcttcttgtgcgattaaatcttctaaatcaatatcgccagaagcagcggtaatttcagttaaacgatcatcgccaaattgtgctttcacttcttctaattcttcacgaatcacttccattaaacgttctgcgctacttaaaatatgaagaagatccgcaattttaactaataattcttcatattcttttataacttcttcaaacgcaatgcccgttaaacggtgtaagcgaagttctagaattgcgtttacttgcgctggcgataagtaatactgttcaccttgaataccaagattttcttctaactcatcaggacgagcggaaacatcaagaagattaataatatcgctatgtaatgtccaagaacgtgaactgattgctgttgcggcctcttcacggtttttagagttgcgaataattgcaatcatttcatcgatattagaacgagcaaccgctaaaccttccaaaatgtgcgtacgttcacgtgctttgcgaagctcaaagatagaacgacgtgtcaccacttcacggcggtgtaaaacgaaggattcaatgatttctttaagattaaataaacgtggctgaccgtgatccaatgccaccatattgataccaaaggtcacttgcatttgagtgagtgagtaaagatggtttaataccacttcccccactgcatcacgtttaatatcaatttcaatacggatcccttctttgtttgaaaggtcagtaatattgctgatgccttcgaattttttctcgcgaataattcggcaaatttctcgactaatttgctntattacttgggatggcaattcagacacgataatttgctcgcgtcctttttcgnttgggttctacgggtgcacgagcacgaacatatactttaccacgaccagtgcgataggcttcttcaatccctttacgaccattaattatnccanncgggtggaaaagtctgggccccggaatatgttgcattaattcatcaatggtaatttcatttggttggcaatataagccaaacaaccatttatacttcngnttaagtgggaggggggaagagttnantggcccttcccccccgcatacccgaagaacatttggttaaagtgctggataccgagttgcaatacatctggggatcattaatcgccttatagttttgcgagaaagggccggttctttatcccatcaggagcaaggctggggatttttttgtacga

SEQ ID NO: 341 - DNA, 2200 bp, H. influenzae
  misc_feature (2186)..(2187): n is a, c, g, or t
attcgactcggtacccttattgagcctgaattattaagaagagtaacagtagacaaaggaaattattctcctcaatatggtaatggtggttttgctggaacagtaaaatttgaaactaaggctgctagggatttcttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattttagaataaatagcccgattgaatctaatcgggctttatcataactataattaagcaaaacctaactataatgtccattatacaagattaatcataaatatacttttttgaaaaaaatttacagaaaatttatcttaatataggagatatattaagataaatacatcattaaagaatgtagagataataggtataatcccctatactaattttagtattctttgaagagcaaatttaaataataaatccaaaataaatacaatatctgaaattatagatgagggggatccccctagagtcganncctgcaggcatgc

SEQ ID NO: 342 - DNA, 2158 bp, H. influenzae
aatcgtcgcgatggattaacgggcagcgaacaaattttttgcgtgggatttaaagaattttcacgtttaaaacaagtaaatccagacgcacctgaagcgattattaaaggcacaatgcgtgcgatgaatcttgcgatgaaccgtgagattgaaagtttggaaaaccgagttccatttttagccacagtggcatctgttagcccttatattggtttattcggcactgtttggggaattatgcacgcttttatggcattaagtggtgcaaaacaagcaacgttacagatggtagcaccaggtatcgccgaagcgttgattgccactgcgattggtttatttgccgcaattcctgcagtaatggcttataaccgtttaagcttacgagtgaatgccattgaacaagattacggtaattttattgatgaatttacgacgattttacaccgtcaagcctttggtaaagcccctcactaaaaatagggaaaattgaccgcactttgaagaaaaagtgcggtaaaaataagttaaaattttagaggaatatatggctcgtcgtcagcgtaaagcaattaaatctgaaattaatattgtgccttttttagatgtgcttttagttttagtgttaatttttatggcaaccgcccctattattagtcaaagcgttcaagttgaattgcctgattctgtgcaaagccaagaggtttctaatgaagataaagtgcccgtcattcttgaagtggcaggcattggaaaatatgcgatttctattggcggagaacgtcaagaaggtttaacagaagaaatggttactcaattatctagacaggaatttgataaggataataatacactatttttagtaggcggagctaaagaagtgccttatgaagaagtgattaaggcattgaatttacttcatcttgcaggcattaaatctgtaggtttaatgacaaatcccatttagctaagtaggtaacacgtgcaaaataatcgacaaaagaaaggaatcaatgcttttgctatttctatccttttgcactttatcttgtttggcttattgattttaagttcgctttatcacaccgttgaaattatgggtggtggagaaggtgaaggagatgtaataggggcagtgattgttgatactggtacggctgctcaggaatgggggcgtattcaacaacaaaaaaaagggcaagcggataaacaaaaacgcccagaacctgttgtggaagaaaaaccacctgagcctaatcaagaagagattaagcatcaacaagaagttcaacgacaagaagagattaagcatcaacaagaagttcaacgacaagaagagttaaaacgtcagcaagaacagcaacgtcagcaagaaataaaaaaacaacaagagcaagctcgtcaagaagcgttggaaaaacagaagcaagctgaagaggctagggctaaacaagcggctgaagctgcaaaattaaaagcagatgcagaggctaaacgtttagctgctgcggcaaaacaagctgaagaagaggctaaagcgaaagcagcagaaattgctgctcaaaaagcaaaacaagaggcagaaactaaggcgaaactagaagcggaagctaaggcaaaagccgctgctgaagctaaagcaaaggctgaagcggaggcaaaagcgaaagcagcagctgaggcaaaagcaaaggctgaagcggaggcaaaagcgaaagcagcagctgaggcaaaagcaaaagctgatgcagaagctaaagcgaaagccgctgctgaggcaaaagctgctgcggaagcaaaacgtaaagcagatcaagcaagcctagatgatttctttaacggcggagatgttggtggcggtagtgcatctaaagggggaaacacaaataaaggtggaactcaaggtagcggtgctgcacttggctctggcgatggtggtaaggttgtggatcaatacgcaggtgtaattaagaaagagatcaacgtcgtttcttaaaagatccatattttgcaggaaaggtttgtcgtattaaattcaattaggccgagatggcccattcttgggggattaaaaaatttcaggctctgaggattttgtctcactgctttaaggcgggggttaaacgaaaaagttcccctgcgcctccgataaaatttatgc

SEQ ID NO: 343 - DNA, 1912 bp, H. influenzae
ataaaatattgaagatttagttggtaagaatagtattttctattcttacctttttatttcgtttttagaggtttttgatttttataattcttataaaagatatgaaattcttttataaaaataaggggagtttatttacattgatatttaaatagcagaatttattgtcctattacctaaagtaccatcatcaatcgcttcttttggcgtcccaataacttcggcgattttctctccatttttaaaaaacacaaatccaccattttccatttttgtccaagattcatctttggttaaaggaaatgttgtgatgatattgaccttatctcctgcttttgcataattgctaaaatcaattactccatcatcatcaatacggtgagctttgccaaaaggtgcttttcgcataacataatgtaagtttgttgagcaatgtgcaatcatccactcgccattagaaagaatgaaattaaacgtaccgtgttgagcaagttcttgtgttactttttgaattgcttcaaaaatttccatttcacttggttttttgcggaaagtatttttaagatactcagccatataacagaaagcagcttcagaatctgtagaacctattggctgtaaaaaatgatctgtcatatctggtaagttttttaaattaccattatgtgcaaaaacccagttttgtccccaaatttcacgaatgaacggatgggtgttttcaatattgacttcgccttgtgttgctttacgaatatgcgcaatgacattaagagatttaatattatattgttttacacaatctgcgatgggggaaagactggctgtttgattatcacgaaaaatacgtacacctcgtccttcaaaaaaagcgaccccaaagccatctgaatggcaatctgttaaacctgcgcgacgacggaaaccttcaaaagaaaaaacaatatccgtcggcgtattacaattcattccgagtaattgacacataattttaattagatataacctcacaatatgtgagtgatttaacaccattatagggagaatatcaagagagatttaatgaatttttatgttgtatagatattaatgatagaaatggtatttaatctattattttttattaatattctttatttttaaagaatggtaaaaaccactgatatttgaaaagtcattgcttagatagaattaacctcctttgcaatttaaccaagttacttgcttgccttgttgattcttgtagtaaattgaactttgagatcgcacgattaaatctacataacttccttgaattggatcatacgaacgataaatcgcttcaaattttgtaccacgggtattgagtgttagcgtatataaatgatcaaaaggtatcgctttgccattatctaactgaaaataaaaactaaaattttctttcatacggctttcacgcgacagagggaaataagtcgtcaaatgagaaattcccccagtttctttattattacaacgataatgatatggcttgtaattaacagaattatttaactcagtttggctaatattattctttaaaaatcgagatttaaccgttttcttcggctgatgtattgtggtacaagcaaataaactcacaagagccccaacaaacaatgccatctttaatttattcataaatacaaaattcggagaaataagaggcgcgtatgatagcggaaattggggactgtgcaagggattggaatgagactaaaaaatgcaataaaaactggaaatgtaattccaaatacatacaaaaaaataaaatatggaaattaacttccaaaccttgtacactttttacaaatatgaaattaacttccaatgagtaaaactatgtctctcgtgaaaattattcagcaatgatcaagggacgagccgaatcgaacag

SEQ ID NO: 344 - DNA, 1949 bp, H. influenzae
  misc_feature (1837)..(1837): n is a, c, g, or t
  misc_feature (1930)..(1930): n is a, c, g, or t
aaatccagtaagaaattttccagccattcaataacttccacatccaagtggttggttcatcaagtaataacacatcaggatcgcataccaatgcacgtgctagtgccgctttgcgtaaccaaccgcccgaaagtgcggataattttgtggttcgattttgcattatattgcagaaattagaaacgaatgtggtagttatgcttctcacggtcaagatatagaacacaaacaaataagtagtgatcttgctttatttgtacttcattcaaccaatgcaattttaggatttattctacacttttacattgctacaaatgattaccgtagaagtgaaaggatacaatatgaagataatcaaagaatcaacgaattaattgatgaggcgtatgaaatggaaacaatatataaaatttcatattcacaagcattatttgctcaagatcctgatacctatagagaaatggtattggagtttgagcaaatagaatatgaacggttgatggacacgctctaatttcttacaaggttcatttcacctatgccaaatttcccctaacccctctttgctaaagagggggactatttggaatgtttagctgcaagcggtcgaattaacagaaaaattattcatgaaaacacctaaactaaaactacgctcaagaccattcccctcttttgtaaagaggggttaggggagatttaaaccacacactaaggaactcatcatgctcaacgaaaacgatatcgaacaactcactcttcaacgcctgcaatccctcggttgggaatatcgctacggtaaagatttgcctgttcattagataactgagttagatcctgttgcaagatcgatgatgcggaaaattaacgcggtaggtttcacaatatactggctctaactcaatggaaagtaactggcgaaatccagcataatcaaatcctagagaaagaccgccagcaccagaaaataaatcgagataagttaatgacatataaaattaaaataataaaaaacgagagatattgtatttcagatagagcctttaacacaagcaaccaagcttacttaaaaaacactaaactaattttaatccacgaaactgtggataaccatctggttatattccacttcccattatatttcgttgttttttatgataaacaagtagcccctaacctttcacttaatctttcaataatttaattttttcaatcacatttgttgttgaacaaccattttcaaagtttagcactttaacatcgccaccgtttgcccaaacttctttactgcctgcaatctcttcgggtttgtaatcgccacctttgactaaaagatctggtagaatttcgccgattaaacgttgtggtgtatcttcagtgaaaggcaccaaccagtccacggatgccaaaccagccaataccgccatacggttttcaagattattaattggacgactttcgccttttaagcgtttaacagaatcgtcgctgtttaccgcaacaattagacgatcgcccaatttgcgtgcattttctaaataagaaatatgccctggatgcaaaatatcaaaacagccattagtcatcacaattttttcaccgcgcgctttagcttgtgcgacagcatcttttaattctgcttcactcataatgccaaatccagtttcaggacgagcatgaatcgcattttcaagttccacgggcgaaacggtttgaagtccccaatttacccaccacatttccagcggctacattggctaagtaacaagatttctcaaaagacgtccatctgctaatgcgggtgctaatacgctatgacgggggcaccggctccggnccataaacactttttttgcacgggggggcaatgtaagggtcttgattgggcgaaaaatggatggctttttcaaacccggtaccaaaggggggnaattcaattaaaaaatatt

SEQ ID NO: 345 - DNA, 2891 bp, H. influenzae
  misc_feature (2817)..(2817): n is a, c, g, or t
  misc_feature (2839)..(2839): n is a, c, g, or t
  misc_feature (2854)..(2854): n is a, c, g, or t
  misc_feature (2857)..(2857): n is a, c, g, or t
ctggtatacgaatatcggactcggtaccctatcataaagttttatttaagcgaacccattctccacgaactgcacgatgttggaaaagataacggtaaagtttgtcattgtcttgagtatagtcttgttgattggtcattgattattcctaattgagataaaaagtgcggtggttttttccgcactttttgtttttatcatcttatttaagtgtttttgcttataaataggtggtacttagaggcttgtaaaatccaatgtgatctctaagttataatattaattaagcaaatcttgttttggcttctgcaatagcttcggcaacacgcaatggcgatacgccaccttttgcacaacgtttgtctaagcaagattggagagaaagaatctcgtaaacgtcatctcccactacttcactaaattggcggaattcagggatagtcagatcttctaatcctttgcctttctcgattgcataaaccactgtttcgcccacgatatgatgggaatctcggaaaggtacgcctttagagactaaataatccgctaattcagttgcgtttgaatatccttttaacgcagcttcacgagtacgttcaacatttactttcaattcatctaagacgaacgttgccatatctacacagttttgccaagtatctaaggcatcaaaaatgccctctttgtcttcttgcatatctttattatacgcaagtggcaagccttttaaggtgattaacatagatgttaatgaaccaattactctccccgttttgccccgaattaactcacaagcatcaggatttttcttttgtggcattaatgatgaaccagaagtcacacgatcggatagttccacgaaatttgcttctccgctgttaaagataatcatatcttcagcaaagcgggaaagatgtgccatactaagagaggcgatagaaagtaattctacgatatgatcgcgatcagagacgctatctaagctatttctagttgcgaaagcaaaactaagatcgtgcgcaagtgaatcacgatctacagcataagccgtaccagccagcgcaccactaccaagtggacaagtattcatacgattatacgcatctgttaaacgtgaatagtcgcggtcgaacatttccacatatgccatacaccaatgggcaaaagtgattggttgagctcgttgtaaatgggtgtagccaggcattactgcttgctgtgtgttttctgcggtttgaactaagtggcggtgcaaattacgcacggattcttgtaattcaaccacacgctgtttgcaccacagttttatatctactgccacttgatcggtgcggctacgaccagtatgtaattttttaccaaggttgcctactttatcaattagcttactctcaacccatctatgaatatcttcagcatcatcttgaacaattgcttgcggaattgaccgcacttcacaagtaattcatttagtgcttgctcaagtggatgctgttcttcacagttaatacatccacttttactaggcccttggaccagccattgagcctgaatatcctgttctgcaaacgatagtcataacgtgatgaggcattaaaactttaaaacgcttatctgcggcttggtaaaacgcccaccccaaagtgccataatttttcctttttgttttaattaattattctattattgtgcatatttattcataaagcaatattctatattaataattaacaaaaatggccaaaatctttcattttgtccattttatttgtattagtgctatttatagcgtttttgccaaatttttgataaaggatttaaattctttacctaatttttcgtgacgaataccatattctacgaaagcttccatataaccaattttatcgccacaatcaaaagtttcccctgtcatatgaaatgcttcaacggtttctttttcaatgagcatatcaatagcatcggttaattggatttcatcgccaacaccaattggtgttttttctaacaaatcccaaattgctgctgaaaaaacataacgcccaaccacagcaagatttgatggtgcgtcttcaatagaaggtttttcaacaatactattaatttttgcactttcgccgccattaagctcaatgccaccacaatctgcaacaccatagctactcacattttcttgcggaactggggttaccataatttggcttgcgccagtttcattaaagcgttgaatcattgcagcaagattttcttttttctgatctgcactaaattcagctaataatacatctggtaacataacggcaaaagattcatttcctactaaaggacgaccgcataacacggcgtgacctaaacctttcgcattaccttgacgaacgtgcataatggttacattttttggacagatagaacgaacttcttctagaagctgacgcttcacacgtttttccagcattgtttctaattcaaaagatgtatcaaaatggttttcgatagcattttttgatgaatgtgttaccagcacaatttcttttatgccagcagctacacattcatttaccacgtattgaattaacggtttatccaccaaagtgagcatttccttcggaatcgccttcgtggcgggcaacatacgtgtgccaagaccggcgacaggaataattgctttcatattattatatccattgtttaactaagaggaacctaaatagggttcatctttcgtttgtttaattcgttggtaaatttcttctcggtgaacggatacttctttaggtgcttcaacaccgagtttgacttggtttccacgtacactcnaaaaccgtgatagaaatatctnccccatgaggggatnccntaagagtcgacctgcaggccatgccaagtctggc

SEQ ID NO: 346 - DNA, 2055 bp, H. influenzae
  misc_feature (1819)..(1819): n is a, c, g, or t
  misc_feature (1866)..(1866): n is a, c, g, or t
  misc_feature (1899)..(1899): n is a, c, g, or t
atttaaataaacgtataaacggaagtaatgtgcgcattattggatatcctgttgtcgttgagcgagtagttcagcaaagaaaccttgatgttgtaattcggtaaatttaccttgctgtactatttctcctcgttgcatcacaaaaatttgatcacattgtttcaaatcttcaattcggtgtgtaatcatcagtgtagtttgatgctgacttgcttcattcaatgcttgtaaaacaagattttctgattgcgcatctaggcttgcggttggctcatcgagcagaagtaaatcgcctttgcgtaacaatgcccgagcaatggcaaggcgttgcgcttgtcccacagaaatgcctaatccaccatcttttatttcgtgatgaagtccaagtttatcggtaaattctttcgcttgagaacgcattaaagcttgattaatttcttcatcgttggcttgaatattgccaagtagtaagttttctttaattgtgccttgtaataacaatggattttgtcctacccacgcaatatgtttgcgccagtcagctagattactttcgcgaagttcttgcccattaattttgagcgagccctcataaggtaaaaagcccagaatcgcatttattaatgaagtttttcccgcgccactttgtcctacaagcgcaacattatgatttgctggaatttggaagtttaacggcttggttaatgctgaaccctgtgtcgaaagcaccactaaattttcggcagaaatttcaaccgcactttctaaagaaattgttttttcattttgatgtacagttaaataatcagattctaaaaaatcaacaatggcatccgctgcaccaatacctgctgcacggtcgtggtaataggtgcctagatcgcgtaagggttgataaaattcaggtgcaagaattaaacaaaagaaacctgtgaaaagtgtaagcggtgcattataggtaccaaattcaatttgacctaagtagctaaaaccaaaatagaccgccatcagtgcaatggaaatagaggtaaaaaattccaatactgcagaagagagaaaagcgagttttagcacatccattgtggtttcacggaaatcttcagtggcattttcaatatgctcagtttgttcagaagtgcggttaaaaagacgcaaggtttccaaaccgcgtaagcgatctaaaaattgggcactgaggcgagaaagggtatccatatttttttggctgttgtcagccgcagcaataccgacaatgatcataaacagaggaacaagcggtgcggtaatcattaagattaagcctgcagcccagttcaagggaaatacagcaatgaaaataaccactggaacaatggctgaaagactttgttgaggcagaaaacgggcatagaaattatgtaagttttcaacttgttccaacataatgcttgcccaacttccagctggtttttgattgattgtcgcagggccgacaagatgaattttatccagaattttttgacgaatatggttgcgtaataattgtccgctttggaaacctatttttttcgcgtgcccataaaataatagcacgcatcccgaagccgataattagcccgagaaaataaggaataagttcatcacgaggcacattttgcataatcagtttatcgagcaacgtcgcaagaaaataagtttgtgcgactaaaatgaatgaagaaagcgtagctaagacaatgtttgcacgcattaattttttgataggttctttgttgtgcgcgaagcccattttgtaaatattttggccgaaagttattccattggttgggccgggatatanaaaaaagttcccctcttaaaagaagttaaagaggggaaattggttanaagaattatgcctcctgagcattaaaaaacgtnctgcatccaaggctggataccaccagtcccgcgggaggggagggttggcgatatttgggatccataattcgcctgtgggaacccgcttcccaaaaaggggggtgcattccttcgaacagatttacacgattagcctttttattctattgccttgaa

SEQ ID NO: 347 - DNA, 2215 bp, H. influenzae
gccagacttgctgcctgcggtcgctctaggggaccccacaaattatcagaaaaaggtgtaaatgtattttttcgtgatctttatgaaatgaatttcaatccaattttatctcatgaagaattgcagaatgctaacaaaggtattattccagaagatattcagcaagagcatgattttattcttcaagcagatttaattacgttggtttatcccctttggtggatggggttcccagcaattttgaaaggatatttagatcgcgtattaagtcacggttttgcctataaaacggaaaacggcgaatcagtggggttgctaaaaaataagcaaatgcagcaatttattacgattggcagtaatgttgatcaatataaagaatttggtgtggataaatcgcttaatcattgtttgattaatggattattcaattattgtggaattgaaaatgtcgagtttgaattatttggagatattcatttaattgatgatgaggctcgtaaggcgatgattgaacttgctgctcaaaaaactcaagcaaaattgaccgcacttttaaaggaaaaagagtaatgtctgaaaaacaaattaataatttttcattaattagtcgattattcggtaatcttttttatcgttctccaacagataaagtactcgctgacgcatttgtttggttacaacaaaaaggtttgagtcaagtttgggcgttagatactgataaagaaagtgaattagcactgaatagcttgcaagttaaaatcgatctcaatttattgaacgaagagtatcaaaaattatttggtgcgaatgggaaagtgatgacggctatttcagcttatggcattgatgttgaagaatttgtgaattttcgccttgtacgcaatatgccagaggtggaaagtgcggatcattttgctttattattgctcactgcttcttggcttgaagataattcggattctttagtggctcaacaagaattctttgaaacttttttactgccttgtgcagcgaagtttttaactcaagttgaaacgcaagcaactttgcctttttatcgtgcattggcccttcttacacgagaaatattggcagcgatggcggatgaattggaagaagagtaggcaatattttgctttcctctaagtcttgaggaaagcaagcaatattttatagataggttacaaaatcttttgtatcaataatacggcattcacgttcggctttctccatacttgtgccaatcatgactaacgcaatcacacgatcttgttcacgacatccgaacgcttctcgtaatgcagtgccattaacccatttccctgaaatccacacattatcaaatccttgtgcttgtgcagccagttgtaatccataagttgcacaacctgcactcaacatttgttcccaatctggcactttagcgatagttggatcgatttttgctaccacgccaataaccataggtgcgcgatgtgctaggttttcggctttcatcaatttttcttccccaagatcaaattctacaacggcagctttaagtagcgtttctaatttatttaagctctcattttccattacaataaaatgataaggatgtaattttccgtgatctggcacacgcattgctgcttcgaaaatacgctcaagctgttctgcattaggtgcaggtacggtcaattttttgtttgattttcttgtggttaaaagtgtaagtgcatccattttattatcccttataagtaaaagtgcggtggattatagcatagtttttgacaaggctttgtgatacgctagtacaaattttttaaaggtaatttgtatgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattatttgaaggggcagatttacccgctgggtaccgagtccgatattcgtatacca

SEQ ID NO: 348 - DNA, 2363 bp, H. influenzae
  misc_feature (1537)..(1537): n is a, c, g, or t
  misc_feature (1709)..(1709): n is a, c, g, or t
tggtatcgaattcggactcggtaccccgcgccgcggattttttgttctgcagcataaaggatgaaaatctttctgaaaaagattaaccgtaaagaacagaaaagttttagtgggcaatgatttagtcttaatcgcaccagcaaaaagtgcggtaaattctgtggatattgcaaaaggtgaatggatcaatgcattaaaagatagctatttatctgttggcgatcctgcacacgtacctgctggtcaatacgcagcagaagcattaaccaaattaaatttatgggataaagtgcaagatcgtttagcgcgtgctaaagatgtgcgtggcgcattagctttagttgaacgtgcagaagcaccttacggtattgtgtacagcactgatgcaaaagttagccaacaagttaaaacggttgcagtgttccctgcagatagccataaaccagttgtttatcccgtttctattgtaaaaggtcatgataatgcggattctcgcgatttcttgaaatatttagaatcagatgctgcgaagaaagtgcttgtagggtatggtttctctgcaaaataagatagaatcttaatagtcatgaagggcggatatttctgcccttttgttattatagagcatcttacctctcatcaatgtgggatattcccataaacaagggatttaaagagaggctatttagataaggattcattttgcttacccaatttttttcatttttcaatctgacgccaatggaaatctcagcaattaatttaagcctgagtgttgcagtcagttctatgctttggagtttgccgttagccatttttgtggcgtggctcttagcgcgcaaaaacttctatggcaaatctctgattactggcgtaattcatttgcctttagtgttgccaccagtggttatcggttatctattacttgtagcaatggggcgcaatggtttcattggcaagtatttatatcagtggtttggcttatcttttggttttagttggaaaggtgcggtgctttcctctgccgtggtggcctttccattggttgttcgcgcgattcgactttctttagaaaatattgatattaaattggagcaagcggcgcaaacactcggtgcttccgcttggcgtgtattttttacaataaccttgccgctttctttacctggggttttagctggactcgtgcttggttttgcacgatcattaggggaatttggcgcgaccattacctttgtatcgaacattgcaggcgaaactcaaacgattccccttgcgatgtattcttttattcaaacacccgcagcagaagaacaaactgctcgcttatgtttatttgctatcattctttcattgatttctttgttactgtctgaatggttgagcaagcgaatgcagaaaaaattaggacaaggaaatgttgcaaattaatgtgaaaaaacagctcgggaaacttgccttgcaagcgaatatacaagtgccagatcaaggcgtaaccgccattttcggtttgtctggctcagggcaaaccatcggntgataatctagtcagtggattgatacacccaagatgaaggattcatccgtttaaatgcccgcactttagtggatatggaaagccaagaatcattgccgaccccacttgcgtaaaattggctatgtattccaagatgcgcgtttatttcctcactacactgtgaaaggtaatntgcgctatggcatgaaacatgtctcgcaagatgattttaactatattgtcgatcttctcggtattactcatttattaaagcgttatccgcttacgctttctggcggagagaaacaacgtgtggcaatagggcgtgcgctgctgactgatcctgatattttactgatggacgaaccactttctgcccttgatgttccccgcaaacgcgagctaatgcaatatttggaacgtctttctaaagaaattaatatcccgattttatatgttacacatagcttggacgaactgttgcgtttagctgatcgggtcgtattgatggaaaacggcattgtgcaagcctatgacagcgtagaaaaaatttggaatagccctatttttgccccttggaaaggggaaaacgaacagagcagtgtacttgccttgcctgttcatttgcataatccaccttataaaatgaccgcactttcgctaggcgaacaagcactttggattcatcaagtacccgcgaatgtaggcgagcgagtgctagtttgtatttatagttcagatgtttctatcatactgcaaaagccagaacaaacaagcattcgtaatattttacgtggcaagattacacaaattgagatacaagattctcgagtggatcttgccgtat

SEQ ID NO: 349 - DNA, 2790 bp, H. influenzae
  misc_feature (503)..(503): n is a, c, g, or t
  misc_feature (518)..(518): n is a, c, g, or t
  misc_feature (568)..(569): n is a, c, g, or t
  misc_feature (622)..(622): n is a, c, g, or t
  misc_feature (719)..(719): n is a, c, g, or t
  misc_feature (726)..(726): n is a, c, g, or t
  misc_feature (2762)..(2762): n is a, c, g, or t
tggatcgattcggctcggtaccctaaagaaagagatcccatatagcttgagcatttgcatgtccctgctccgccgctttgcgaaaccacttcaccgcttcggtataatcttgtcttacaccacgcccttcagtataagccaaacctaaataagcctgagcatttgcatctccctgctccgccgctttgcgataccatttcaccgcttcaaaatcatcttgtttgacgccttgcccctcagcatacatcacgcccaaattaaattgaacatttgcatctccctgctccgccagaggtaaccaaagtttaaaggcggtttgatagttgctttgctcataagcggttaaaccttgttggaattgctgttccagcgtatccgcccaagcggtggattgaaaagataatacagaagcacctaaaagtgcggtggtaagaagtgtttttgtgagtttcattttgttttcctattaaattgaatgaatggataatcttttatttttattncactaaattgggctntgaaccatgatgaggaacttgcaaaccataaacccaatgaaaggcttggnngcgtctccacttgaatacgcccacttgaaaataacccttgccctacattccanaattcgcattgtaaaagtgggcattagagctcccctctatttagcttgccataatattcgcagccattttgattaccattatcacaagccttaccanaccattncttggctaaagaattatttacttgacacctctttctcctaaaagatataagaatcccaatatagcttgagcatctgcatctccctgctccgccgctttgcgataccagttcactgcttcaaaatcatcttgtttgacgcctcgtcccttagaatacatatggcccaaattaaatttagcctctgcatatccctgctccgccgctttgcgaaaccacttcaccgcttcaaaatcatcttgtttgacgccttgccccttagcatacatcacgcccaaattaaattgagcctttgcatatccctgctctgccataggtaaccaaagtttaaaggcggtttgatagttgctttgctcataagcggttaaaccttgttggaattgctgttccagcgtatccgcccaagcggtggattgaaaagaaaatacagaagcaccgaaaagtgcggtggtaagaagtgtttttgtgagtttcattttgttttcctattaaattgaatgaatggataatcttttatttttattcactaaaattggctttgaaccatgatgaggaacttgcaaaccataaacccaatgaaaggcttgggcgtctcccatttgaatacgcccacttgaaaataacccttgccctacattccaaaattcgcattgtaaagttggcattagcgttcccctctatttagcttgccataatattcacaacccacttgttcaccattatcacaagccttaccaaaccattctttggctaaagatttatttacttgaacaccttttcccgaaagatatgagaatcccaacataacttgagcacctccatatccctgctccgccgctttgcgatgccatttcaccgctttgaaataatcttgttttatgccaagtcctccgtcatacatcatgcccaaaccattttgagcctttgcatttccctgctctgccgctttgcgaaaccacttcaccgcttcaacaccatcttgttttacgccacgtccgattgcatacatcgcacccaaatttaattgagcatctgcatccccctgctccgccgctttgcgataccagttcactgctttgaaatcatcttgttttacgccaagtcctctttcatacatcatgcccaaaccaccttgagcctgtgcatctccctgctccgccagaggtaaccaaagtttaaaggcggtttgatagttgctttgctcataagcggttaaaccttgttggaattgctgttccggcgtatccgcccaagcggtggattgaaaagaaaaaatagaagcaccgaaaagtgcggtggtaagaagtgtttttgtgagtttcatttgttttcctattaaattgaatgaatggataatcttttatttttattcactaaaattggctttgaaccatgatgaggaacttgcaaaccataaacccaatgaaaggctggggcgtctcccatttgaatacgcccacttgaaaataacccttgccctacattccaaaattcgcattgtaaagttggcattagagctcccctctatttaacttgccataatattcgcaaccattttgatcaccattatcacaagccttaccaaaccattctttggctaaagatttatttacttgaacaccgctttgtcctaaaagatatgagaatcccaatatagcttgagcatttgcatatccctgctccgccgcttggcgataccacttcaccgcttcaaaatcatcttgtttgacgcctattcctcttgcatacatcacgcccaacatcaattgagcctctgcatttccctgctccgccagaggtaacaaaaatttaaaggtggtttgataatcgcctctcgtagtggcttcagaaccttgttggaattgctgttccagcgtatccgcccaagcggtggattgaaaagaaaagatagaagcacctaaaagtgcggtggtaaaaagtgtttttgtgaatcgcatagaaatcgtccatttattaatcaacaattgaaacaaccaaacattttttgtttagcattatgttttgttgtaggggtctcntagagtcgaccgcaggcagcaagctggc

SEQ ID NO: 350 - DNA, 1963 bp, H. influenzae
  misc_feature (607)..(607): n is a, c, g, or t
  misc_feature (701)..(701): n is a, c, g, or t
aaaaatttcgttatatcgatcgcatcaaaacacaaaaaggcgaaatactgcaaaccagttctgaaatttacggaaaatcgaatgaaaactggcaaaatcaaattggtgatattttagagaaactgttgcctgctgggtctattagtggtgcaccaaaagaaaaaaccacacaaattattcaacaagcagaaaaacaaaagcgcggttattacacgggaatttttggcatatttgatggcaaaacactacaaagtgcggtagcaattcgatttatttctcaagtagatgaaaaattttattttcatagtggaggcgggattaccattcatagcaatgcgcaagatgaatatgaagaattattagaaaaagtctatttaccgattgaaggtgctgattaatgtatcctctatttgaaaccctttgtattgaaaacgggaaaattcaaaatatcgatttacaccaagcgcgatatgaacgtagtttgcgtgaatattatggcaaaagtgcggtgaaaatttttaatcttttttcccttattcaactgcctgaagatttacaaaatcaattagttcgctgccgcattgattacaatgccgaaaccacacanattcaatattttgaataccaacgaaaaatctaccgcacttttcacctgtaatttgtgatgacattgaatatagtttgaaatatttagatcgcangtttaattaatacattatttgctcaacgtggtgcttgtgatgaaattatgattatcaaaaatggaaaagtgacagattgttccatcggtaatttaatttttcgccaaggaaaaaaatggtacacgccagacacgccattgcttttaggcacacaacgagaaaaattattacaagaagggaaaattcaagaacgcacaatattccaagaagatattgtcaattttgatgaaattaaaatcattaacgcaatgaatagcttataaaaaataagccgactgatttagtcggctctagttatcctattatttttcagcatttttcaataattctgcgtgtgcttttttctgttctttcattttcgtactcgcttcacggcgttgcttagaaagttcagcattgcgaattgtataatcatccacacggctttcataatcatcacgcatactttcaataattccgcgtacttctgcaatagtcatatcatcacgaatatattgatttaaattatccaataacaatatgcgtttttggttatcgcgaatcttacgattattgtcttccatatctcgtttaattctattttttaaacgatacatacgcacgtattccaacacttcttgaaaagattgtttattcacaatttccataacaactccctttaaaataaataaaatgactgtgccgtaatttagcttttttttaatcaatcgtcaaaatttaccctctattttatgaatgatagaaagaatttttttgatttcagtaaaaagcattgattatcgatttttgtagtgataaaaaagacatcattattttcataaaaagcaaggaaatacaatgtcacaagtctttaattttagcgcaggtcctgcgatgattttcccagaagtgttgcaaaaagcacaaaatgaacttacaaactggctcaatcaaggtgtttctgtaatggaagtaagccatcgtggaaagtattttatggaactcgttacccaagcggaaaaagatctacgtgaggtttacaatattcctgataactatcgtgtacttttcttacaaggtggcgctcgcggtcaatttgccgcaattccgatgaacttaatcggtaaaaaaggcaaagccctttatttaaatagtgggcattggtcagctacagcggcaaaagaagcaagaaattttgcagaaattgatgaaatcactatcgtagaaaatggcgaacagactcgaattaccgatcttgattttagccatatcgctgatcaata

SEQ ID NO: 351 - DNA, 2244 bp, H. influenzae
aaagaatttttcttaaggcgggttttgatcggcctccaaaaagatatgtttatgcttcccggctggggaaagaatatgaaaaatgcgcgcaaaattcccggcacttctccctaaaattcgagatggtccctttattggaggatgccatttcaaggccgtgaattggcgtttaaattagggttaagtggtacgcaaaacaaacagttacagaatatctttatgggcttatctcgtttgtttttagaaaaagatttatctttagtggaagtcaatccacttgttctaactaaccaaggctatttggtttgtctcgacgccaaaatatctgtcgatgataacgctttatttcgccataaagatctcttagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgaaagagcgggttgctgaagcgttcaaaatcattttaaccgatccttccgttaaagtgattttagtgaatatttttggtggcattgttcgttgtgatttgattgctgaaggcgtgattgctgcagtaaatgaagtgggcgtgagagtgcctgtggttgtgcgattagaaggaacgaatgctgaaatgggtcgccaaattttagcgcaaagcgacgttaatattcttacagcacagagtttacaacaagctgcagaattagctgtgaatgcagcaaaaggagaacactaatggcgattttaattgataaaaatactaaagtgatttgccaaggttttactggtggacaaggggcttttcattccgaacaagcattagcctacggaacgcaattagttggtggcgtatcgccaaataaaggtggaaccactcatcttggtttacctgtatttaatacagttcgtgaagctgtcgaaaatacgggggcaacagcgacagttatttatgtgccagcatcattttgtaaagatgccataattgaagccattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgttactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaaccgcactttagttttctaaagcgtagattggctttctacgcctttatttttatatgctcgccattataaagtgagcacaaaattgctataatcagcgcacattttttaaggaagaaacacatgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttgggtgtgtagcgatttgtcgggaactttcaacttatgcaacggtaaataataccgcttatcgtttgattaaaaataatacgcccagggcgttatacttttattcttacagcaacgaaagaatacctcggccgtttaatgacatcaaaaccgtaaaccattggtttacgcgtaccaaataataaaatgctttagatta

SEQ ID NO: 352 - DNA, 1963 bp, H. influenzae
  misc_feature (30)..(30): n is a, c, g, or t
  misc_feature (33)..(33): n is a, c, g, or t
  misc_feature (36)..(36): n is a, c, g, or t
  misc_feature (48)..(48): n is a, c, g, or t
  misc_feature (1684)..(1684): n is a, c, g, or t
  misc_feature (1715)..(1715): n is a, c, g, or t
  misc_feature (1758)..(1758): n is a, c, g, or t
gccatacttgctgcctgcaggtcgacttcnagnagnatccccccgcgnataacctaaggctgcgattaagaaatattctgaaattggccgcactttggataggttgtttacggcggcggaggttaaatagattgtaataatccgcttgttgctgttcaaaatgaggcacgtttcccaccattggggcaagatctcttacagagcagcggatgcctacacgagcgagattatctgatgtattcacatcttgagtccaaggttgggcgatattttgttggagtttttgttggttttcttgttgttcttgttcactaaagtggcgatcaacattatcacgaacatggcttgcgccgatgcaatgtgaggtttttaattgattggctggagtaagatagccatcataacaaagcacagatttcagtttgagtaagttttctgatgttggaatttggctaacttgcccgcggatagggtagagcggtagcttttctgtttgaacaaaatcagtaattttatatccgttcgcaagaatgacgacttcatggcagtatttttgaccttgcgtattttctagttcccaacctttttcttgttgagaaagtgcggtaattttttgtgaggttttaatgattacaccttgcttttcaagaaatgaaaaggcattttgaacaaattgtcttggtgcaagccaagccccttgttcaatccaaccgccttcgcaattaagcggtaatcccactttttcactgagttgttcagcactcagcatttggaagatttcgttcggtaaaccaagttgagaaatctttgttaatttaaccgcacttttttcgttgtaagcacatagtgccacgccacaaaattcgtgctcaaactctatgtttgttcgatcgcccaaatcaagtaattggcgaccgtagctaaaagcgtgcaggtaaaaatcaaccggtgagcgcattatcatcgctaagttgcggataaaatgcgccttgtttattgcctgaggcattgagagcgagcgcatcatcttcacaataaatggtgacttttgccccacgttttactaaggaaatggctgcacaaaaagaagcgataccaccgccgataatagcgacatcttgtttttccattttcgcaggctgagcaagataccaaggtgtggaaagtacggtagattttgattgtatttttagcccacttaaacattcccgttttttgccaaagcctttacgttttgtcacattaaagcctgcggattcaagtccttttctaaccgcacttgctgcggtgaaagtggcaaaagaaccattgggttttgtgaaacgaaacattaatttatagagatcatcattccacatttcaggatttttgctcggcgcaaaaccatctaaaaaccaagcatcaatacgttcattcatataatcaccaagttgtggcaagttttctgatacattaccaagccataaatctaacgttgtctctccaaaatgaatacgatgacaacctagaatcaatgaaggccaataacgttgcaaatgagcgcttaaatcttcaaactgcggataggcaaggtgcgcttgcgaaagtgcggtgatttttagcggatatttttcaaaggaaataaaattaaggcgttttaaaggaatgattctcgtgttgctggcgaaattcacggaataattgngttaccgcgaagatatttaatcctgtaccanatcctgtttcagcaaatgacaaattagcctcgttgtggctatnccacgttcccaagttgataccttgtagaaacataatctgtttcgctaatcattttcgtagaaaaagacatatggattgatctggacggaatatggttcgaattgagtgatctcagatgtgccgctaaaggcatttattccttctgctaagaaattgcgatataccatttctgactgtcacaagatatgctgaaaattatttcaaa

SEQ ID NO: 353 - DNA, 1797 bp, H. influenzae
  misc_feature (1504)..(1504): n is a, c, g, or t
  misc_feature (1663)..(1664): n is a, c, g, or t
  misc_feature (1698)..(1699): n is a, c, g, or t
  misc_feature (1709)..(1709): n is a, c, g, or t
tgattggggaagaaatttcacccgtatttgacaaagtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaactaattgagaagtgcggtaaaaatttctctcattttttaccgcactttcttcgttaaagttgctgaatatccagtgccatttggtctagcatttcataacgtttacgatacatagaacgttttttacttgcgatatcttctaattgtttgcgttcaatatgcaaaggtaattgccaatagttatggcgatattctccttggttttcttgccaaaattcatcgtaattaaacaaaatcttactgcgagcagaaagacggtattttccttgtgctttgtgcggaatgcccactaactcacattgccatttttcagcaagcattttgaacgcattaaccaacataaacattggtcgcataccgtgtaatgctttcgtagcctgtttcacaagttcttgtgcattgtcgcttgaggggccttgaattgaggcgataagcaatttattcgggcttaaaaaagtgaaagacgcatcatatactcgttcgttattttgattgcgaatattaatagaaaaatatccttcaaagggatcgatatgattaatactcaacgataaacgcaaatcctcagttaattgggttagcacgatatgttgttgatctaataattgttggcaaagcgaacgtcccattttttcttctgccaaacgtaaattctccgtaatcgccgttaaacgttctgaagcagaaaaacgtttatcgcaaaaggtcgtcagaattgtattagtacgataataatcttgtgtaaataaagactgccattgcgtttctgtattaaggaaatccactaattgatgacattgcttttgatataaccatttatagccataatagcgtaatttttcccgcacttgtttaagaaaagggcgatccttagaataaggatacatttgaacgtaagtggggaaaataaaatgatttttcgtggacataactcaatattttgtgaaatttaataaaatttttcgttattttagccattatcacttcatttgccaaaattcttttttgtttaaaacccactttataactcagattttgttataatcttttccttgaattcctttttccctaccccaatatttacccaaattatcggaacgaaattataagagagaccaattatggcgaagaatacccaacgtacaatgcccgtattgccattcgcgatgttggccgttttcctttatgggngtgccctttttgtaggcgcgtaaatcaattatgcccttgagaacatgaacgatgacaacgatttttttgtatccaaagagagctgatttggagacctaccctgagattatttgtggggggaaccatgctactttatcagtattaaatacctgtgcacgnnaagtgctagttgaggtaaatcggcgaaattacgnnctgagacgcnaaaaggcttttcgccaataccctatcgacctatggcataaaaagataagggcaaaaaaggcgccttttgggttgaaatactacctacc

SEQ ID NO: 354 - DNA, 1884 bp, H. influenzae
gaagagacaacgaaataaggaacagagcaataaaaaatcgaaagtgggaaagggggagaaaaaacaaaaaggggaaagaggagggagattgggtaaaagaaaagacaaaagggtgaataggaggttgattgggggaatttgagtgaaggccgagtcattatggaaaaaggtgaaaaacgaaaaagtgtccataccgatgatcaacagaatttcaagccttgagcatcgaaaatattcgagacgttttaccacgctttttttaaatctgcaaacgtataaatatctacatctgcaatttcacttaactgtacaaggtagtcattaaattgtggcaactcaattttgaatactttatcaggtcgccaacttggtacaacatcaatatcaaaactttcatcattcttgattgcttgatgatattgcaaagaatcaatgggatcatctgttgtccccactaatttcacgttcattttctgcataatgcctcgcgcagaaaattcaggttgttgcaacatttcattacattgatgccaaattttttccgcattttgcggattaaataacatattggttataccaaaaggacggcgtaattctaaatgtgtccagtgataaattggattaccaatacaaagggggactgttttcgcccaagccaaatatttttgatagttagtagccttccctgtaatcaattcttctggtactccagctgtacgcaaagctcgccatttgtagtgatcaccctctagccaaatttcagctaaatcattaaattgacgattttccgccacttctcttggatttaaatgacagtgataatcaaaaataggtttatttttggcataatcatgatagagaatttttgctgtatccgttgaaagaaggaaattttcatccataaattgcttcattttgccctcctatactccactatacgcagaaaaaccgccatcaacaggtaaaactacgccattgacaaaagcagaataattttcatctattaagaaaagtaatgcaccgagcaattcttctgactcaccaaaacgtcccattggtgtgttagtgaggattttatttgctctatctgttggttttccttcagtatcaaataataaagtgcggttttgattactaactaaaaatcctggtgcgatagcattacaacgaataccaacttttgagaaatatacagcaagccattgagtaaaattactgattgcagcttttgcaccagagtaagcaggtatctttgtaagtggtgtaaaggcattcatactggaaatattaataatatttgccccttgtttaccaagcatatcttttgaaaaaacttgggttggtaataatgaacctaagtaattgagattaaatacaaattctataccagatttatctaaatcaaagaatgttcttgtcgtttcatttaaatcaaattgatggaactcattatctgttgtcgcttttggattattcccaccagcaccattaattaaaatatcacaagtgccaaaatcaatagctatttgatcacgcacttctttaatattttcaagttctaacacattagttttataagcttttgcttttccacctgattggttaatttcttttgctgctttgtctgctgcctcgaaattcaaatctaacaaggcaatattagctttagtatacgctaactgcttagctagaaatgaacatagcactccgccagcccccgtgattataattagtttattttctaagttatgggttgctgcaatattcatagtaaactccattaattaaattcagattgaagatgagacgttgcgactttatctatatcgcacctttatattgatgatgatgccagcaatacgattgccttgctgacaacagttt

SEQ ID NO: 355 - DNA, 1952 bp, H. influenzae
aaggcacaaaagttagaataattccaatacctttccaaattataaaagaaacgcgccgccttttgcgaccgttgggatattatttatcctgtcaaaacagcccggaataattggattggccaaaaataatgtcgccagcaaaaatacatataaaatccacgaaacaatcggattgcttggtgtatcatcagcagtaatttctttaattgaggttgcattgcgatattcatccatcatcgtaatacgccaaccatagtatttaatttgcacaagtttgttgtcattacccaaagcctgcgcttcagcctgtaaattggccgatccaaatttgaaatagaacgggaaaccccaacgtgtatcttcattgcgatacaccataattttgccatcgtcattttgcgtattgatgtaatatacatcgcgtgttgggccatcagctggattcgattttgtgattgggccatctttatcaacacgtttaacttctacgccagtaacacgcgtcacatcataatgagggaacacataattcaccacagaaaacataaaaccgtggaataaaaaaacaacaataaataagaaatatttaaaaaactttcgcatatttttcccttgtcagaactgtacatttattctacacgaattttaaataaacgctcgaaattttgtgtagtgatttgagcaaacgcctctgcagaaacgccctttaaggttgccacgtattcacatacttctctcgtatacgctggttgattttcttttcctctgtaaggcactggcgcaagataaggcgaatccgtttccaccaataagcgatccattggcacataacgaataacctcacgaatcgcttcggcatttttaaaggttacaatgccagaacaagaaatgtaaaatcctaaatccaacgcttttttcgcaaattccatggtttccgtaaaacaatgaataacgccaccgcacttttcagcatgatgttcgcgtaacattgcaatggtgtcatcgcctgcagaacgtgtatgaataattacaggcttatctaattggtttgcaatatcgatttggctaccaaacaccgcttgttgtgccgctttattgtccgcactgtaataataatctaagccaatttcgccaatcgcaatcacttttggatcttgcgataaacgcaataagcgttctgcgtcataaggttcctcttcaaaatcgaggggatggacaccgcaagcaagcgagacattattaaattcccgtaaagagtcataagcctgctcaaaacggcttaaggttacaccaatcgcgagcaaatgtttcacatcacgcgcacgtgctttttccaccacatccgagatatttttatgtaaattttcataatccaacgcatctaaatggcagtgggagtcaacaatgaacataattatttttccttatgcctaaggcttgaacaccatagacgatatatctttaatttattgcgtttcaaatacttctgtgactaatcgcgtcaagccatctaatagcattaattcaagattcacaccattaattgtaagcaaatctgaccgcactttttgcataattttaatggcttgtaataaaccaagggcagtttgctcatcgctgaattgttcgatgccacggccaagatcagccacttgtcgatgactatcaatttcaagtttatgttttaaacaatcagaaagaaaagccaaaatccaatccacttgctgaacatagcgttctttatcaaacaacggaagcaattccaatggcgaacgtcggcgatagaacacccaaaattgacgtaagaagtttttacgctgttcaatcagcccttgttgtaaagtttctaatgctaaaagcggacgcccaagattcatcgcaagtgcggtcaaaatttcctgattttcagccgcactttctgatttcacccatccacggcctttggttattac

SEQ ID NO: 356 - DNA, 1691 bp, H. influenzae
ctccgtatccttggttttatacacgccttggtgtgttgcttgtaaagaatttgaaaagctgacgttttcagatctcacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaagttagaattatttacaataagtaaaaactctttttctgttatacatcttgtttaacaaatagctaatcattactatagctgggttttaatttatctttaaacgaaaggaaagcaaaatgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaagtagtttagttgtagtttcataattttatccttatttttgcccacatttatgtgggcttttttatgcctgaaatttatcgcattttttaccgcactttaagaaattatatttaatcttttctatatttaagcaaacgtttgcgttataatccaactcgcttatttttaaccatttaatgaaaggaaaatacaatgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaattcggtgcgggtaccgagtccgaatcg

SEQ ID NO: 357 - DNA, 2173 bp, H. influenzae
  misc_feature (2160)..(2160): n is a, c, g, or t
  misc_feature (2163)..(2163): n is a, c, g, or t
cggtctttttcataaattacattcccgaatatcatgctgtgtacgggcccgttcccccggaaattgcccccccgccttgcgttttccgtaaaatcatcctgccccgggaatatcggattttctgcccctagaaagtcattgccattggttattcaatacgcggttttagcgaaatgtgcaaataatctttcggcaagccttgtggcaattccacggtagtgtagtcatcataaagtttaatatgcccaatataacggctgttaatatcgccttcgttagcaatcgcaccaacgatatggcgagcttttacaccatctgcacgaccgacttcgatacgatataaatccattggttgtggatttccatagcctttacgttcgccacgacgttcagctgaacgtggattttcacggcgatcaccgcgatcattacgttcacgacgacgtttttccattggcggatcaggtggaagaattaatttttgtttgccttgaagcagcatcaacattgctgcagcaatatcttcttgatcctgatcggctgtgaataagtcttctaataaactacgatattgttctaaatcgtgatgctcgagttgtttcgtaattttggcgacaaattttttgcggcggcattcttgtaacacaagatgatttggcaattctacttcattgataccttttttcattaggtgttcaatattacgaagtaaacgacgctcgcgaggttcaacaaataataaagcacgaccagaacgaccagcacgaccagtacgcccaattcggtgtacataagattctgcatcaagcggaatgtcgtagttcaccacaaggctgatacgttcaatatcaataccgcgtgcagccacatcggttgccacaacaatatctaaactgccgttacgtaagcgatcgagggtttgttcgcgtaattgttgtgtcatatcgccattaagtgcggcagaacggaaaccatttttttcaagtagttctgtaatgtctaaagtaccagttttagtgcgagcaaaaataatcgctgcatcaaaatcttccacttctaagaaacgaagaagagcttcgtttttacgcacgccgtgtacataccaacaactttggtcgatatctggggcattttcgttattcactttgatcttcacttcttgtggatcattcataaaacgtttcgtaatacgacggatcggttcaggcattgttgcagagaataacgcagtttgatgattttctggtaattctgccatgacggtttctacatcatcaatgaaacccatgcgtagcatttcatcggcttcatctaatacgataaaacgaagttcagaaagatttaatgttctgcgacgaatatggtcaagaatacggcctggtgtacccacaaccacttgtgcgccttgttttaatgcacgaagttggatgtcataacgttggccaccatataaggtaacaatgcgagtgccgtgtgcatatttaacaaattgttcacacgcatcggcaacttgaatagcaagttcgcgtgtaggcgccatcactaacatttgtggatgtttttcacttggatcgatttgcgctaataaaggcagtgcaaaagcagcggttttaccactacccgtttgtgccatacctagcacatcattgccattgagcaaatgtgggatacaagcttgttgaattggagaaggggtttcaaaacctaagtcagaaacagcttttaagatgaactcaggtaagcctaagtcattaaaagtaattttgtcagtcattaaaatactcgaatataaataaggaaagctcaacgggctttcggtttattaagttgagcagagcgaatgaatttttctattcgttctactgcaaagagcggtaagttttggattgatttttagaaaacaatcgcttttgttaccgcacttttctcttctttttcgtcttctgtttgaaccggttttaatttcatgagttcaaacgcggcaaaacgatactcaacaaagttataaacctgatttgccatggctagtttaaataaagctgctgcttcatctactagccctacattgagtttttgttttgctagataaaaataggtttctgtgagaatttcagcatattgtttgaattttcggaattcacttgcacgttgttgtaattnttntacagagatg

SEQ ID NO: 358 - DNA, 2063 bp, H. influenzae
  misc_feature (1917)..(1917): n is a, c, g, or t
  misc_feature (1926)..(1926): n is a, c, g, or t
  misc_feature (1928)..(1928): n is a, c, g, or t
  misc_feature (1951)..(1951): n is a, c, g, or t
  misc_feature (1976)..(1976): n is a, c, g, or t
  misc_feature (1982)..(1982): n is a, c, g, or t
  misc_feature (1987)..(1987): n is a, c, g, or t
  misc_feature (1994)..(1995): n is a, c, g, or t
  misc_feature (2004)..(2006): n is a, c, g, or t
  misc_feature (2008)..(2008): n is a, c, g, or t
  misc_feature (2011)..(2011): n is a, c, g, or t
  misc_feature (2028)..(2028): n is a, c, g, or t
  misc_feature (2032)..(2032): n is a, c, g, or t
  misc_feature (2042)..(2042): n is a, c, g, or t
  misc_feature (2045)..(2045): n is a, c, g, or t
  misc_feature (2053)..(2054): n is a, c, g, or t
ggaattcctaaatggtctattattttataccaaacatcatttaaccggatttcagcgtattgcttgtgacaaagcagtgacaatggggcatattgaacgtgagcatttatctgctgcaaaatgcatagtgccaaatgacgaattattagcaaataaagcattagaaaatattttagaaaaaattatttttaacaggctggaaaatttcaatcttcaaaacacaagagatttattattacctagattgttaaatggtgaactcaatggatagaactaccgattatttagaacgacttttcattgaggaactaaactctgaaggcgaaattattatcagcggaaacagttttttccgacatgaaattttatatactcttgatcctgaagcatataaagacgtttttgaattttggaaaacagaaagaaaacaaagaaacttaaatgaagccaatagaatattggatattacttcagataatcgaaatcgatttattcgattaaaagaactcttcaaagagaaaaagattatcccctttattggagctgggatgtccatgtctacaggtttaccttcttggagcgaatttcttcgtagtgttcaacaagaaactagaactgatcgtttctattttgaagatctcttatcgcaaggtgaatttgaagaagctgctcagtatctagatgactgtagtccttcacacttacaagagcagttagataatatatttggtagaaaatatctatttaatgaaataaatggtgtaatttgccttttaccaaaattttttaataatactcctattattacaacaaattatgacaatatacttagtactgtttatcaaaaatgcgattacccattttctgatgaactaaatggattatacctagaagacctttataataaacttcttgataaacaaaatttcttattaaagatacatggtacttttgataaaccacaaaatcgaatactaacaaaaaatgactacgataaacactacaatgaccaaactagtaaattgaaaaattgtgtagaaagcttattttcaagttctctattatttatcggttgtagtttaactattgatcgcttaattaaggcgctagccgagattgttcaagaaaaaggcagtgaaaatctacctagacattatgcttttttattttcagatcctaaaaaggacgtgaacagaattaacaaaaaagaagaattagcaaaatccaatatttttccaatttggtatgatggcgatcatgatgaaagcattgaagccttgctggaattattaaatgatggagaacaataaaatgctcaacgaaaacgacatcgaacaactcacccttcaacgcctgcaatccctcggttgggaatatcgctatggtaaagatttgcctgttcatgagggcgaattttcccgtggcaatttgagcggtgtagtttttattgagcaactgcgtgaggcggtgcgtaaacttaatccgcagctgcctgaaagtgcggttgattctgtggtgaaatccgcgacaaaaagcgatattggcgacttggttgtgcgtaatcagacgttttataaattgttgcgtgatggtgtacgggtagaatatcaagatgatggtgagcagaaaatcgagatggcgcgtttggtggattttgagcatggggaaaacaaccgctttgtcgccgtcaatcagctggaaatccgcagccgtaaaggaggtaaacggattcccgatattatcggctttgtaaatgggctgcctttggtggtatttgagctcaaaaatccgctgcgtgaatcggcggatttattgcaggcgtttaatcagtttgaaacctataaagatgaaattgccgagctgtttgtttacaaccaagccctgattatttcagacggcattgccgcccgtttgggntcgctttcngnagattttcaacgctttacgccgnggaaagtgggctatgaaaaaaatanaagcgngcggntatattnngaccaacannncncancccgcccatggctttangccnccctgtgatnacnggcccatnnccctttctc

SEQ ID NO: 359 - DNA, 2844 bp, H. influenzae
  misc_feature (2835)..(2835): n is a, c, g, or t
ctactggctcgagaaaacgcggcaacacgagcgtttttgatatggcgcgcaatggtttgtaccgattcaaaatccccttgagaagaaacgggaaaccccacttccattacatccacacctaagcgttcaagtgctaaagcgatctgtaatttttcttttaccgtcaaacttgcttttaacgcctgttccccatcacgcaaggtggtatcaaaaataataacgcgatctgtcataacaatatccttactaaaagttcctctaaaatcactccaaaagtgcggtgcgtttttcctgtattttttagacaaaaaacccgcgacttataaagtgcgggtttaaaattgggtatttacatctgactgttttttatccacaacttagccgcacgcaaaatgtgagagcagcaggttgagagataaagaaacaatacgaaacataaataaaaatccttctgtgtaaaacgttttccatattacgaataaaaaactggctgtcaaactattttttggcattttatattaaaaataaacctactcacactttattaaatatatatttaactaataaatttaataaaatcagaatatttaaccaatttaatcgtcatcaacaaatttttcttattggattttttacattttcaaaataagaaaaattttgcaattttttattcattaaaaagaatttttgcgatctacatcgcaaaatgcttttaaattaatcgtttctttccctcgtttttcccatactaggctttcaaataaaaaggaaaaaatatgaatgacattacctacacattactccgtttaatgcaagtgcctaaacttggcggcgttggcattgataaaattttgtccaatattaccttaaatgaattacttaattatgatgatgttgctttccgacaaatgggatggggagccattcaaattcgccgttggttcaaacctgaagcaaaatttattgagccagcactcgcgtggtcacaaaaagagggaaatcatttagtaaattatttttcccctttttatccctttttattgaaacaaaccgcaaactttccgccactattatttgtaaaaggaaatttaaccgcactttcacaacgccaaatggcaatggttgggagccgttattgcacgacttatggagaatattgggcaaaacattttgcaacagaactttcattagcgggttttaccataacaagcggtttagcattaggaattgatggtcattgtcatcaggctgtcgtcaatattcaagggcaaactattgcggtcttaggcagtggattagaacaaatctatccctctaaacatcaaagattatcagcacaaatcatcgaaaataatggggcattagtctctgaatttttacctaaccaagcacctattgctgctaattttccacgccgtaatcggattattagtgggctttcagtcggcacgctcgttgttgaagccaccgaaaaaagtggatcacttattactgcacggtatgcgttggaacaaaaccgagaggtttttgctgtgccaggcaatattcaaaatgaatcaagtcaaggttgtcatcgcctgattaaacaaggcgcaatgttggtagaaaatgcaaaggacattttggaaacgctctaccaacattctatccacagccaaactgaaattgattttgaccagatcgccgtgcctaattacacgccaccacccgatcctcgccgattagtagaagcaccaagccacccgaaactttattcacgtattggctatactcctgtgagcattgatgatttagctgaagaatttaatttaagtgtcgatgttttacttgttcaattgctcgatcttgagctacaagatcttatcataagtgaaaatggcttatataaacgcatttaacgtaaatttttatgctaagatacgcccattcttttttcataaaaggacgattatgttagccattatctcccctgccaaaacccttgattttgaaagtgcggtaaaaaattttcctgtttttcaaccgcactttactgattacagcgaacaacttattgaggtttgtcgtaaactttctccgcaagatctttcatcattaatgtctatcagcgataaattagcagggcttaatgttgcacgttttgctgaatggacaaaaattcacaatgaagacaattctcgccctgcactctttgcatttaaaggcgatgtttatacgggtttagatgctgattccctttcggaagatgatgtcatttttgcacaatcccatttacgtatgctttctgggctttatgggcttttaaaaccacttgatttaatgcaaccttaccgattagaaatggggacaaaattagccaatccgaaaggaaaagatctgtatgccttttggggaaatgtgattacccaagcagttcaacaagctattgatgcacaaggcgataatgtgttagtcaatctagcctctgatgaatattataaatctgttaaagaaaaccaacttaacgccaaaattatcaagccagttttcttagacaataaaaatggaaaatacaaagtaattagcttttatgctaaaaaagcgcgaggattaatgtgccgttatcttattcaaaatcgtttaaccgacattgaacagttaaaagaatttgatttaggtggttattggtttgattcagcatcctccactgaaactgaatttgtctttaagcgagatattaatgaataaaatttttgttattttgaccgcacttatacttcagggctgtgcaactaagctgacccaattaaatgtgcctacgcagttagaatataatggggaaccgaggctgatatncgtaaaaca

SEQ ID NO: 360 - DNA, 2408 bp, H. influenzae
  misc_feature (260)..(260): n is a, c, g, or t
  misc_feature (2356)..(2356): n is a, c, g, or t
gggaacgcagggcagccttacctattgtttaggtagagaaattaggggtacacccgattatgttgatttggcaaaaatgccaccttaattggtagcaggttttacggatccaggtaagtctgttggtggaatccgatgaattcccagtttactttatcggttcacccagaagatgggaaatttattatgattgatcctaaagtcgtcgaacttcgtgttataaataatattccacattgtactgacaccagttgtaacgngtatatgaaaaaaacacgctaatgcgttgcgttggtgcgtagatgaaatggaacgtcgttatcagttgctttcagctttacgcgtacgaaacattgaaggctttaatgaaaaaattgatgaatacgaagcaatgggaatgcctgtgccaaatccaatttggcgaccgagcgatacgatggatgcaatgccaccagcgttgaaaaaattgagttatattgtggttattgtcgatgagtttgctgatttaatgatggtagcgggtaagcaaatcgaagaactgattgcacggttggcacaaaaagcgcgagctattggtatccatttaattttagccacacaacgcccctctgtggatgtgattactggtttaattaaagcaaatattccaagtcgcattgcctttacggtggcaagtaaaattgactcacgtactattcttgatcaagggggtgcagaagcccttttagggcgtggagatatgctttattctggacaaggttcatctgatttaatccgcgtacatggagcctatatgagtgatgatgaagtcatcaatattgccgatgattggcgagcacgcggtaaacctgattatattgatggaattttagaaagtgctgacgatgaggaaagtacagaaaaagggatatcaagcggtggagaattagatccactctttgatgaagtaatggactttgttattaatactggtacaacttcagtatcttctattcaacgtaaattcagcgtaggttttaaccgagcagcgcgtattatggatcaaatggaagagcaagggattgtcagcccaatgcaaaatggtaagcgtgaaattttatcgcatcgtccagaatactaatttaaaaggaaagtaaaatgaaaaaaacaaccttaaaatttgccgcacttaccttacttggtttgagtaatttggcattggctgatgcggcaagtgaattacaaatgcgtttagctaaagtcgatgtattaagtgcagaatttgtgcaaacagtgacttctggaagtggaaaaaatgttcaacaaggaagtggcaaacttcaaattaaacgcccaaatttattccgtatggagactaaaacccctcaagaaacccagattatttctgatggtaaaaccttatggttctacgatccatttgtgcaacaagtgaccgcacaatgggtaaaaaatgcggtaaataatactccttttgttttgcttaccagcaatgataatagccattggcatcaatatacggtaacacaacaatcggatacctttgtgttaaaaccaaccttatccacaagcaacattaagcaatttgatattcgtgttgatgctaatggaatattgcgaaatttcagtacgacagagaaagatgggcaaaccaatctttatgttttacgtaatattacgaatcaaaccttgtctgatagcttgttccaattcaagccagaaaaaggcgttgaagtggatgaccaacgtaaaaaataacaagtgattattttaaataagggcgtagaaatacgcccttcaattttgtgagaaataaaaatgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatnctgaacgaggattgggtaaagaggggtaccgagcctgatatccgtataacag

SEQ ID NO: 361 - DNA, 3696 bp, H. influenzae
  misc_feature (1006)..(1006): n is a, c, g, or t
  misc_feature (2037)..(2037): n is a, c, g, or t
tgatttcgtatatcaaactcgtatcccgttttgtttgaattcttcatctacggctttttgatttcttttaactgcggaaatcagcaaaagcttgataataatcgtggtattgcaagccttgtaatagttgatgataacgttgaggttcttctggtgagaatttaccctcaataatttgatccacgactgtgcgtaattgagcatcgttttgatagtattcaaatgaacgatagccgtcgcgacgaagttgttccacttgttctaccgtattaccgaagatgaaaatgtgattttcgcccacattttccaagatctctacgttcgcaccgtcaagtgtaccgagtgtcaatgcgccatttaaggcaaacttcatattactggtgccagaagcctctgtgcctgcaagggatatttgctctgaaatatctgctgctgggatgataagctgtgcaaggctcacgctgtaatttggaataaatacaacttttaaacggcctttcaaacgctcatcattattgatgacattagcaacatcattaattaaatggatcgtttgtttcgcagcatagtaagccgaagccgctttacctgctaaaataaatacgcgaggttgccaatctttttcagggttggcaagcatttcattgtagcgagcaataatatgcaatacgttcaacatttggcgtttatattcgtgaatacgttttacttgcacgtcaaataaggcgtgcggatcaagctctacccctaactcgcgttttacgtattccgctaatttcactttattagcaaatttaatgtcagcaacagcctctttaaatgctttttcttgcgtaaatggtttaagtttttcgatttgacttaaatcacaacgccattctgaaccgatatatttatcaaacaatgcggctaattgtgggttcgccacgggctaaccaacgacgcggtgtgataaccgtttgttacgttggtaaagcgttctgggaaatacgagcaaaatctgcanaggttgaaagttaccattaaatcgaatgaatttcggcaaccccgttgattttgtgtgaacctactacggatagccatcccatacgcactttgcgttggtagccttcttcgataagagaaacacggcggataaaatcgttgtcagtcgttacataagtgcggacatattctaagaagtgatcgttaatttcaaaaatcatctgtaaatgacgtggcaagatttttgccatcatttccacaggccaagtttctaacgcttcggacattaaagtatggcaggtgtaagagaaaatgttacgcgtcatctcccacgcttttttccactcgaaaccttcatcgtccactaaaatacgcattaattcaggaatcgctaacgctgggtgggtatcatttaagtggatcgccactttatccgccaagttttcaaggctgtcgtgggtgcgtttgtgacggcgtaaaatatcttgaagcgatgcagagactaagaaatactcttgacgtaaacgcaattcgcgaccattccaagtagaatcatcagggtaaagtacacgtgataaatttttatttgcggagtgctcttctaatgcggctaaatgttcgccacggttgaagtcggcaaggttaaacacttcgcctgcgtgtgccgaccataaacgtaatgttgctgcagaattattttgataacctgggatcatttgatcgtaagcaagtgcggttactttttcggtatcttgccaaatacattttttgccttcgaaatgaatgtttccaccaaattctacggtaaagcgtttagatggacgaataaattcccaaggtgctcctttttcaagccatgcatcaggacgctcgacttgctgaccattttcaattttttggcggaacataccatattcataacgaataccgtagcccatacccggtaaaccaagggtcgcaatagaatccataaaacaagcggctaaacgacctaaaccaccattgcccaagccaggatctactctttttctaaaactcttctaaatccacatntaattcagaaagtgcttcctgtgctaatccataaatgccttctgcaatcattgcattagatagcgtacgcccgattaaaaattccattgaaaggtagtaaacacggcgagaatcttctgctcgagtttggcgagcagtagtgatccaaccctctgttactaaatcacgcacagcgtgaagtgttgcattgagccaatcgcgttggctggcttcacgtggagagcgaccgattaagaaaataagtttgtaaacgattgattttttaatcgcttcaacggtcatttcaggacgattatattggaatggagaatcaaagttatccattatcataggtaaaacctctattagaatgctaagaaatgattaacgtagggtgtgtgaattttcaaaattcacgcacgtttgcaaaaatcaatcaaaatttgaccgctctttgaatgcgtgaatgttgtttacacagcctacaaagtagttcgaattttatgcttatctttgcaaaaaacaagcacaaccacaccgcttgcaaaatattctttcacaagcggtgtgattgttaagaaagtttacgaataaaactacaagcgttcataaagtgttctatattgctctgcagccttacgccagctgaagtcttgttccattgcatctgtacgaaccatcgcccatgcacgcggtttttgccataaggcaaaggcacgttgcaagcaatggcggagagcttcaggcgttgcactttcaaacacaaaacctgttgcggtgcgagctttgatgctttctgaagtgctatccaccaccgtatccgctaaaccacctgttttacgaacacgtggcagtgtgccatattgcaaaccataaagttgggttaagccacaaggctcgaaacgacttggcactaaaatcacatcgccacctgccaccattaaatgcgaaagggcttcatcgtagccgatttttaccgcaatattttgcggataacgttcagcaagctcacgaataccttgttcaaagtgcggtgcacctgaacctaaaatcatcaactgaccgccttgtttgacgatttcgtctgcactttcgattaataaatcaacacctttttgctcggttaaacgggtaaccatcacaaatgccaaggcagattcatcttgtggcaaattgaaataggcttgcagttcggctttgtttttctttttgcctgccatatatttgagcttgtaatggcgcggaatgtattgatccacgttcggatgccaaatattttcgtccacaccatttaaaatccccaccaaacgacctcgcgcttttaacccagaaagccagcctttgcaaaccgtaggcatattctggcctcttcacttcttctgcataagttgggttaactgccgggctggcatatcattttaacaaccccgctttcttttttgtatcccgcccattaagcctccgcctttcttctgccatcgtccctgttcgatcggccccgcgtttttctttttgttccaccccttgttctttcatcggccggtgagggaatgtttccatccggcttttttggtcgcaccttccgacaaccgatggcgtctatcatacccgctcaactgtccttgacttccatcaacgtcccagccaacaataagtctcttctcgtctccccccccgtcg

SEQ ID NO: 362 - DNA, 2007 bp, H. influenzae
atatcgactcggtacccatctaaaccttgtaaagcaccataatgacgttcatttaaacgccagttttttacttgcggaatccataattgatgggattcttctaacacgatattacaagttttgattgctcgagttaaaacagaggtaaatgcgatatcaaattcataacctttgtctaacagttttttacccgcagcttttgcttcttccacaccacgttcagttaaattcacatcacgccagcctgtgaataagtttttcgcattccattcactaaaaccgtgacggataaatactaattccataagaatctcctaatgttttcaaataaaaagaacgcgcattttatagcaaaaaatccttagctttaaaagttaaaagggatgatttcctgatctttagcaaaaaataaccatcaaactttttcgccttttaacaaatatgataagatttgcgagttttacgaatttaggatgaattatgttgcgttttggcgttaatcaaaaaacatcattattattaaccgcacttttaagctgcggtttattaatattttcgcctgtcagccaatcttccgatctcaatcaaattcaaaaacaaattaagcaacaagaatctaaaatagagaagcaaaaacgtgagcaagctaagttacaagcaaatttaaaaaaacacgagagtaaaattaacagtgttgagggcgaactgcttgaaacagaaataagtttaaaggaaattcgtaagcaaattgccgatgcagataagcaactcaaacaattagaaaaacaggaacgtgagcaaaaagcacgattaaccaaacaaatagatataatttatcgttcaggcattaatccatcgctgattgaacgaatgtttgcccaagatccgacaaaagcagagcgaatgaaagtttattatcagcatttaaatcaagttcggattgaaatgattaataatttaaaagcaacgcaagcacaaattgcagtacaaaaaaaggcgattttctctcaacaaaagaatcaccgaaatcaactttccacacaaaaaaaacaacaacaagcattgcaaaaagcacagcaagagcatcaatctacgctgaatgaactcaataaaaatttagccctagatcaagataaattgaatgcactaaaagcaaacgaacaagcacttcgtcaagaaattcaacgagctgaacaagcagcgcgcgaacaagaaaaacgtgaaagagaggcacttgctcaacgccaaaaagctgaagaaaaacgaacatcaaaaccttatcaaccaactgtacaagaacgccaattacttaatagtacaagcggtttaggggcggcaaaaaaacaatattccttaccagtttctggttcaattttgcatacttttggttctatccaagcaggcgaagtacgttggaaaggtatggtaattggcgcatcagcaggcacgcctgttaaagcaattgctgctggacgcgtcattttagcgggatatttaaatggttatggttatatggttattgttaaacacggcgaaactgatttaagtttatatggcttcaatcaagccgtatcagtgaaagttggtcagcttgtttcagcagggcaggttattgctcaagtaggaaatacaggggaaatatcacgttctgcgctttattttggtattagccgtaaaggaacgccagtaaatcctgcagggtgggttcgttgatgaatattctgataaaaagtgcggtaaaaaatttcattgttttttctaccgcactttatacctctttttcttttgctcaaagtaaacttgctattgtgattgatgatgtaggctatcattccaaagaagatgcagcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgc

SEQ ID NO: 363 - DNA, 2564 bp, H. influenzae
gactaaataaaataatcaaatctagaaaaaagaaaaaagagtaaacaataaatatggcgaaggatgagttgtagatagaagaaacaacataaataaaaagaataatgagaaaacaagaaaagagaatagagaaagcggaaacaacagagttagaccgcagcagcaagaagaataataagaactgatgcatgagatgaaagaacaaaacaaatggagagtaataggagataaaatggcgctgcgagaagagattacagaaaaacaagagaaagagaagagggaaagataagctagaagatgcaataaaaagaaaacatgagagtaaaatgtataggagaacgaaggaaaaaagtgaagaaaggagaaacaaaagagaaagaagtatgagacggggaggagggagagacaggaaggagaaagaaagggggaaggaagggaggtaaggataagagagaagaaaggagaatgaaaaagattggacagtacagacggaaaagggagaggggagtgtgggttggggggggaacaaaatgggggagagaatgaggggaataaacaaaaggcggagattcggagggtaggggatagtcgggcttatttaattgatgagaaaggaagatggcaacaaatcacccaagatcattctattctttctgaattattgactgatttccccgataaaaaagaagaagattttgccaagatttatggcggcgtttcttcttgtttagtcgccgattattccgaatttcaagataaaattttttatcaagaaattgaaattcagcaaggggaaagtttattactttgttctgacggcttgaccgacgggctttcagatgaaatgcgcgaaaaaatttggcagaaatatcccgatgataaatatcgccttacggtttgccgcaagatgattgagaagcaatcgttttcggatgatttgtcggtagtttgttgtcattctattattgagtaaaaaatatgtttaaattgttttttttttgctcaattatctataattcggtgaattttaactagaaataaggaaaaactatgtttgaaaaaattgaacctactaatattcgttttattaaattaggcataaaaggatgttgggaaaaagattgtattgataaaaatagtacagcaagtacaaaaaatacgattcgtcttggctatgaatctacatcagagattcacaaagaatgtttgaataatcaatgggatagttgtattgaatattgtaaaacttattggagtgaccatacaggaactgtttcaaatcacttgagacaaattcaagatttttatcaacttggggaagatacactttggatcaccttctttggacgtaaattatattgggctttttgcagtaaagaggttgttgaggaaagcgatggttctagaacaagaaaagttattagtaacaatgggaattggtcttgcgttgatgctaacggtaaagagcttttagtcgataatcttgatggtagagtaacaaaggtccaagcctatagagggacgatttgtggtgttgagatggaggactatttaatacgtcgtataaatggtgaagttattgaggaaattacagaagcgaaagaggcgtatgaaacattaattaaatcagttgaaaaattaattaaaggtttatggtggagtgactttgaacttttaacggatcttgttttttctaaattaggatggcaacgatactctgttttaggtaaaacggagaaaggaatagatcttgatttgtattcgtcttcaacgcagaagagagtatttgtgcaaattaagtcagatacggatattaaacaattagacgaatatgtttcgaactttgaaagtgaatataaaaactatggttattcagaaatgtattacgtatatcattctggtttagaaaacatagatgaaaaacaatatcaagctaaaggaattaagcttgtaaatggccgaaaaatggcagagcttgtaattagtgctggtttagttgaatggttgattaacaaacgttcttaaaactatccttaacgacaccttttgtcgcactactcactaaaatactccttaccaacccagtaaggagtattttttatgtctgaatataaattaaacccaccgacagtgtcttcttatactgaaaatatgatgcttaaagttttatttgagcataaaggtttttccgaagtgtttcgggagactagctggcgaagtgatgaaattgccagtgcatttgggctgcctgaagaattgagagaatgataaaaatttacgcacggttgctcgtcggcttttaaaagagcggtataaaaaactccaaaaatccaccgcacttttacctgagttatggaaacaggcgtatgaaaatttggcaacgttggcagaatttttgcaactgaatcccgttgaacaggaacttctccgctttgccatgcatttacgtagtgaaggagctatgcgagatttgtttggctacttgccgaaatcggatttacaaagaacggctgcgatcatggcggatttacttaaacaggggtaccgagtccgaatcgtataca

SEQ ID NO: 364 - DNA, 2810 bp, H. influenzae
tttatacgatatcggctcggtacccttttttagtaacttgcaactattttatggtctggtcgcaccacaaaataggcaatggtgaacacacacatcaaatatagttacgtacctttgcatacgctcaaggcgtaaccaagttacattgcgagcgggattttagcattatctaaaatctttggctatgattttattgcttagaacccccccccccataaatcaatgtcaaagtttagcttaagtataagccaccattcacgtgtaacgttgtacccgtgatataacctgcatcatcagaagctaagaaagcaacggctttagctatgtcttttgcttcgcctaaacgtccagctggaacattagataagatccccgctttttgttcatccgtaagcacttctgtcatatctgttgcaataaaacctggtgcaaccacatttacagtaacaccacgtgcagctacttctttcgctaaagatttagaaaaaccaaccacacccgcttttgccgcacaatagttagtttgtcctggattacccgttgaaccaaccactgaaccaatattgatgatacgaccaaaacgttttttcatcattgaacgtaacatggctttagaaagatgatacacagaagttaagttagtttgcataatatcaaaccattcctcatctttcatacgcatcaataaattatcgcgagtaatacctgcgttattcacgagaatatcaatatcgccaaaatcatttttaatttgctcaagtaaagtttcgatagattctttatccgttacgtttaaaactaaacctttacctttatcccctaaataagccgagatcgcctctgcacccttttcagaggttgcggtaccaattacaaatgcaccttttgaactaagttcttctgcaatcgcacgaccgataccacggctagcccctgtcactaaagcaattttaccttgcattttttcttccttttacttacgctaaaaattcttctaccgcattgaatgatgcaacatcatttacagatattgcttgtaaatcacccacaatgcgtttgggtaaaccatttaatactttacctggccccacttcaacaagcgctaaaacaccatcttgcgccattttttcaactgtttcagtccaacgaactggactatataactgacgaacaagtgcggtacgactatttcggtgccttcagtttcagctttcacaatcaacgttatttaataaccgatattgttggtgtattatatttgaatattctcaagtgttaccgctaattgctcggctgcaggtttcattaatgcacagtgagaaggtacgctcacagctaacggcaatgcacgtttcgcccctgcttctttacataatgcagccgcacgctcaactgcagctttcgcacccgcaataactacttgacccggtgagttaaagttcaccgcagatacgacttcgccttcctctgcttgtttgcaagcattaataattgcttcattatctaaaccaatgattgcatacattgcgccagtgccttcaggcacagcttgttgcattaattttccgcgcaattccactaatttaatcgcatcttggaaatccaacaccccagcacaaaccaaggcagaatactcacccaagctatggcctgccatcacttctggttttaattgaggaaatttttcttgccatacgcgataaatagcgactgaagcagctaaaagtgcgggctgagtttgccaagttttattaagttcttcagctggaccttgttgaacaagataccataaatcataaccaagcgcatcagatgcttgtttaaatgtttcaataacgattggatattcagtggcaagatcagcaagcataccgacagtttgggagccttgacctgggaagaccattgcgaattttttcattatgttttgtcctattgttttttaattgaaaattcttcttcggtaattaaaatcgggtttcgccgatggcgacttactttttctttgcttcgccaaagaaaaagtaagcaaaaagaagggaacccaatttgttctttatccgatttaaagtgcggtcaaaactcaaaatattttttgttcttaaaatgaatttaaaattaaccgcactttttaaataatgctctgataaattcggggccccatataaatcgcctttgcgactttcaatttttaggcaatttgcgtctgtttgagcgtagcgagttcagcaaattgccgttaagaaaattgaaacaaagcaaagaacagcgatttaactggggcgtgttttctttgcctactttcttttacacgagtaaaagaaagtaggtcgccgtcaggcgaacccctgacatttaacacaaaaagtgcggtcaatttttaccgcactttaaaatcatcaataattatatcaaatcaactaaaatctcactaacgctgaaccccaagtccaaccaccgccaaaggcttctaataatagtaactgcccacgttgaatacgaccatctcgaatagcctcatctaaagcgacaggaacagttgctgcactgttgttagcgtatttatctaacgttaccaccacttgcgacatatccatttctaattttttagctgttgctgtaataatacgtaaatttgcttggtgtggcacaagccagtctaaatcttttttatctaaattatttgctaaaagtgtttcttccaccacatttgaaagttcacgaactgccaatttgaacgtttcgttaccttgcatctcgatatagccagatttttctataccacgttctggctgagctaaaacaagggg

SEQ ID NO: 365 - DNA, 2023 bp, H. influenzae
tctattgatataaaagacaacaaaattctagtgtggttgatcaagggatttcttatcttaatttgatgcttgaatataaagctgattttattgtggaatataatgaaaagcaaaaagccccacttaaaagaaatgatgtggattggtcacaatctaaggtgatttttgtttcacctacttttaatgatttccaaattcaagccacaaattttaaagatttacctattgaattatgggaagttaatcgctttgataatgatattattacgctcaatattattaataaatcaaaatcagcaccgaatattaaagctgtttctattgaaaaaaatgaagaattttctacattaaaagaaataaaagtttatcaagaatctgatcacttaagtgataaatcagattttattcaagaactatacgaagattttaaacaaggcattttaaatttagatcctaatatcgaaattaatactagaaaactttacattgcattcaaaaaagatcgaaatattgcagatattcgtatccaacaaaagaatttaaaaatttggattaatcttccttatggagagttagacgatcctaaaaatttagcaaaaaatgtatctaatactggtcactgggggaatggagattatgaaatcaccattgaaagcacccaatatcttgaatacattatgagtttaattaaacaagctattaaggattaataaatgcacaatcttatttttgccattctttgcagcgtagcagtttcagttttactgaaaattgcccgtaaaaaaaatatcattattgaacaagctatcgcattcaactacattacagccatcactttcagttatttcttacttaaacctgattttaaaggcttagagtttactgattacattgcacaaagcgaaaattcacccatttttttagcactaggtttattgctacctagcgtatttattattatgtcaaaagcagtggagtttgctggaattgtacgttcagatgcagcgcaacgtctttcgttatttcttcccattttagcagcgtttttaatttttcatgaaacactaagccaatctaaaatcattggcgttgtattagcctttattggtttattttgtttattaactaagccaactcaagggcaaagtgcggtcaattttaaaggtgttttaggattaatcggcgtctggtttggttacggcatcattgatattttattcaaacaagtagcgaaaagcggtggtgcatttcctgcaacattgtttatttctttctcgcttgcagcttgcgttatgtttatctatttattcttaaaacgtgcgcaatggacatcatcaagtgtaattggcggcatcgttttaggtgtattgaatttctttaatattttattctatataaaagcacatcaaagttttgctggaaatccgacgcttgttttcgcgggaatgaatatcggggtaatttgcctaggtacgataactggcgcattagtttttaaagaaaaaatcagtaagctaaattggctaggtattatttttagtttatcggctattttctgcctatattatttagacaaactcatcccgtacaagagagtagtcatggcaaaagacttcagcttttttatttacgattatgcacagtttttcgttaatcccgccatacatcgccctctccaatttgttgtcgttctcacgcacgctcactcaccacttccgtccacccccttacttccctttttctaatttatcccctatcctctccccgctctctatccccctcaggtacctctcctccctcctcccccctctcttcactcaatattcccccccctctctctcccattctctcatcccctctttacttttcatccctcctttccctatttttccccctatctcatcacttttcacactattatcttttcctttccccgtattctttccttttactccctttccatctcttcacccctcctcctttccctcttttttccatttttcctcttcgcctaccgcccttg

SEQ ID NO: 366 - DNA, 2360 bp, H. influenzae
ataaagaaatttgcagatacatggcgatccaatgattcgatttccccatgtctgacaatctaaacaatatcaaagtgcggaatgatttcagccagtttttcttcgtccaacttcgcattaatcgtctctatgtttatatgtggattgatttgttccagtgcaattttagcggattccacctttggcatattcaagcgcgtatcgcagtgtaggacttgtcgttgaagattcgaaagcgaaactgtatcgaaatccaacagtgttaaatttccaacgcctgccgctgcgagatattggctggctgcacatcctaagccaccaagcccaacgatcagcattttgcttgctttaagtttttcttgcccgtcaaaatctacgcttttaagaataatttgacggttataacgcaattcttcttcgtgactaagttcgatcattttttatcctaataaatgattgaaaggctcaattgtcactgtttcgcccgcagagacattgccacgttcttgttctaacacgataaaacaattgctttttacaaaagcactaaagagatgagaaccttggaaacctactgattgcacttcaatttgaccttgttcattgatgtaataaaaaccccgttggaagtctaaacgtcccactgcttttttcaaattcattgtagcaatggctgaaaagtgcggtggatttttccattgtttttgtccttgcagtttagcgattaatggctgtacaagttgatagaatgttactaatgcggaaacaggattgccgggtaaaccacagaaccaagcattttctaatttaccaaaagcgaatggtttgccgggtttgattgcaattttccagaaatttactttgcctactttttccaatactgctttagtgaaatccgcttcaccaacggaaacaccgccactggtaatcactaaatcggcttggctttgtgcggcaataaatgctttttcaaattcagcttcgttatcaggtaatagtcctaaatcaatgacttcacagtttagtttttctagcagtaattttacggtgaaacggttagtgtcatatatttgtccgctttgtaatggcttgccgacttccacaagttcatcgccagttgagagtacaccgacttttaattgacgatagcattttacttctgcaatgcctagagaggctaataatggcaaggaaactggggtgagcggtgcgccttgttctaatacaacatcccctttttttacatcttcaccaatacgacggatgttttgatttggtttaggtaattcactaaaagtgatggtgccgtcttcattgagtgttacttgctcttgcattatcactgcatctgtgccttcaggaatcatcgcgccagtcataattctgaccgcactttttgatggccattcctctttgaatggattacctgcaaaagatttccctgccactgaaagggttaaagattgttgtaaatccgataaacgtacagcataaccatccattgctgagttatcgaaagagggaacattgataggcgaaataatatcttctgcacaaattcgattggcggcttcttgtaaatttaggtattcagtttgagtcgggaagggaagctgttcaagcattttcgagcgagcttgatccaatgtaagcatagaaaatccttatttgataaaatttgtcagctattctatatctaaagcctaattcattcaaatttgcaatttttctcatttttaccatcctattatcctttgctagaatagccgattatttttttaggaaagacctattatgagcaaaatttcactggatgcactgaatgtaacaaatgccttgattgaaaaaggttttgatacacctatgattgatccaacacaggctatagatgaatctttagatatctttgcgaactccatgtctgaagcattgatgctgatgggcttaaacttgtcaatatgattgtctaatattaactcccttatctgctatctaaaattgttatttgatcacaatctttagtggacaggatttatgccatttttcctaacttgactaaatacacatatctgattatgtccccctaaagcgggccagtcgattaccttcctcttacacgtcctcggggaccttctttccgtgttaattgatgtattgttatgtgtacggttttattcttcgcatttgggtatgtgcttttttatctactcatgcgcccttcttttgcctctctcctcgtcttagtactctctactaaccacttctgatatatagagaccttcttttctacgcggattggcggtctatcttcccgacttctctcctcttcgtatagcctcgccacgtagttcctacctcga

SEQ ID NO: 367 - DNA, 2721 bp, H. influenzae
  misc_feature (2694)..(2694): n is a, c, g, or t
aagggcaaagtcctaagaattttaccaatacaaaattgttaattaatgcggtgccgataatcaataaaatatagtgcgtcattatttttttgccttttgaataggggcgttattatccctatttatggaagcaagaacaatagaaaattttgctaaggggaaatggtaagttgcgattttgttattgaaataaaaaacgcagctaatcatttaaacgattagctgcgtaatatttggattaacaatactcaacttgatttatgaattaaatataataaaacccctaaagatcggcgagtatcttaatgacaaagatttgtcttgtaaacatagaaataaaaacttctttttttgtggataaatgtttagtacataaagtctctagactgttttgtactataacgatgaatgatattaattgcactttcttcagcttgtcgtccgaatttttttattagggatttttttaaacggtatttaacattaagtacctgtttttctttcattttttccaaaattaaatcatcactcgttgagatttcatctacaagttgtaatgcaatggcttgttgtccaaaccaatgttcgcctgttgcgattttatcaatatctaggcaagggcgattttgtgagacaaattgtttgaataatttatgtgtttcttccaattcttgttgaaatttttgtttgcctttttcagtgttctcacccaatacggtcactgtacgtttaaattcgcccgcagtcattacatctacatcgacatcgtgttttttcaatagtcgatgaacatttggaatttgagcgacaacgccaatagaaccaataacagcaaaaggtgcggatacaattttatcggcaacgcaagccatcatataaccgccacttgcagccactttatcgacggcaacagttaattttatgcctttttgttttaagcgagacaattgagaggctgcaaatccataattatgcacaataccgcctgggctttctaaacgtagtaatacttcgtcttctggttttgctacatttaaaattgctgaaatttcttcacgaagtgcggttgtttctgaggctgaaatatcgccgcaaaaatctaatacatatacgcaagctttcttttcatcttctaaagtatcgccttttttcaatttttctttgcgttttttagcattttgtttttctgcttttttttcagctttagtgcgttgtttttgttcttcttcagaaagattaaaatcacgtaataaacgaacttgttcattaaattcttctgataaatctttaatttctaattctcccactttagacttgttatgttggcgataagaaataatcaaaccaacaatagcaagaatgagtaataaaattgttaaaatttccagaataaaaattccatagcctgttaaaatatcgttcaacattgttactcccgttgatatttaatggattaaattttcacgacactggtttagtgtgtagatcgccaacataataaaacattgtgattgtttgtgctatttataacaaaaaattttaaattaattcttactttttattttcattttggctaatttggcatagcataagcgagtatttcatttatatcaaaggagcaattatgaaattacgcgctgttgtattaggtcttgccacattatgcacaagtacggcaacctttgctggaatgggtttccacttcatctaaccttgagtttttagcgattgatggtcaaaaagcctctaaatctctcggaaaagctaagccatttactgtagatgatacccaaagccatcaggttggtgtgcgtttaaatgaaattgttggttcaggatcgaatcaatctctttttgaatctaatcctgtgattgtgacattcaaaggtaatgctgaagatttagttatttccgccccagctattcgtaatcttgatagtggcgataaattcaatcaaatgccaaatattactgtgaaaacaaaatcaggtaatgctatttcagcgaaagtggatgtgttaaaacaagaaggtttattcccaagtggtaatgtgctaaatgatcttgctgaatataatgcgtctggtgcagcggcatcagtttctaaatttactgcaacaacttctgctaattcaatggttgctgtgccagcaggtaatgcaaaagcgaataaaggcaaagtggttgttcagggcgaaaacgttgcagagcaacaacttcaatattggttccaacaagcggataaagaaactcaaacacgttttttaaactgggcaaaatcccataaataatgaccgcactttatacaataaaaagtgagccttgttgctcacttttctattttgataaggatttgaaatgaatattcggttaaatgctaaagtaatttctacaattcctgtttttattgccgtaaatattgcggcagtgggaatatggttttttgatatttcttcgcaatcaatgcctttgattctagggattattgcaggtggtttggtggatttggataaccgtttaactggacgattgaaaaacgtattttttacccttattgccttttctatttcttcctttattgtgcagttacatattggcaagcctatccaatatattgtgttaatgacggtgctgacatttattttcactaatgattggtgccgtggggcagcgttatagcaccatgcttcggtnctgggtaccgagtcgatatcgtataca

SEQ ID NO: 368 - DNA, 2013 bp, H. influenzae
gcgttaagtatctcaatatcttcccctattcgccaaatcttttataggctacccctgttttccaagcccgctcccccttaggcaaagtttccttcaaaacgagcagttacatcttcttttacaatatcatcgttctgctcggtgatattgtcgtcaaatttcaggcgtttcagcgtgccatcttcgattaatacgaatttaaggttgttttcccactcaagcgcgagtttagagatcaagccattttgaacaagctcaataatttcctcgtcttcaacatctttttgcttgcagtgaataacgccaagatcttctttttcgcggatttccacttccttacgcaagattagccaatcaggtgcagtatctgtaacccatcttgtcattacttcacacggcgcacagttaaacgccaacggtactactagcaaactacctagcgatttgcgcaaaagtgcgagtgcatcctcagctgttttacttgatgctgcatcaacaaagataagttgtttcaacgtgtcgatgtaaagtgcggtcgttttgatgcgagaaaatgcttgcggaagtagagtagctatcacgtcatcttttaaagatgatcgttctactttctttaattttcgctgttctttttcttcaagtgcagtgattcgtttattgagttcacgattcacaacttccacaggcaaaatcttctcttctcgtttagctacaagtaagatttttccgttcgcttgatgtgctaaattttcgctggtgacgagcggagcagaccaaccgaaatggctaacatctgctgaaccacacggagtaaattcacattctttgagttgtttttcgatattctcaaagtctatttgttttgttaattggtaaataattgcatttctgaaccagtacatttttattattcctcataaataaaaagccgctaattaatagcggcagattttaagcatcatcttcgtagtagtgttcttcaaccacgaatctatcactaccatagacaggttctctatatggtttttagtcatctttaacctcaacaaactcaccaaattcatctaacgtgtaccaagtatcagctttgatgttattttcaccgacttttgatgctttgatatggattagctcgccatcatgattgcgatatacacaaacaatagcaccattaatactcgccttagctttagattgccaaccaagcgcaacagctatagattgcttgccagatatttccgctaccgactgatcgcctgtattagtcgctaccgaccgatagcctgtattagtcgctgccgaccgatcgcctgtattagtcgctaccgaccgatagcctgtattagtcgctgccgaccgatagcctgtattagtcgctgccgaccgatcgcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattggttgctgccgaccaatcgcctgggtaccgagtccgaatcgtatacca

SEQ ID NO: 369 - DNA, 2813 bp, H. influenzae
atgttaaacgaatatcggactcggtaccccttggtgggcggcgttgcatggttataatcatcctcgtttaaatgcggcggcacagaatcaattagcaaaaatgagccatattatgtttggcggatttacccatgaccctgcggtggaattagctcaattattggtacaaattttgcccaatggattagataagatcttttttgctgatagtggttctgttgcagtggaagtagcgatgaaaatggctattcaatatcagcacgctaaaggagaagtacaacgacaaaaatttgccactattcgttcaggttatcacggcgatacgtggaatgcgatgtcagtgtgcgatccaaccacagggatgcatcatttatttcatcatagcctgcctgtacaatattttcttcctcaacccaacattccatttaatgaatcttggaatgattgtgtcattgaacctttagctgatttacttaagaaaaaaggtagcgaaatcgccgcactgattttagaacctgttgtgcaaggtgcgggtggtatgtatttttattcgccaacttatttagtgaaagcgcaagcgctttgtaaacaatatggtgtattgctgatctttgatgaaatcgccacgggatttggtcgaacagggaaattatttgcagctgaacacgcaggcatttcgccagatattatgtgtatcggtaaagcattaacgggtggttatttaactttatcggcaagtattacgaccactgaaattgcgcaaattatttgtagcggtgaggctaaatgctttatgcacgggcccacttttatggcaaacccgttggcttgtgcaattgcagcggaatctatccgtttattgttggaaagtccttggcagcaaaatattcagcgaattgagcattccttaaaacaacagctttcgcctttagctgaaaaagattacgtcaaagaagttcgtgcattaggggcgattggggtggttgaaatgaaaagtgcggtaaatatgaaaactttagttccacgttttgtggaacaaggtgtttggattcgacctttcggaaaattggtttatgttatgccaccatttgtgattaaagatgatgaacttcagaaattaacggaaggcatgattttggctttaattcaggaatatgaacattaggataaaaaatggatgctttcaaacagcaactggaacagcttagcgcacaaaatcaatatcgttcaattccagatttagttcatcaaggacgatatattatgcgagaaaatcgcaaaatgctgaatatgtcatctaatgattatttaggtttggcatcaaatgaaaacttgcgccagtcttttttacagcaatacggcggtaatttcccctcttttaccagttcttcatcgcgtttattaacgggcaactttcctatttataccgatttggaagagcttgtcgcacaacgtttccaacgggaaagtgcgttattatttaacagcggctatcacgccaatatcggcattttgcctgctttgacgacgaaaagtttgattttggcagataaattagtgcatgccagcatgattgatggcattcgtttaagccaatgtgagttctttcgttatcgtcataatgattatgaacatttgaaaaatctgcttgaaaaaaacgtcggaaaatttgaccgcacttttatcgttaccgaatctgttttcagtatggacggcgacgtggcggatttgaaacagcttgttcaattaaaaaaacaatttcccaatacttatctttatgtggatgaagcccatgcaataggcgtttacggtaaaaacggattaggtattgccgaacgagctaatgtgatagctgatatagatttgttggttggcacttttggcaaggccttagcttcaatgggggcttatgtcgtctgtgatcaaatattaaaagaatgtttgattaatcaaatgcgcccattgattttttcaaccgcattgccgccgtttaatgtggcttggacttattttatttttgaacgattgccgcaattctcaaaagaaagaagccatcttgagcggttaagtgcatttttacgccaagaagtggaacacagaacgcaaataatgccaagccaaacttgcatcgttccctatattttaggcgaaaacgaagcaacccttgctaaggcgaaagatctgcaagagcaaggttattattgtttgccaatcagaccgccgacagtaccaaaaggtacatccagaatacgattgtctttgacggcagatatgacaatggatgaagtgaaacagtttgtggcatgcttataaggaaataatgtgaaaacgaaattttatgatcatcaaggtgagcatttaatagtttattttgctggctgggggacacctcttgatgctgtagttcatttgattttgccaacagatcatgatttattaatttgctatgattatcaagatttaaatttggattttgatttttccgcctatcggcacatccgtttggtggcgtggtctatgggcgtttgggcggcagagcgagtattacaaggaatcaccttacaatcagcaacagcagtgaatggaacaggtttaccttgtgatgatagcttcggtattccctatgctatttttaaaggtacgttagataatctcacagaaaatactcgttcaaagtttgaacgtagaatttgtggtgacaaagttcttttgaacgttatcaacaattttctgcacgaccatttaacaaaattcatcaagaactcaccgcacttttgcgatgatgggtaccgagtccgatattcgtataccag

SEQ ID NO: 370 - DNA, 3194 bp, H. influenzae
ttgctgtattgtttttagctaccacgccattaattgcggaagataatctaagtgcgggttcttttacggtagttttttcatctatgttggcaatgatgcgcccattaaaatccttaacgaatgtaaactctcaattccaacgtggaatggcagcatgtcaaacgctatttgccattttagatttagaaccagaaaaagataacggcacttataaagcagaacctgcgaaaggtgcgttagaatttaaaaatgtgagttttgcatatcagggaaaagaggaacttgcattaaataatatttcttttagcgtgcctgcaggaaaaaccgttgctttagtgggacgttctggatcgggcaaatcaaccattgctaatttagtgacacgtttttacgatattgagcaaggcgagattttactggatggcgtaaatatccaagattatcgtttatctaatttgcgtgagaactgtgctgtggtttctcaacaagttcatttatttaacgataccattgcgaataatattgcttatgccgcgcaggataagtattctcgcgaagaaattattgctgcagcaaaagcggcttatgctttagagtttatcgaaaaattaccgcaaggttttgatacggtaattggcgaaaatggtgcgagcctatctggtgggcaacgccagcgtttagcgattgctcgcgctttattgcgtaattcgccagtattaattttagatgaagctacatctgcactagatacggaatcagaacgcgccattcaatctgcattagatgaattgaagaaagatcgtactgttatcgtaatcgcccatcgtttatcaaccattgaaaatgcggatgaaattcttgtgattgatcacggagaaattcgtgagcgaggcaaccataaagcattgcttgaacaaaatggtgcttataaacagctatacagtatgcagtttagtggctaatttattaattattgaaaacgcgagttgaaaaactcgcgttattttatccgcacttattagaaaggattttctatgcccttctggtattccaattccaaacttatttggctcttatcgcctttttctttattgttttggttgattagccaactgcgtcacgccttattttgtttggggataaaatcttcttatcgcgcaccaaaaccagtgataattgtgggaaatttgtctgttggtggaaatggcaaaacgcccgtggtggtgtggcttgtggaagaattaaaaaaacgaggtttgcgcgtaggtgtgatttctcgtggttacggcagtaaatctaaaacttatccgttattcgtcactgaaaatacgcgtccgattgaaggtggcgatgagccagtattgatcgctaaacgcaccaatgcgccagtcgtgatttccccgaatcgccagcaagcgattgaattactcttaagccaagcagagtgcgatattattgtttctgacgatggtttacagcattataaattacagcgtgatttggaaattgtcgtaatggacgctgagcgcgcattgggaaatggttttgtattgcctgcaggcccattgcgtgaattaccaagtcgattaaaatccgtagattttgtgatcactaatggtggaaaaaatcagtattcagatgcagttatgtatcttgtaccccatttcgcaattaatttaaaaaccaatgaaaaacgccaattaaaggaatttcaatctggtgttgccattgcagggattggcaatccacagcgtttttttactatgttagaaaagttagggattcaattagaacgaactcaagcatttcaagatcatcaacattttgaagcctctcaattagaaaaacttgctgaaaatcaaccgctctttatgacggaaaaagatgccgtaaaatgccaatcttttgccaacgataattggtggtatgtccctgtagatgcagagattattgaggctgaaaaacaatgtgaaaatttaccgcacttttgggacaaaatagacaaacttgtggcgcaatatagaaatggctgaaaggatttatctccagttgttttgattgcttaccgagaaagctgaaatattaaagaataaggaataaattatgtcatttaccgttattatccccgctcgttttgcatcaagtcgtttacctggaaaaccgcttgccgatattgcaggtaagccaatgattcaacatgtatttgagaaagcgctgcagtctggggcgaaccgagtgattattgccaccgataatgaaaatgtggctgatgttgccaaaaattttggcgcggaagtgtgcatgacttcggttaatcataattctggtacagaacgtttagcggaagttgtagaaaaattagcgattcctgacaatgaaatcattgtcaatattcaaggcgatgagcctttgattcctcccgttatcgtgcgacaagtggcagataatttagcaaaatttaatgtcaatatggcaagtcttgcggtaaaaattcatgatgctgaggaattattcaatccaaatgcagtgaaagttttgacggataaagacggctatgtgctatatttttcccgttcggttattccttacgatcgtgatcagtttatgaatttacaggatgttcagaaagtacagcttgcggacgcttacttacgtcatattggcatttacgcatatcgtgcggggttcataaaacaatatgtgcaatgggctccgactcaacttgaaaatctagaaaaacttgagcagcttcgtgtgttatataacggcgaacgcattcacgtagagcttgcgaaagaagtgcctgcagtgggggtggatactgctgaagatttggaaaaagtgcgggcaattttagcggcgaattaaaatgtttgatgctaaaaagttcttagcggatgtctctcacgaacctggtgtttatcgtatgtatgacgataaagatcaggttatttatgttgggaaagcaaaggatctaaaaaaacgtctttcaagctattttcgtaaaaatctgagtagtaaaaaaacagaggcgttggtagcatcaattcatcatattgacaccatgctaacttcatctgaaacgggagcctttactgcttagagcattattttattaaggctttatcagcctcgctataacgtattattgcggggagataaacctatccatttttttattaaccacaaacgcc

SEQ ID NO: 371 - DNA, 2525 bp, H. influenzae
cagaaaacccatttcatcgcacttaagccaacaattaaaactgcgcaacccccaaatcaataccaattgcagagaattttgcaattaacgcgactaaaggatttttttgtttgccacgttgataacgccagctaataaaaaacggcgtattcatcacgccccctccttcaaaagaccatcttgcataactaaacggcgtgataatttttccgcaagccccatatcgtgagtgactaataaaaaggcgatattttgttcttgattaagttgttgaatcagctcaaaaatactttcagtggtcttgtgatcgagatttcctgtgggttcatccgctaaaactaacgatggattattcactaaagcacgcgcaatcgccacacgctgacgttccccaccagaaagcgcagaaggacgatgggtaattctatggcttaatcccaccgcacttagcattttttcagcgcgatctttcgcttcagttttattttgatgaccaatcaacatcggcatcatcacattttcaagtgcggtaaaatccgccattaaatgatggaattggtacacaaatcctaaataacgattacgcaaagcagctaattcattagccgatgctttttgcaaggattgtccattaataaacacttccccactacttggctgatcaagtccccctaaagtatgtaataaagtacttttccctgaacctgaactccccacaatcgcaaccaactctgcaggttccatagaaaaagaaacgccttttaacacttgcgtttgattttcgccctcttgataaaatttattgatattttcgcattttaataaatagttgttcattttttactcgttttaaccgcactttagcggcagataatcccatcaaaaacttgcgcgagtctatcacacttttccttgagcttaaatttcaatacacccaaagtattcaaatcctgtttcaggaaaatgtttttcaagataacgttttaaatagcgttgggtttcttgactaataataggatcatattctgggtaaccgttatacattacacttaatactgaaatacctcgagtacgacaagcctctaaacttaataatgtatggtttatactgcctagttttcccgatgtccactaaaattaaagggtaattatttaactggatataatccaacgtcgtctcttcttcacaataaggtaccattaagccaccaggcaccctccaatagtacataatcatatttttctgccaaagtgcggaagatttttcaaggatttttgcttcaatttttttacttttctcgctttgcagctaaatgtggcgaacaaggatattcaaaaacataagggcaggttttgccttgtaaatcttcttccgttaaatcaatgtcttgaatctttcgatgcacaagtaaatcatcagcgatatttttacagcctgtttgaatcattttttgtgtaatcacggagcagccttgttccatcaattttttagcataaatgcctgtggcaatcgtttttcccacatcagtatcaatgccagatataaaaataaccttgcccataaatattccttactgattttctatgtgagaatagcgtgcgataaaaaataacggatgataagtcaggcgcactttgtccgacggcatactgaacgccgacaagtaatcgccaataaatccattgagattttttcttgtccaatttttttggttagtcgctgttacaccggtatatttcagatgtttgagtacatccaatggtgtatcaaagtctagtattacattaaaatcctcacaccataaaagctcaaaatcattggctaaccaattttgccattgggataaagtcgggtaatttaatcctatatttgtgatctggcggacttctttcaaattgtcttcgccaaaggttgcaaccgccaataatccgtttgttttcaagcctgttttgcaatgggcgataaaagcgtcgggttggtgaaaccattgcacggcggatgcacttgcaatcaagtcaaatcgtcgttgaaaaggaaagttctctgcatcaccacaataaaaatcaaagggttgaatcagcttttcagtgagtagagtgcgcacatcgcacaaatcattaaataaccaatagttggctgaaatctgtttctgcaacaacgtactcaacataccagacccgcaacctagttccaaaacgctatctaatgacccatttggtaaatagtcttgcaaatgcatcattaacttaatattcattttttgttgaattaacgcatgttcatcatagctatttaaggctttttggaaggcttgttgaatacgcgatttatttacggaagttaatgattccataatgccgaccagtgggtaaatcttgaaaacacataatgctcaccctctattttctgaacggcacaacgggatgcccaatattggttctgattggctggcgtaaaaattttatcgcgagaactaaccggggatccttctagaagacgacctgcagggcatgcaagtcatggc

SEQ ID NO: 372 - DNA, 3233 bp, H. influenzae
ttcttggaaaaattttcaagagcaactcaatcaactttctcgagcattgcttactcacaatattgacgtacaagataaaatcgccatttttgcccataatatggaacgttggacaatcgctgacattgcaaccttacaaattcgagcaatcacagtgcctatttactcaaccaatacagcccagcaagcagaatttatcctaaatcacgccgatgtaaaaattctcttcgtcggcgatcaagagcaatacgatcaagcattggaaattgctcatcattgtccaaaattacaaaaaattgtggcaatgaaatctacaattcaattacaacaagatcctctttcttgcacttgggaaagttttattgaaacaggttcaaacgcccaacaagatgaactgactcaacgcttaaaccaaaaacaattatcggatttatttacgattatttatacctcaggcacaacgggagagcctaaaggtgtcatgttagattacgctaatctcgcgcatcaattagaaacgcacgatctttcacttaatgtgacagatcaggatatttcactttcttttttaccattctctcatatttttgaacgggcatgggcggcttatattcttcatagaggcgcaatactttgctatttagaagacaccaatcaagtacggtcagctttaacggaaattcgcccaactttaatgtgtgccgtcccacgtttttacgaaaaaatttatgcagccgtgctggataaagttcaaaaagcaccaaaacttcgccaaataatgttccattggacaatttctgtaggacaaaaacattttgatttacgtgcgaataacaaagctattccgttcttattgaagaaacaatttgctttagcggataaattagtactctcaaaacttcgccaattattgggtgggcgtataaaaatgatgccttgcggaggagcaaaattagaaccggctattgggttatttttccacgccattggtatcaacatcaaattaggctatggcatgacagaaacaaccgcaaccgtttcttgctggcatgatttccaatttaacccaaattcaatcggcacactcatgccaaaagcggaagttaaaattggggaaaataatgaaatcctcgtgcgtggcaaaatggtaatgaaaggctattacaagaagccagaagaaacggctcaagccttcacaaaagatggtttcttaaaaactggcgatgcgggagagtttgacgaacaaggaaatttatttattaccgatcgtatcaaagaattaatgaaaacctcaaacggtaaatatatcgcgccacaatatatcgaaagcaaaatcggtaaagataaatttatcgaacaaattgcaatcatcgcagatgcgaaaaaatatgtgtccgcactgattgtgccttgctttgatagtttggaagagtacgctaaacagatcaatattaaatatcatgaccgtttagaattattaaaaaattctgacattctgaaaatgtttgagcaacgtattaatgcggtgcaaaaagaattggctcactttgagcaagtaaagaaattcacgctactctctcaagcattcagcattaaattaggcgaaattacaccaacattaaaattgcgtagaaaagtgattttggaacgttatcgcaagcaaattgaagcaatgtatcattcacaagaagcataaccaaaaggctctcaattgagagcctttcttttctaattattcaggaaacttttcttctaaaatcaatgcaagtccatcttcattattggttgccgtaatcacatttgccgcttgtttaatttcatctggcgcatttcccattgccaccccaagtcctgcgtgttgtagcatatccaaatcattaaaattatcgccaaatgcaatcacttcattgggtttgtacgccaaaataatcttccaaaaaacgcaccgcacttcctttggttgcattcttgtgcattacctctaaaaaattagcgtgggaacggcaaatacttaaatgtggaaattttttctttaaaagaacttcaatctcaatgatttcttctgcttccccaataatttgaattttatgtggcgaacttgtcgctacttcatcaaaaggatgaatctcaattttggtcacgctgcattcataaatcacccatttattttctacgtcacgagcatggcaatcattatttgtataataattcacgccaagcaaaggatgttccgccaaaacggtattaatctctaaaatatcttttggatcgatttgtacgctataaattggttcgagattttggttcaaaataagcgcgccactaaatgcaacaagcacattattcgtttcaagctgtttccaataaggcaaaatacctagaggagaacgcgccgaaattggcacaaaaggaatgccattcgccgttaaacgcttaattaccgcaacagttcgaggggaaatggtatgttgagaggttaataaggtgccatcaaaatcactaaatactgctttatacatcattactccgaataaagattatttctctgctaaataaggatcatcaaagcctaatccttgcataatttgggtttctaaactttccatttcttccgcttcatcgtcttcaatatgatcataaccgagtaaatgtaaacaaccatgcacgaccatatgcgcccaatgcgccattaatggtttctcttgttctgcagcttctcgctccacgacttgacgacaaataacgagatcccctaacaatggcaactccacctcatcggggcattcaaatggaaatgaaagcacgttagtcgggcgatcctttccacgataagttaaatttaattcatggctttcggcttcatccacaatacgcaccgtcatttcgacttcattcccttctggttgaacagcacctgttgcccactgcaatatctgctcttctgtcggcaaaccctttatatttttctgtggcaatttgcatactatccaatactcttcccattctactttcctaaatgtttttatactccaaccgcattttccgccttattgaattcttataccaatgggctgcgcttatgaccattttttcttggtataatatcgaggggaatatatcatactaactctccaatccccctaattagattacttatttatttcttccgctcctccactttatttttactctcctatatactattccccgtatccccttattaatccaaaccc

SEQ ID NO: 373 - DNA, 1854 bp, H. influenzae
ttcaacgtttaaaagaccaaatgcttcagtgaaagagggcataaacccgtcgaaaaattattattgagctgttctgaccgcacatcaaacagaaacaacacgtcgttcattaattcataaacacattgaaatcaataaatgttaagcaagctagaacatcatgatttaacggaaaaagaacgcaattatattgaacgtctattacttcgtttaatcgctgaagcatggcataccaacgaaattcgtactgttcgcccaacgccatttgatgaggctaaatggggctttgcgatgttagaaaacagtttgtggcaagctgtgccagaatttttacgccaactcaacgaaaccgcccgtgaatttttaggttacgatttgccggtaggattaaaacctgtgcgtatttcctcttggatgggcggcgaccgtgatggaaatccatttgttaccgcacaaattaccaaaaaagtactttattttgcccgctggaaagcggcggatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggagccgctttacgattgttatcaatctttaattcaatgtggtatgcgcattattgcaaatggttcattgttggatattttgcaccgtattagttgttttggtgtgacgctttctcaaatggatattcgccaagaaagcactcgtcacaccgatgccattgctgaaatcatgcgctatattggtttgggcgattactctcaatggatggaagacgataaacaggctttcttaattcgtgaattaagctctcgccgtccattgattccgcaaaactggacgccatcgcctgaaaccaaagaaattttagatacttgtaaagtcattgctcaacaaaaacaaggtgtcattgcgtgttatgttatttcgatggcgcgcagtgcatctgatgttttagccgttcatttactcttaaaagaagctggcgtgccatatcatattcctgttgtgccattattcgaaaccttagaggatttagatgcagccgaaaaagtgatgactcaacttttcaatgtgggttggtatcgtggcgtgatcaataatcgtcaaatggtaatgattggctattcagattcggcaaaagatgcgggaatgatggctgcttcttgggcgcaataccgtgcgcaagaagccttagtaaatttaacagaaaaacttggcattgaactcactttattccacggacgtggtggcacaattggtcgtggcggtgcgccagcacatgcggcattactttctcagccacctcgttcattaaaaaatggtttacgtgtaacagaacaaggcgaaatgattcgtttcaaactgggtttacccgcagtagcagtagaaacctttgatctctacgccagcgccattttagaagcaaatcttttaccaccaccagaaccgaaaccagaatggcgtactataatggacgagctttccacgatttcttgcgatatttatcgtggtgtggtgcgtggcgataaagattttgtgccttatttccgcagtgcgacgccagaacaggaactctccaaattgccgcttggctctcgccctgcaaaacgcaatccaaatggcggtgtggaaagtttacgtgcgatcccgtggatttttgctgggggtaccgagtccgaattcgataac

SEQ ID NO: 374 - DNA, 2401 bp, H. influenzae
aacatccattggtgtaataatatcttcaaggcgttgttctagcgcatttactgtaccgattacatcaaattcttggcgagaacaggttgggcaagcaataaagttaattcctcttgaacgaatccgtaaagatttcaaaatatcaaaaccgactttgatttcctctatgggatctgccgccaaagagatgcgcagtgtatcaccaatgccctcagctaataacattcctaaacccaccgcagattttactgcgccagcgcgtgcgccacctgcttctgtaatgcctaaatgtaaaggctgtttaattgctttagccagtaaacgataagattcaaccgctaagaatacatcggaggcttttacgctcactttaaactgatcgaagttaagacgatctagaatttctacatgacgcaatgcggattctaacaaggcttctggcgttggttcgccatatttttcttgcaaatctttttctaaagagcctgcatttacaccaatacgaatcggaatatttttgtcttgcgcacaatcaacaacggcacggacgcgatcttcacgaccaatgttgccaggattgatacgtaaacaatccactccatattctgcgacttttaacgcaatacgatagtcaaaatgaatatctgctacgagcgggacattcacttgttgtttaatttgtttaaatgcttccgcagcatccattgttggaacagatacacgaacaatatctgcaccaacacgttctaatgatttaatttgagcaactgtcgcttccacatcagtggtgcgagtatttgtcattgattgcacggcaatcggtgcatccccaccaattggtacatttcccacataaatttttgtcgattcacgacgcttaatagttggctgaaaagctgacattatttttcctaaggttgtgaaagcttgaattttgctacgcgaccatccactttgagaggataattctcgcctttgtaagtgatacgcacattgcttggtgcgcctacaattaatgaaaattcattgccattaaaggttaatatttcgccttgtttatattctttttgtgctaatacgtggcgagcgttatcttttacactaatccaactgctatttgctagtatttcaatcactaaatcgccttttgctataggtaacgttggagaaatacttggattttcgcccgcactttgaatgtctgaaactgatttttcatcgtttttgggttgtgaaacgctattttcttgtgctatttctggtaacagattatttgttatttctactggttgtgagactggtgctgctgtttctggtgcagatttattagtttcttctgttgtcacaagagcggtggtgggctgattgttttcggtagaggcaacatagctttgcactaaatcatcgcgttcttgagtattttgttgataactttgccaccaccaaagcccagtcataccaattaccatcacgaatactattgcggttaaacgcccgatccaacgattgtgagaagaatattgattaacggcacgggttgaacgtgcatttttccctaaatcatttttttcggtttcagcaaaaacaatattttcccacacagaatctggcaaacgtaagaattttgcatagctgcgaacataacctttgacaaatatagaaggcgttgatttttgaataaattcattattttcaagttgctctaatatagaagggcgtagcgtgatttctttagcgacatcttcaagagaaagatttaaggcttcgcgtgtttgacgaaaaatctcaccaggagaaagcacttgctcagtagttggattcataaagttaatcaaataattaggcggtaaataagggctaaattttaaagtccaatacttgatttggcaatgctttattttagactattgaatttttccgcacgttttccattgatttgacgtaatttttctaatgtttgctgataaatatccatttttttcgcggaataagcacaaagcgcgatattttcaaatgtatctgcttgatgataataattcggcgaattaagggctaattcaaattgttgctgggcttgctcaaatttcttttgactacatagaaacgtaccaaaattattatgtacatcgccttgtttatgattaagttttacggctatttcatactcacgaaaggcattttctatttgcccttgttgttgataataatgcgcaagtgctgaatgtccgagatagtattttttatcgtgctgaagggctttgcctaatttgattttagccagtggggattatttctgtgcaaatgcctcaagcgagtttccccttctctttgtcgtatgttggatacctaatctctaccccctttttcaacccctttggtatttctccccgtcacacttctg

SEQ ID NO: 375 - DNA, 2209 bp, H. influenzae
  misc_feature (139)..(139): n is a, c, g, or t
ccgccttcaaagtcaaaatgactttcgacaatccaatgaggatttaacgcaatttttgcttgcgacagcgcatttttataaccttgcaaacgattttgtgcgacagattttttgagatttcccgtaataatgccaattntacgatgtcctgcatcaattaatgcttttgtcgccaaatagccaccaagtgctgaattttcgagtattttatctgcatttaactcagtaaaccaccagtccatcacaaccagtggcagcgaaatggctaactctatatcagcctgaaaacggctatcaccacacatcaaaagcaaaccatccacttgtttgtgcattagagtttgcagattttgttgtaggcgtttggcatctccacccgttgtagcaataataagattatattgatttttctgacaatattgctccacgccagccatcacttccgcaaagaagggattatttgttgcggtgacaagtagcccgatagttttggtttcgcgcaccttaaggcttcgtgcaacagctgaaggggtgtaattcagttcagcgacaatacgcatcactttctcacgaatttcatcgctaacaaaacgcgatccattaatgacatgtgaaactgtagaagtcgaaacttgcgccagtcgtgcaatatctttcattgtcgccataaaaacaccctaaaaattcaccgcactttaagcgtgttcaagaaattccaaagtttcttgacgcgttggaatagaggattgagccccttttttcgtcacactaatcgcagcggcagcttgaccaaaacgaatggcttcatcaaaggatttttcttccaataaagccgtaacaaaaccgccattaaatgtatcaccagctgcggtagtatctattgcttgcacacaaaagcccttaatgatgcggcttttaccttttcgactgacaaacacacctttcgcgccaagggtaatcattacggtttcaatgcctttatcgtgaaaaacactcgcagctttcaccgcactttgctcgtcggctaccgctacccccgtcaggatttcagcttctgtttcatttggtgtaataatatcaatcaaactcaataattcgtccgataaaatctgcgctggagcaggatttagcacaaccttaacaccatttttcttagcgatttgagcagccagctccacaccagaaagtggggtttctaattgcattaacaagcaatccgattgtgcaatttgcgcctcactttgacgaacgaccatctcacccaaatgtgcatttgcaccgctagccaacacaatactgttctcactagacttggcgacttgaataaatgccattcctgtcatttcctgtgaaacggtattaatatgggttgtatcaattccttcttgctcaaacgcatttttcattgttttgcctatgctatctgatccaatgcaactaatgaacgctacctttgcacctaaacgagcggctgccactgcttgattggcacctttgccaccataggcaatttgataattttgacctgttagcgtttcaccgggtttagcaaagtaaggcacagaaataacgtgatcagcattgatactaccgagaaccgtgagggtttttttcattattttatcctgtattgttatattttttctttctacacaatgggacaaatataatttgccccataatgtgatataacgagcttatttagtagatagattattcacttattactttcaaatctactggaattttcgcttcaactttttcgccctttaagattttatcagcggtaacaacacctaatgaaccaataagctcgggttgttgtgcgatagttgctgccattttgccactttttaccgctttaacaccatcatcggtaccatcaaaacctacgataaggacttttttatttgcggctttcaccgcacgtaatgcacctaatgccatttcatcattttgcgcaaaaattgcttgaacatcacctttagatgccaacaaattttccgttacattcaaaccttttgttcgatcaaaatctgctggctgactggcaagcacattgaatttatgagcatcaatagcttgtttgaaaccctcacctcgttcgcgtgccgcagatgttcctgcaataccttcaagttgaatcaccttggcattatcgcctaattctgtgcgataaatcacctgccttttaccactgcggggtctc

SEQ ID NO: 376 - DNA, 1855 bp, H. influenzae
cgttatactatatcgactcggtattctcacttctcctaaaacgttaaaagcacaaccttaatctgttgtgctttttgattgatgccatctacaagtactagtttacgatcttttatcatcaaatcgtgttgtccactcaattttaaatcgatcataatggtttccctgttgtaccaccgctatcgcctttgtgcttgtgactttgtaatgacacaccatctgccataacatcgccagttgtcgttaaagaaccactaacggatacactgccactgttacctgccgttgaaataccgccatttacgattacattgccgttaaaggtgctggttgtcgcagtcacagtaaaattatccgttgttacccttacatcaggcgaattgatcgtaatattgccatttggtgcgattttaattttaccgctaccgtatttaatacaaaggttctcaacatcggcatttggagagcgactattaccgcccattacacaaaaagcatcggataaatcaaacattcgcggatcatctggcgcatcattgcttccacttaaccaattttctagagatcgctgcgaaaaaatcagcaagcagccgtctcccgctttcactggtaatgtcacttgtgctaccgcaccgttaatgtctgccatagggaacattaccggcacgtttacaatctgcggtgcatttaatacttcgccattggctaaccgcttaggaatagagggttgtaccgttgctcgcaccgtttccgcatcataactaacaatttttccaggtaatgacacattaatttcagaaagtgcggttaaaatatccgtcatttttaatcgtcctttttcttacgttttttacgatgtttactttgcgtttccatctgcgttttagtcggtgcgtttagatctactaaatgtagttcgctttgccaatcgctagaatgactatcccccgaatgcttgattttttccacgcggaaccaatttgttaccgtcacactttccagcttgattttgtcacaagggtttaccataggcagtaacaggctttttacattccaaccgtccctcgcttgccgatcaaaggcaaatttctcatctttctttttatttggcgtatcctgcttcttactgcgtgctgcttcacgtgtgcgttcaggaaaaccgattagcccgctatcttttgccaacacataacccgatcgctttgtcacgccattgcggtttacaatctgcagttcgccattttggatcgaccactcaagccccgttcctgcaacgactttgtctaacgctttacgtgcggcaccgtaaaaactaaaaccatttgcccaagtgcgtgatttcaaattatctgcaccaactacggttacgcccatttttgcagcaatatcattagtaatttgcgtagaactcacgccaccgacataacctaatgaaaccgccgtatcgcgaatttctaccaagccatctaaaacataaagctccgttacccaatctgcgccttcgtgatacgaatatgccgtggcaatatcgccagagcataacaacacgtcacctttctgcgcataaccgggatacagcacgcaccgcatatccggctgctaatagtttttcgtgtagtggatgcaaggtatagattttaatgggatttttcgtccgctcggcttcacatctttttcatatccgactcatacgcatgggcgctcatcacatggcatcttttgcctttcttgccatcatcattataactcgtaaaagcgatactcatcatccactcgattaaacacaccgccttgcatgataaaattacgccaatcgtgggattatcataccacggataatttcaggggattctcc

SEQ ID NO: 377 - DNA, 3042 bp, H. influenzae
  misc_feature (2902)..(2902): n is a, c, g, or t
  misc_feature (2926)..(2926): n is a, c, g, or t
  misc_feature (3026)..(3026): n is a, c, g, or t
tggtttcgaattcggactcggtacccctaggtagctatttttacactcaaaaagggaaatttaaaatgaaaaattttacattgaatctattttgcgaagttaggaaaaaatcaggtgtttaagaaaagaataattgataccgctttttaacttgatatttgcttttagtgtgtagccgacaccaattgccatcgcattacagctgccataaccgcccaccgcagcagaaaaactcgcttttccaaccacttgtggcaattctaaaccagaaagggcgttagccgccgctaaaccacgttctaatttactgtctaacttaccaattttgccatttaactcgttaaagcctgattggaaattttactattaattgtattattctttaaattaccaatgatcaggctatacgccccaaactctttaatgccgtaattcgtactaattgaattgtcactcgccgcaaaggcttgagaagagatcagcaaactgtgctgataagtgaagctgtcatggttggcttgacagatgaaaagaaaagattagcattgcttgcttgcttgcttgcttgcttgcttgcttgcttgcttgcttgcttgcagaattgtaataaaacatgttatatcctcctaggataaaacaaaaaagaagcgtgactttacgttaaataaattgatatgtaaaggaaatacaaattttttcgtgcaaattccaatatttaactttaaaatacttgcctctgaacaaacattcattataaataaaagtcacaatatttattttataaataaaaaagtgcggttaaaatcatccgcactttttagttcgtagaaaggaaaattcaatgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgtgttatagagcaagctttaacaaacaataaagatttagctaaagctgctgtagcggtaaaccgtgcgctttatagtgcgaatttagtgggtgcaaatttagtgcctgcatttaatggttcaacttcatcagcagcacaacgccgagttgatatcagtacaaactctgccacttcacacaaaggttctttaaatgtgagctatacattagatctgtggcaacgtttggccaatactgttgatgcggcggaatggtcgcacaaagcaactgcagaagatatggaatcggctcgtttatcattaatcaattctgtagtaacaacttattatcaaattgcttatttaaatgatgctattagcacaaccaacgaaacgatcaaatattacacggatattggcaatattatgcaaacgcgtttagcgcaaggcgtggctgatgcagccagcgttgatcaagctcaacaagccatattaacggcgcgtaataacaaattaaattttgaaacccaacgcaaaacagcagaacaaacactgcgtaatcttctcaacctaaaaccaaatgaagcattaaatatcacgttcccacatattatgaatgtgaaaacggcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacagttggtacggcattacataaccctgtggctgctggcacagtaggaattagcttgccattcttaaattggaacaccgtaaaatggaacgttaaaatttctgaagctgactatgaaacagcacgtttaaattacgaacaacgtattaccacggctctcaataatgtggataccaactattttgcctttacccaagcgcaaagtacattaagtaatttacagcaaacccatagttacaatcagcgtatcacacaatattatcgaaatcgctataatgcgggcgtgtccgaattgcgcgaatggttagttgcagccaatacggaaaaatcatcacaacttgcgattttgaatgcaaaatatcaagtgctacaaagtgaaaatgcggtatatagctcaatggcgggatattatttgtaaaaatcaaattggattaatctataaaaaatccctgttaaatttctttaacagggattttgttatttaaattaaacctattattttgtcgcttctttcactgcatctactgcttgagttgctttttctgaaaccgcctctttcatttcagttgctttttctttcatttcgcctactttttctgatgcagcttctttcatctcacttgctttttctgatgcagcttctttcatttcacttgctttttctgatgcagcttctttcatctcacttgctttttctgatgcagcttctttcatctcacttgctttttctgatgcagcttctttcatctcacttgctttttctgaaactgcctcttttatttcagttgctttttctgatgctgtttctgttgctgatttaattacttctttcgcatcttccactttctctgctactttatttttcacgtctgtagaaagctgctgtgctttttcctttacttcagtcattgtattagctgcagcatcttttgtttctgatgcgactgatgctacagtttgtttcgtatcctcaactttttgttttgcttcttgcttatcaaaacaacctgtcacggctaaagctgaacctaaaaccaatgctaatgttaattttttcattattttctccatagaataatttgattattacaaagccctattactttgatgcagnttagtttacgggaattttcataanaagaaaaaccataatagtaaaactttacctttctttaaaagatactttataaacaacatctaagatactgatttttaatagatattataaaaaccctaanaattttattttttgac

SEQ ID NO: 378 - DNA, 2262 bp, H. influenzae
atatttatgtttccccaagtcaaatccgtcgttttaatcttcaaactggggataaaatcgaaggcaaaattcgtccaccaaaagaaggcgaacgttattttgcacttttaaaagttgatcaagttaatgacgacaaaccagaagtttctcgtagcaaaatcttatttgaaaacttaacaccattacatgctaactctcgtttaagaatggagcgaggcaatggatcaacagaagatttaaccgcccgtattttagatttagcctcgccaattggtaaaggccaacgtgggttaatcgtagcaccaccaaaagcgggtaaaacaatgttgttgcaaaatattgcgcaaagtatcacgcataattaccccgatgtggaacttatcgtattattgattgatgaacgcccagaagaagtgacagaaatgcaacgttccgtaaaaggcgaagtcattgcgtctacttttgatgaacccgcaactcgtcacgttcaagtggcagaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggagctgcacgtaatgtggaagaaggcggcagtttaacgattattgcaacagcactagttgatactggttcgaaaatggatgaagtaatttttgaggaatttaaaggtacgggtaatatggaattgcacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaaaaacaaccgcacttctatgaagaacaagggaaaaatattatgttttcccctttttaatatccgtaatatttgacgagataaataatgatagccgataagttcataaaaggggcaaaaggtataaattcttttttctttttatgaataagcgaaaaacatattccaagcactgaggctaataataaaaagtgcggtaaggtttctaaatgaataaaacttcctaatgccattgctagccaataatctccccgtccaaaggcttcttttctataataacattttgcaatccaatagattgcgtagaaaacaataaaaaaactagccgcactttttatgctttcagataacgttagcaatgaaaagttattgtctgcgccaaataaaccgagagtaagtaaccataaacagggtgtcgtagaaataagttgatagtgccaatcaagataactgattgtccaaagaataataagtgtgagtccgatccatacagtaaaaatagaatctttgaaggcaatttgtaaaaatataaatccaaccccaatactaaaaaaatacctcaaaatatgaccgcactttttttgttgaatagaggcaaagtgcggttgaaatggagaactgttttgtggaaataattcaacgtaagtcgcataaatctcttgctgcaaatgcgtaataaaaccagataggtagaaccacaatgcgatccctaagatgccgcctaataaaaacattgtgaagtaaatcattgaataactgatcccatattaaagataggtaaatacattcccatcataataatcccaatcagactgccgatgattaccatcattaatggttctagcatttgtgagagtaagtcaatttgatgattaagtttttcttggtaattatctgcgatatgctctagcatcaaagcgagttttccgctttgttcgccaatttgtagcatttgttgtgcttccatcgggaaaagatcgctacttacgctattagaaaacgcatagccttgagaaacccattgcaaaattgaccgcacttctttatctaataccatatcgtttacaagcgttttcttggtttgccaagtttgtgtgcgaggaagaaaactgtctagtgcctgattaagcggtacgccggcctgcaacataatttgtaaactttgactaaagttcactaaacgtgaaagcttttgaattgtgccaaaaataggggtaccgagtcgatatcgtaaaca

SEQ ID NO: 379 - DNA, 2266 bp, H. influenzae
gagaccccgcacgattaacgccaccaacgcacctattgctgagactgttgtcattttttctctcctataaaaattaaaaccaaggagattatttctgttttataggggaaatgctttattagagcaaacaaaaagtgcggttaaaaatcatcaaactttgtaaagttatacaacctcaatgttctaacaacgttccgagatagagcgttaatttatcatctatcttattgaaaaataaaccagttatttgctctattttgttcaatcgataacgcaaagtattcgggtgaacaaataatttttccgcagtgagataaagatcacaatttgataaaaaatattgttgaagggttttataaagtgtcgcattttcttctgagaaaaggggagaaaggggttttatcaattcgttcccttgccaagaatgggataatccagcaagtaacacaggcaatcgatgctcatcaaacacataaatacccttgcgtggatgatgttttaatccataagaaagcgtgctttgcgcactttgaaaagacaagggaagctgctcaaaaagcggtagatttagacaagcgcctacagcaattttataatcttgttttgaataatctgcaggtaaaagcgttttcatttgagcagaaagtacggtggagttttgccaagtctttaagaccacaacctgatcaagggacaaaattgccacatcctgtgcaaattcagactgttccaaataattgatcagatgctgtaaattatccagggctggattaagtaacttaatcaatacaaccacacgagatttatttaaatcaaaagaaaaaaatttcgcctgctgttccatctttttccaattcaaattgcaatgtaataattgcaaaataaattcttctttgtaacgacgatgccagctttcttgttcgagtaaagcctgttgttccacaataagttctgcggtcattttcactagttcggcatattgtttcacctgagttggctcaccagaaatccccaccactccaatatttttgcctaaataatgaatcggtaaattaatccctggttgcgcttcaaaattccatttttgtgccaacgcttgatcaatctctaccacacgattttcccgcaacgccaacaccgctcctgtgtgccgttgattcaaacgcgttgaatttcccgacgcaatgatcacaccgtcgtgatccattacatttacagagtgatgaatgatcttcattgcacgtttaacaatttttttggcagtgtatttgtcaagttgcatatttgtaataaagaagataaatgaagataaaatattgagaaaaagaaagttagtcaaatattgttttatctgcaagaaaagacgggagactattctcccgcactgcgtttttatcgctataatgttttattctgaacttgaacatatcccataattaatgccaaaatccctagtggaaaaatgagatctattacagaaccatcatttccccaaatcaagaatagctttgatgaaaataagtaaaatcggtaagacaataggaatactcacgacatagcccgtaatggctaatgcccattcttcctttttcttacctagaaatttgataaaactgaacgccatttttcagcaactgggcagattgaagtttcaccatgtaaaggttctcgaataatgctacttacaaaggaagaagtcgctttatttggttttcctggacggatacaaattgtgagcaggcgaacacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaaataaaacgaattttagtatcagattcatcaaaatatgagaaagtggcgacattccatatttgtccactaacaaattttgatcacataatttgcgacaaaaatcttgttgaatctgcacagaatggcattagagaattaaatattaatttaactatcgtataaataaattaatataaatgatctgcaccccaaaactaaacaaataagcttactcattaaggtgcaaatcaaagtgcggttcgtttttatattatttttggctacatacagcaataaaatgtaatttatgttcaggatcattaaaggttttgcacatcttttaaattgctcacgattttccgctttcatcgcattacggatgat

SEQ ID NO: 380 - DNA, 3610 bp, H. influenzae
  misc_feature (3567)..(3567): n is a, c, g, or t
gagacccctaacggtttgttcgtccgattgacgaacataaggcatcgccacgatcccacgatcataattgccagactgtaaatctattaataattcaggcgtaagctcggcattgggatcaaaataatccaataaataatcatctaaaatgccattaggcagtaaagcatcgtcttcaattgggaaccatttttcattgggataatgtacgaaatcgccgtttgcaatttcttgtcctaaatagaaatcggcaaagaaataattagtagaaagacgctcaaaatattcgccaagggcagaggctaacgccgcttttttacttgcccctttaccattagaaaaacactgcggacagtctttatcgcgaatatgcacagaccacacatttggcacaggattcaaccaagatgcctcttcaatattaaaaccaagtgcggtcaatttttgctgaaattttgcaatactatcttctaatgcagcatctttgccgagaataaaggtttgttctgtcatttttgttcctaaataagaaaaaagtgcggtgaataataggggagttttaatagcggggcaagattttttcggcaaaaataaatcccgaaaaacttcggggttttctaccgcacttttaacgtatatttgattggcgttaaagtaaagttggattgaaccgcacttttaaggcaattgtaattgcggcgaaaattttttcatcgttgagaggaaagttttcgcataaagtgcggtgggaatcagttatgtttatttgagcttgcgataattcatttaataaaatcgggagagaaagattaagttgctcggcgatttgttgaatagagaaatgttcgaaagtcatcatcaagcgatctaaattgcagtaagaaggcatgcgattatttgtgatgagatcggcaaattgagtgttgatttttacccatttcttcttacggctataaaaatgcagtaacaaaccaaatacggtaaatccagcaaagaaaagatgaatgtctaaggcttgactaaaaggaaatcctagccacattgaaatgccacttgcaacaacgaaaagcaaacttaaggctagtccccacactaagaaaaatttataaattacttcaaatttcattgaattatccttttctacgaaataaatctgtataaggaaatatataacgttaaatattatagaaacattttgcctgtttttgctacgttatatttgaattaatatatcgatgctgtagaatttgttgtaatgtctcgtttttaaaaaagttaaaatgaaaaaacgcttaccattttaaccgcacttcgtccaaacttttacatcaacatttgaataattacattgaaaaatcactatgactatttacgacatcaattttgctgaactgtatcaacaacacttaatcgcttgtcatcattacaacttacctccgacaaaatgggataaaaaagccgtgaaaatggcagaaaatttggtcggtaagccttcagcatataatcagcaattattgcaagcaatgaatgtgcaaaccgatgaaacagtgttggatattggctgtgggcctggtacttttgctgtaccgctcgcacaacaaggttcaacggtatatgccttagattatagtaatggaatgttagattgcttggcgcagttcaaacagaaattggggttgcataatctcacaacatttcataaatcttggacggataattgggatgatgtgccacaagctgatgtagtgttggcatctcattcaacgttggtggacgatttggacgatatgatcgaaaaactctgtgccaaagcgaaaaaacgtgtgtttttgacttctgtcacacaacgccatttcttagatgagggcgtatttgaggcaattggccgtgaagatattggtttccccacttatatttatttactcaatcggttgtatcaaaaaggcattcaggcaaatttgaattttattgaaacggaatcgggttgttttcaaggtgaaatctacgaggatttattagcctcggtggaattttctttaggcgaactgtccgaaaaagaaaaacaaggtttgaaagccttttacgatcgtaaacaagccaataacgaactaatttttcatggacagaaaaaatgggcgttgatttggtggaatgtggatcgcatctaatgtttcaagtggaatcaatttatttttctatcactaattaaaaggacgattatgttatttgctttacctgcgctgaatgataactacatttggctttatcaacgagaaaatctgccgcttattattgtcgatttgcctgaaacggacaagctgtttgcatggctagataagcaaaacgcaacgattgaagcggtgttgcttactcacgaacatgaggatcatacacaaggtgtgtcggcatttaaaaaacgttatccaacagtgccgatttatgggccgcaagaatgtgagaaaaaaggtgcgactcaagttgtgaacgaagggaagatccttaccgcacattatcaaattgatgtcattccgacggggggacacactaaacagcacgttagttttttagtggataatcatttattttgcggtgatgcgttattttctgcaggttgcggacgtgtttttacaggcaattatgcgcagatgtttgatggtttgcagcgtttgaatacattgcctgacgagacgattgtttgcccagctcatgaatataccttggggaatttagcatttgcggaaactgtgctggtggaaaaaagtgcggtagaaaaacaacgtatttttgttgaaacacaacgggctgaaaataaaccaagtttgccgacaaccttaaaacttgagcgagaaattaatccgtttttacaagcaaaaacacttgaagaatttaccgcacttcgcaaagctaaagatattttctaatattgggtgaggacaaagtgcggtgattttttaaattagcagattatttctttctcgctaacatggtggcaaatttcattttaatgcgattgccgttttcatcggttttgtgtaattcgcccatattttcgttatattctaagaattcccaatctttgtaatattctttcaattcgttttcagcaaaagtgaatgagaatggaagtgggcaaggcacatcatctgtggacattgcggcaacgattaaattatatccgccaacattggtatgttcttgcatatttgtgatgattgacggcacacgttcacgatttaagaacataaacaccaccgttgaaacaataaaatcatagttttcttgaatgttggcggcgttaatgtcgtaaagtgcggtagaaatattaaggttttctttctctttggtttcatttaaaaaggcaatgctgttttcattgtgatcccaagaggttacatcatagcctaataaacttaaataaagtgaattacgcccttgtccgcaacctaaatctaatactttacaaggcgagataatttttgctgcatccaccacatcgccgtgaatggcagtcatgttgtatttttactgaaatatcttcttttttgcaatagaaacctagggtacttntagggcggggtctcctagagtcgaccgcaggcagcaagctggc

SEQ ID NO: 381 - DNA, 2265 bp, H. influenzae
gactgcctatgcatgcctcgcaggttcgcactcttatagaatccccttccaaataatttacctgccaaatctttacaaaaatgaatttttgagctaataagtagaagactttttataaaaatatcgcctaataacaaggaggttcaaatgcaacacaaactactcttctctgcaatcgctcttgctctttcctattctgtgcaagcagttatagtgcctgaaggaacacaattagatgaaaaacaacatatcgtcatcaataacggggctgaaccgcaaagttttgacccacacaaaaccgaaggtgtgccagaatctaacgttgcttatcaattacttgaaggcttagtcacctcagactctgaaggtaaacttcaaccgggtgcggctgaaagctgggaaaatacacctgacttcaaaacctggacattccatttacgtaaagatgctaaatggtcaaacggagatcctgttactgcacacgatttcgtgtttgcgtggcgtcgtttagtggatcctgcaactgctgcaccttatgcgagttacttaagttatttacaagttgaaaatgcgcaagacattattgacggtaagaaaaaaccggctgaattaggcgtggaagcaaaagatgattacacctttgtggttcatgcaaccaatcctgtgccttatgcagtcagtttaacgactcaccaatccttattgccattaccacaaaaagtagtcgaaaaattgggtgatgcatgggtgaaaaaagaaaactacgtgggtaacggtgcgtataagctggctaaccacatcattaacgaaaaaatcgaatttgaacgtaacccactttattggaacgataaagaaaccgtaatcaatagtgcgacattcctcgccattgaaaacccaagtaccgatgtagcacgttatcgtgcgggcgatttagacatgaccagttatggtttaccgccagaacaattcgctaaattaaaaaaagaattgctaggcgaagtatacgttactcgtaccctaggaacttattcttatgaattaaacaataagaaagcaccttttgataacgtgaatattcgtaaagccttgaacttatcccttgatcgtaatgtgatcaccgataaagtattgggccaaggtcaaacaccaacctatgtgtttaccccaacttacatcgaagaaggtcatctcattcaacaacctgcttattcaaaagaaccgatggcacaacgtaatgaagaagccattaaactcttagaagaagctggttacagtaaagcgaatccgttgaaattcagcattctttataataccaatgaaaaccacaaaaaagtggctattgctgcagcttctatgtggaaagctaacaccaaaggtttgattgatgtgaaattagaaaaccaagagtggaaaacttacattgatagccgtcgtgcaggtcgttacgatgtggcgcgtgctggatggcatgcggattacaaccaagcaacaacattcggcaactatttcttatctaattctagtaacaataccgcgaaatatgcgaatccagaatatgataaagcgatggcagaatcttacgcagcaactgatgcagaaggtcgtgcaaaagcttatgcgaaagccgaagaaattcttggaaaagattacggtatcgtaccaatctttaactatgtgaatccacgcttagtgaaaccttacgtaaaaggttattcaggcaaagatccacaagatcatatttacttacgcaatctttatattattaaacattaattcgttgctcgtatttaagtgcggttaaaaatcgtcgtattttttgaccgcacttttcgcccattttggttggagttgttatgctcaagtttatttttaaacggctgttggaagccttaccgacgctgtttattttgattactttttctttctttttgatgcgtcttgcccctggcagccccttcacttctgaacgcgcttatccgccagaagtcatggctaatatcgaagcgaagttcttttaaaatgacccttttttaagccatatttctctttattcaaaaatctttccataggatatcccgggccccccttattaaaaaattgaccaaccctgcataggatccatatgcgtgcagccttccccgcttttctaataatcggaactggtggcctttccctttcgacttcggctagacgcactccccgtgaccctgcgtcctttcacctaaaaacccaggttttatttttcagccatcctttttccgctga

SEQ ID NO: 382 - DNA, 3924 bp, H. influenzae
ctggtatacgaatatcagcctcggtaccccgctttttcggctgctttatcaaactctacatcgcctactaattttccatctactcggttaattccaacatcaattacgaccgcactttctttgatccaatcgccagaaattaaatttggtttacctaccgcaacgacaagtatatctgcttggcgaacgtgattttccaaatttttagtgaatctatgtgttactgtgacggttgcccctgctaataataattctaaagacattgggcggccaacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaaaaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttgtctgtttaactagatcctgtttagttctttcaaatataagcactttcagtctgttagatttcatgctcataatctgcatcatttgagtgaagaagcttaaatacactcttaatgatgcagataaaaacaatattttggctatttaagtattttccaagctctgaagccataaatggcaattactacaaaacagattaatggtaggataaaggagaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaagacataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccctcagctttagtgaagcctaaacgttcagcatattgtacgataaatgtccaacacataatttgaacacccacgtaaaaggcttgtgcgatcacaccctcacgatatttagcttttttagccagtttgcttattgcacttttaaagctaatttgtccactttcttctacttttacagcaggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaattcgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaagacaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagactggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtacttcagaaatgtccacaacatcaatcggtaaatttaaggtgtttgcacggatttgat

SEQ ID NO: 383 - DNA, 2911 bp, H. influenzae
  misc_feature (2836)..(2836): n is a, c, g, or t
  misc_feature (2868)..(2868): n is a, c, g, or t
  misc_feature (2875)..(2875): n is a, c, g, or t
  misc_feature (2881)..(2881): n is a, c, g, or t
gaccaccatttgccccatatcaccgtcggtactgatcccgtcatcaatgaaccggactgccacgccctgagcgtcaaattcctttatcagttggatcatatcggcagtgtcgcggccaagacggtcgagcttcttaaccagaatgacatcaccttcctccaccttcatcctcagcaaatccagcccttcccggtctgttgaactgccggatgccttatcggtaaatatacggtttgctttcacacctgcgtctttgagtgctctgacctgaagatcaagagactgctgactggttgagacccgagcgtaaccaaaaagtcgcataaaaatgtaccttaaatcgaatatcggacaactcatgtctattattacaaatttacgatttaatagacatattaatgtaacagttttacgatgtccgataatttataacatttcgtacggttggaaaaatgttactaaatgcccgtcaggcagggaggccgatatgcccgttgactttctgaccactgagcagactgaaagctatggcagattcaccggtgaaccggatgagcttcagctggcacgatattttcaccttgatgaagcagacaaggaatttatcggaaaaagcagaggtgatcacaaccgtctgggcattgccctgcaaattggatgtgtccgttttctgggcaccttcctcaccgatatgaatcatattccttccggcgtccggcattttaccgccagacagctcgggattcgtgatatcaccgttcttgcagaatacggtcagagggaaaatacccgccgtgagcatgcagcgctgatacgtcagcactatcagtatcgtgaatttgcctggccctggacatttcgccttacccgtcttttatatacccggagctggataagcaacgaacgtcctggcctgcttttcgatctggcgacagggtggcttatgcaacatcgtattattctccccggagccactacgctgacccggttgatttcagaggtaagggaaaaggcgacgttgcgcctgtggaacaaactggcactgataccgtcagccgaacagcgttcacagctggagatgctgctggggccaactgattgcagccgcctgtctttactggaatcactgaaaaagggccctgtgaccatcagtggtccggcgtttaatgaagcaattgaacgctggaaaactctgaacgattttggccctgcatgctgaaaacctgagtacactcccggctgtgcgcctgaaaaatctcgcacgttatgctggtatgacttcggggggtcaatattgccaggatgtcaccgcagaaaaggatggcggttctggttgcctttgtccttgcatgggaaacgctggcgctggatgatgcattggacgttctggacgccatgctggccgttatcatccgtgacgccagaaagattgggcagaaaaaacggctccgctcgctgaaggatctggataaatctgcattggcgctcgccagcgcatgttcgtacctgctgaaagaagaaacaccggacgaatcgattcgtgctgaggtgttcagctacatcccaaggcaaaagctggctgaaatcatcacgcttgtccgtgaaattgcccggccctcagacgataattttcatgaagaaatggtggagcagtacgggcgcgttcgtcgtttcctgccccatctgctgaataccgttaaattttcatccgcacctgccggggttaccactctgaatgcctgtgactacctcagccgggagttcagctcacggcggcagtttttgacgacgcaccaacggaaattatcagtcggtcatggaaacggctggtgattaacaaggaaaaacatatcacccgcaggggatacacgctctgctttctcagtaaactgcaggatagtctgaggcggagggatgtctacgttaccggcagtaaccggtggggagatcctcgtgcaagattactacagggtgctgactggcaggcaaaccggattaaggtttatcgttctttggggcacccgacagacccgcaggaagcaataaaatctctgggtcatcagcttgatagtcgttacagacaggttgctgcacgtctttgcgaaaatgaggctgtcgaactcgatgtttctggcccgaagccccggttgacaatttctcccctcgccagtcttgatgagccggacagtctgaaacgactgagcaaaatgatcagtgatctactccctccggtggatttaacggagttgctgctcgaaattaacgcccataccggatttgctgatgagtttttccatgctagtgaagccagtgccagagttgatgatctgcccgtcagcatcagcgccgtgctgatggctgaagcctgcaatatcggtctggaaccactgatcagatcaaatgttcctgcactgacccgacaccggctgaactggacaaaagcgaactatctgcgggctgaaactatcaccagcgctaatgccagactggttgattttcaggcaacgctgccactggcacagatatggggtggaggagaagtggcatctgcagatggaatgcgctttgttacgccagtcagaacaatcaatgccggaccgaaccgcaaatactttggtaataacagagggatcacctggtacaactttgtgtccgatcagtattccggctttcatggcatcgttataccggggacgctgagggactctatctttgtgctggaaggtcttctggaacaggagaccgggctgaatccaaccgaaattatgaccgatacagcaggtgccagcgaacttgtctttggccttttctggctgctgggataccagttttctcncacgcctggctgatgccggtgcttcggttttnctggcgnaatggnaccagggtaccgagtccgaatcgtatacag

SEQ ID NO: 384 - DNA, 2600 bp, H. influenzae
  misc_feature (2550)..(2550): n is a, c, g, or t
  misc_feature (2584)..(2584): n is a, c, g, or t
acgtaaccacggattattacacagtggtgcacgttacgccgtgaacgaccaagaatctgctgaagaatgtattaaagaaaaccgcattttgcgcaaaattgcgcgtcattgcgtagatgaaacggaaggcttatttatcactttgcctgaagattcgctcgactatcaaaaaaccttccttgagagctgtgcaaaatctggaattgatgcacaagctattgatcctgatttagctaaaattatggagccttctgtaaaccctgatttagtgggcgctgttgttgtgccagatggttctattgacccattccgtttaaccgcctctaatatgatggacgccacagaaaacggcgcaaaaatgttcacttattgcgaagtaaaaaatttgattcgtgaaggtggaaaagtgattggcgtgaatgtgtacgatcacaaaaatcgcagagaacgccaattttttgcaccgcttgttgtaaatgctggtggtatttggggacaagggattgcggaatatgccgatctcaaaattaaaatgttccctgcaaaaggcgcattactcgtaatgggtcatcgcattaataaacttgtaattaaccgctgccgtaaacctgctgatgcggatattctcgtccctggcgatacaatttgtgtgatcggaacaacatctagccgcattccttatgatcaaattgataatatggaagtaacaccagaggaagtggatattcttttccgtgaaggtgaaaaactcgcacctagcttgcgtcatactcgcgtattacgtgcttatgctggggtgcgaccattagttgcaagcgatgatgatccatcaggtcgaaatgtgagtcgtggtatcgtgctacttgaccacgcagaacgtgatggcttagatggctttattactatcactggcggtaagttaatgacttatcgtttaatggctgaatgggcgactgaccttgtttgtaaaaaactcaataaaacggcacgttgtgtgactgcagagcaacctttgccaggctctactgaaagtcgtcaagagaccaatcaaaaagtcatttcattaccaagtactattcgttattctgccgtatatcgtcacggttcacgggctactcgtttgcttgaaaaagaacgtttagatcgttcaatggtttgcgaatgtgaagcggtaacagcgggggaagttcgttacgctattgatgaactggatgtaaataatctcgtcgatttacgtcgtcgctcccgagttggaatgggaacttgtcaagctgaactctgtgcgtgtcgtgccgcaggactaatgaatcgttttgaagtggcaacaccacgtcaatcaactactcaactttccgcctttatggaagaacgctggcgtggtattgaaccgattgcttggggggaagctattcgcgaagccgaatttacctcttggatgtatggtagtgtattaggtttaaatgatgtgaaaccgcttgatgaacaagcacaacaagggacggatagcaatgaattttgatgtagccattattggcggtggtttggcgggtttaacctgtggcatcgcccttcaacaatgcggcaaacgttgcgtgattatcaacaacggtcaagcggccattgattttgcatctggctctttagatttattaagccgtatgccatcaacgacatatggggaaaatcgcgcagtagaaaatttaaaagaaaatattaccgcacttcgcaatgaattacctgcccacccttatagtttattgggtgcagagaaagtgcttgctaaagcacaagattttgaacgtttagccaatgaattaaatcttgatttaattggttctacggaaaaaaatcactggcgtgtaacaggcttaggcagtttacgcggtgcgtggctttcgccaaatagcgtgccaactgtgcaaggtaatgaaccttttccgcataaacgtattgcagtgcttggtattgaaggttatcacgattttcaacctcaacttttagcggcaaatttagtgttaaacccacaatttgaacattgtgaagtaacgagtggtttcttaaatattccacaattagatgaacttcgcaaaaatgctcgtgagttccgtagtgtaaatatctctcaacttctagagcacaaacttgcgttcaatgatcttgttaaagaaatcattgaatcagcacaaggtgcagaagcggtctttttacctgcttgctttggtttagaaaaccaagaatttatgaccgcacttcgtgatgcaactaaacttgcattatttgaattaccaacactgccaccatcattacttggtatgcgccaacgtattcaattacgtcataaatttgaatcccttggtggtttaatgattaatggcgacagtgcattgaatgcaacatttgaaggaataaagtacgttgtatcaacactcgtttgctagaaatgaagaaatcactgagataattttgactagcttcagaaggttcttcacaaagggctaatttccaaattgaaaaattatgaacctggttttgaattgtttttatcgggtngaaggttaaacataaaatcgttcatttggacgtntttctttgccaaccac

SEQ ID NO: 385 - DNA, 3908 bp, H. influenzae
  misc_feature (3267)..(3267): n is a, c, g, or t
  misc_feature (3289)..(3289): n is a, c, g, or t
  misc_feature (3300)..(3300): n is a, c, g, or t
  misc_feature (3351)..(3352): n is a, c, g, or t
  misc_feature (3366)..(3366): n is a, c, g, or t
  misc_feature (3403)..(3403): n is a, c, g, or t
  misc_feature (3439)..(3439): n is a, c, g, or t
  misc_feature (3499)..(3499): n is a, c, g, or t
ataatttagtcccgtaaaattaagaaaaataatataagtgattaaagtgacaatcagtatttctaataattttccgtgaatgtaattagaaatttgctgttgcatttctttccatactttaaatgcgagatttctattttttggtaagaatcgacttaccccttgtaaaagttctgatttatctttcaacataaaaaacatcattaatggcactaaaaaggcataaatccctaaagaaaccaagttcataatagaggctaaagaaagttttacagcagattcgccaaaaccaaggattttttctcgcacagaattgaaaatagaatcaaccattgaataatcaataagttcaggataatttttgggtaaattgagtagccattcattagatttattaaacatagcgggcaaatcacttaataaggaaatagtttgattccacaacattggcaccaataccaaaaagaaaactgctgctagaccaataaaactaccgaaaataagaattgtcgctaacattcttgggcattttaaatattgatttaaaaaattgattggcatttcaagtaaataggatagtactagagcaatcaacaaaggcgcaattaaatctccaaaaaaataaatggagataaagccaaataataatattgctaatagtcccatcgcttgaggatcacttaaacggcgagagtaccagctttttaacatttctagcataatttcttttcctataagtatttttttgccattataagttaaaatttacagtgtttatagctactaagaggaaatcctatgtctgttattatttatcacaacccacattgctcaaaaagccgtgaaacgctagcattattagaaaataaaggtattcagccgattattgaactgtatttgcaaaagcagtattccgttaatgaattacaaagcattgccaaaaaattaggaattgatgatgttcgccaaatgatgcgcacgaaagatgaactatataaaagcttaaatttagataatttagatctttctcaagcagaattatttaaagcgatgagtgaacattcagcacttattgaacgcccaattgttattaatggcgataaagctaaaatcgggcgtccgccagaaactgtacttgagattttgtaatttaaacgtttgcatgtatagtacaccagccgtggaaatccttccgcggcttttttaaggaaaatttatgagaaagaaacaaaaaagtgcggttgaaaatgaaaccgtttatttgcacactcgaggcgtgataaaagataatgcagtgatggcattgctaggcgataaattatttcgtcagcgtgttgagaaaaaacgtaaagggaaaggcagttaccaacgtaaggcgaaacacccagggaaaatatttgaaaagcccgattataaatttttttgattacagaaactttataatcgggtttttcttaggttaaaaatagcaaggagttaaaatatgtcaaaacagcctcaaattctacttaattaatacgtggaatgtgcgtattagtgatcccggagaggagggggccaaaagccatttctttgaaacgatttatttaactctaacagcttattttgaagaaaataacatacgctatgaatttgtgcgtaaagtggaggatcaaataaaaattcagcgttcttttacagagttaaatgaattgttcaaatttttaggggattattttgatcccgtctcgattggtctagtcggtgtgaaaattggaaacttagggataaaattagaataaaatattgattaatctataaaatttcacactatattttacgattattgtaaaacaaagatcgcactttaatgatataaattacataaaaaagtgcggttattttttctttattttgataagaaaaatagattacttagcaacaaatttcttgtacgacaaattgtaatgaatgtctcgaaaattgttgttgtttgcggtgttttaaacgtcttaaacgtagattacgtgataaagaactttgttgtaaattagctttctttttaagaaaagttttacgttttaacattttattaatccttattttcttttatttcttctaaatttttaaccgcactttcgttgttggcattatcattcgttgtttgattttcttggactcgatgataatttacgatgctattcatatagcggcgaatattttctacatattgataggcttcatagcctcttgcatagccgtatttcagttgggaataatagcgtttttctgctaataaaggcagattttttttcacattgagccaattatctggatttcctccaagattttgagttaaacggcgtgcatcaattaagtgaccgagtcctatgttataggcaactaaggcaaaccaaattctttcttccttttcaatgctttcaggaagctgactaatcaaccagtgtaaatattctgaaccagctttaatactttgttcaggatctgttctatcactgattttcatatgttgtgcggtatttttggtgagcatcattatgccacgtactccagttggcgatgttgcgtcaggattccaatgagattcttgataagccactgctgcgagtagtcgccaatctaattcacctttgtatttttcaaagagcggtgagaattgtggcagggtattttcaattgcgttcatataagagcgcgtatccacgtaatcaaattgtgaaatatgtcctaaatatttttcttttaaattatctaaaagtcccgtttcttcggcattattcataaaattgagtaaagccgtttgtagatcgcggtaggggctattgggtaaataccagtgaacgtttgcttcatcagtaatatcaaaggcaatggctaattctggtttgatttgttgaattgcagcaatatcaatagaatttgcaataacgtaaggaattttgccttcagccagttgtagtaatagttcttcttgagtaagtgcttgatttcttttccaagttaattgtggatattgtttttgtaattcttttagcgtttcttctaatgctaaattatttgagatataaatatctttctttacgttacctaaatttttaggacgattttcattttttcgataagctaattgccatgaagcagaatgatatgcaggacctatttggaaacgttctgcatttttaggatggtataaaaggggggcggcagctaaatcaatattgtgtttatcaagttcatcaaataactgctcttgattatcgaaaattntcatttcgagttctacgcctanagtatcagcanatgctgtggctaattcatattcaaagcctcgttcgctatctttattaatannataagaaatctggntatttattgttcctacataaagtgatcccctagcttngattgcagtataatggatttcttcagtatgacgtanaaattgcatgggaacacatatcattagccccaaatatacgctagagcagaatatacgtanaaaagaccttcaatgatttttctatataaaaagtaatgggatgtgcccaaactttacttatggcataaaagcccctggaggtcaggggctaggggttgaaaaaatcgacgattattttaaaaggaaactaacaatcgggggggttgtggcataaaggggggtactttttattaaattcacaagggccgatattattgcctgtcaccgcccccctctccgggaaacccccccaactttaagttaccgggaaaaccccgtccccgggatttcggtttttcccccctaaaaaaattccccttttatatctacccggggttaaaaagggggaaaatttttgggactcttgggggacaagggggggggctcctaaagtataatacccatacggggtataacccctctttacaac

SEQ ID NO: 386 - DNA, 4200 bp, H. influenzae
  misc_feature (4162)..(4162): n is a, c, g, or t
  misc_feature (4192)..(4192): n is a, c, g, or t
gaagatattattgatacgggttatacgttggaaaaagtgcgtgatattttgaatttacgtgagcctgcgagccttgcaatttgtacgttacttgataagccttctcgtcgggaagtggaagtgcttgttgaatgggttggttttgaaattcctgatgaatttgttgtggggtatggtatcgattacgcgcaacgccatcgtaatttaggctatatcggtaaagttgttttagaagaataatttgattttattgaaaagtgcggttgaaattttaaatgaatttttagccgcacttttttatattatttcattgctattttctcgatcacttgctaaatctttttacagcaaatacagccattatattgataatcttgctggggcaattttcttatttttcggcggctatttagtttattcaggcgtgctagccactgcagccgcattttaattaccaaaaagtataaaatataacgaaagaaaacttgttatttttactgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgccaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataagtaactggaaatcaataaaaaaatctgcaattgagaattcagttgcagattttttatcgctcaatacttttgactaaaaagtgcggtggttcttttcagtgttttataacttaaatcgatgaataatttgatttgcggaacctcgccaaactaaacttgggtcagcctgttcttgaataaatttcccatcaattaatacatcaatataaggcaacatagcacgttgttgttcgtctaattcatctagcttataacccgtccaaacccagatgtctttatcggggcattctcgttttacacgttgcacaaagggcaataatgtttctatgttacggggatgaagtggatcgccacctgaaagcgtgagaccttggcgtttaatgcgtgtgtcttttaaatcattgatgatttgttgttccattgcgtcatcaaataatacacccgctgaaaatgaccaacttttttggttgtagcaacctttgcaagcgtgcgtacagccactgacgaaaagtgtgcatcttgtgccttcgccattaatcacatcggtcgggtagtattggaggtagttcatttcataaaaatcctaaaaaggtggcttaaattctcgccaaattcaccgcactttttaattaatctttgcaatatgacggtaatttttgcataatagtgcgaaatcgcattgcgatatcaatggaaaccttctcggtctctcgcaacggtgtctggtttactcggtcaggtctggaaggaagcagccaaagtcggaattactgtgtgccgagaagaagctgggaaggtttccgcccaacttccttttctcatactcgctcaatcaatcttttaaagaaaccattttctttagtgattaaactattgtaatcgccttcttcgattaatcttccgctatcaattacacaaattttatcgaattgttcaattgaactgagacggtgagtgaccataattagggttttattttcggcatgttgcagaattaaacgtaaaatttgacgttcagtttcgcgatctaagccttcagtcggttcatccaataataaaattgacgcattattgagtaaaatacgcgctaaacctaaacggcgttgttccccaccagaaagtggacgaccgccatccccaagccaaagatttaaaccttttccctcttgctcaagtaatttacttaagccaacttgatgtagtacttcaatcatttgttcatcagaaattttatccgcacttgcaaattgtaaattttgacgaagtgtatcgctgaatacgtgaacacgttgagttaaaaaacaaatttggcggcgtaatgtctcttctgaataggcggaaatgggtttttctgccaataaaagttcaccttgattcgcatcataattgcgtactaaaagttgaagaagtgaagattttccacttccagttttgcctaaaatagcaatttttttgccctgttctaaatctaatgtaagattttttaatacgagtgtttcttgttcgggataggaaaaatttaaattcttcgcagaaattaaccgcactttgtttcaaattcctcgttgccattaaactcaacaatcggtttttgctcaatgatttcggtcacacgttctgctgccgcaataacttgacctatatgtaaaaatgctgcccccaatggcatgataatctcaaaggcggcaagtgcagcaaaagtgaaaagtgcaatataagccgtgcgatattcatctgtgccaaaatcggcgttacttgcaaaccatagcattccagaaatcaacaaaccattaagaaagagaacaagtgcggtagagaatccgcttaattttgcttctttggcttgatcttcctgccatgttttttctgtggctgacattttttcttttaatctatcttccgcattaaataataaaagctcggcttgtgcttggataaattctaaaaactgggttcgataggtcgcgcgtgcttggattaagcgttcgccaaattgctgtcctagtcgatagaaaacagttgggataatcattaataaaattaataaaaataagcctaaaccaagtgcgagtggaatattgataaagctaagtccaatggttatggcaatgattacaaatacagcagtgaaaaatggcgcaagtaaacgtaaatagaggctatcaagggtatccacatcggaaactaaacgatttaataaatcgctgttgcgataacgatttaataccgctgggcttaaaggaatgatttttcaaatacttgcacgcgtaatttggacaaaatgcggaatgttgcatnatgcgttactatgggaaccgagtcgatatncgaaaaca

SEQ ID NO: 387 - DNA, 2869 bp, H. influenzae
tgagttccctcacttccgtaaagggactgaaatcatttctcacgccattgcaaacagcgatgcattctctattgctggcggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaaccgcacttttcctctataacatattgatggtggcatcaaaaatgccatcatcaatacaaattcttcaaattgtgggcttatcccgctaaacataaaaaggaaacacaagtatggctaaattattagatatcgtgaaacccggtgttgtaacaggcgaagatgtgcaaaaagtttttgcttatgctaaagagcataactttgctattcctgccgtaaactgtgtgggttcagactccgttaatgccgtgttagaaactgctgcacgtgtaaaagcaccagtgattatccaattttcaaatggtggcgcagcgttctatgcaggtaaaggtatcaaaccaacgagtggtactcgtccagatgttttaggggcgattgctggagcgaaacaggttcatactttagcgaaagaatacggtgtgcctgttattcttcatactgatcacgcagcgaaaaaattattaccttggatcgacggtttattagatgcaggcgaaaaacattttgccgaaacgggtcgtccacttttctcttcacatatgatcgatttatctgaagagtcaatggaagaaaatatggcaatctgccgtgaatatcttgctcgtatggataaaatggggatgacccttgaaatcgaaattggcattactggtggcgaagaagacggcgtagataactctgatgttgatgaatcacgtttatatacacaaccgtctgatgtgctttatgtttacgatcaattgcatccagtaagccctaactttaccgttgctgctgcattcggtaacgtacatggtgtttacaaaccaggtaatgtaaaattaaaaccatctattttaggtgcatcacaagagttcgtttctaaagaacgcaatcttcctgcaaaaccaattaacttcgtcttccacggtggttcaggttctagccgcgaagaaatccgcgaagcaattggctacggtgcaatcaaaatgaacattgatactgatacgcaatgggcgtcttggaatggtattttgaatttctataaagcaaatgaagcttatcttcaaggtcaattaggtaaccctgaaggcccagatgcaccaaacaaaaaatactacgacccacgtgtttggttacgtaaaatggaagaatcaatgtctaaacgcttagagcaatctttcgaagacttaaattgtgttgatgttttataatccacaaaaataacataaaatacggccgcactttcaagtgcggtttttttattttagcggagaaattatggaaaagatcttagttattcgtaacgataaattaggcgattttatgcaagcatggcctgcttttgcaatgttgaaagcctcaaatccagagctaaaattaaccgcacttgtgccgagttacactgcgcctttagcggaaatttgtccatttattgatgatgttattattgatagcaaaaaaaatgacaaaacggatttcaaacgtcttgtgcaggaaatcaaagcgcagcagtttgatggcatgattagtttcttttccaatacccataatggaaaactcgcttggaaaagtggaattaaatatcgccttgcacctgcgactaaatgggttcaaattctttataatcaccgtctaacacaacgtcgttctcgttcagaaaaatcagaagcggaatacaatcaagatttagtccgcacttttttgcaaaagcataatatgccagttgttgaacctaaaccgccttatttaatctttgagaaaagtgcggtggaaaaccagcgcgtttttttacaagagagtttagggctttccgcaaataaaaaatggatctttgtgcatagtggttctggtggttcagctacgaatctttctttagcgcaatatgcggatttaattaaaggcttattggctgagtttgattgcaatattgtgctgacagcagggcctggcgaaagagaaaaagcctatgaattagcaaatcttgtgaatgatttacgcgtagccatttacgataagaataaaggtttagtggattttgctcattctttagcttgtgcggatttatttattgcaggatctactgggccattgcatttgagcagtgcgtttaatattccgactatcggattttatccaaatagtcgttcttctcagccgagacgctggaaaccgattaatgatgtcgataagcatcttgcattttgcccacccgcgggaaaagagactcaaatgaatttagagttaatttcaatagacaatgcgttagctgaaatatcacttttcatacggaatatgtggcaaacgagcaataatatttaagaagaattgaacaacgctgcctatgctggtggcgaaaaggacagtacccaagccaacgacaccaccaagtaaaaaaccaagtaaacaaaccgagatttcaaggcttgagcgtaccacgttgatgcttaaatgaaaacgttggcaaataccaaccattaatccgtctcgagggcctgcacctaagtgacaagtgagatataacgcagttccaaaaccatagagtaatataccgatcagacagaagatcattcgtgaaaaaagtgcggttggcggcgtcagtattttgttgtgatccctagaaatagagcaataacgataatatttaataatgtcccaagcccaagg

SEQ ID NO: 388 - DNA, 3761 bp, H. influenzae
cctcgtaagccctttggcttctgtcctttgcaattgaatattgttaatggtgagtcataattggcttttatatctgaataaatgggccatttctcctctggtacttgaagatttctactgatgtttctgcagaaagatcaataaactgacctttaccctgctctggctgaacaaaagacttttgattagcttcataatacgttttgatttcatcatcagagactgattgttttgccatttcatcttcaagagataaagttgctaaacgagctaaacgcttttgaaagaaaacttctggccctattttttacttgagcaggaacaataaattcactgttagcaacgccattttgtatttgttcaagaggtaacgaagcacgtaaaattgaagcgtaaccatctgaagttaaatgattttgttgtaatattcgttgataaacagcattatcaaatttaccctttacttgaaaattaggatcggtcacgattgcacgtttaatcatttcatcactcacgcctaattttaattctttaacatattggcgaagtaattcttgatcaatcattagattgacgatgttttgacgaagtgcggtaacaaattcaggagaatctgactgagccacaaacgcctctccctcacgttgtgcgcgtatttcaaattcttgattatagcgatttaaaaaatcttgttgagaaatcacttcgccgttcacttttgccgcataagtatcatttgagctaaaaagatagccagacattccaccaactaaaaacgatacagtaatcaaacctaagataaatttagaaacctttgagtttgttaaattgtgcattttttcaattaacattctataacccttgttataaatataaaattttcctgattataatctaaacgtaaaaaattagcatcttaaaaagtgaaaactccatgctcacaaagccagctaataccaattcctatcaacaaaacaccaccaaatattgccacttttgatttaaatttttgccaaaaaatgaccgcactttacgcttcctattttccaatgcagaaagaactaaaaatattaccaagtaaatcatcggatgtgaattgacccgtaatttcacttaaatagctttgaactaagcgtaattcttccgctaaaagttctcctgcatgaaattctgtaagttgaaccaaaccgatttgtaaatgctctgcggctttctcaagtgcatctaaatgacgacgacgagctaaaaatcccccttcgatacctgtttgaaaacccattgcttgtttcaaatggtcacgtaaaagttttacaccatcatgcgtttgagcagaaagactaataatttgataaccgccctgttcgctttcacttgcttgttcgccatttaaatcaattttgtttctaacaatagtaactggcaaggttgagggtaattttgctaaaaattctgaccgcactttgcttaaatctgcactttcaggatcgctactatctaacatcaaaataatacgatcggcttgttcaatctctgtccaagcacgagaaatcccaattcgctctacttcatcggttgcatctcgaagacctgcggtatcaataatatgcaatggcataccatcaatatgaatatgctcacgcaatacatcacgggttgtacctgcaatatccgtgacgatagctgcttcgcgaccagcaagtgcattaagcaaactcgatttgcctgcattcgggcgaccagcaatcacgactttcatcccctcacgtaaaatagaaccttgtttagcttcagaacgaacattttctagctgattaataataccgcgtaaatttgcttcaatttttccatctgccaagaaatcaatttcttcatcaggaaaatcaatgcttgcttctacataagtacgtaaataaatcacagaatcaaccaattcatttacttttttagaaaactcgccttgtaatgattttaatgctgagcgtgccgcttgttctgatgttgcatcaattaaatctgcaatggcctctgcttgagcaagatccaatttatcattcaaaaaagcttgttcagaaaactcgcctggtctcgccaaacggattccgtcaatttgtaaaatacgtttgagtaataaatctaatacaacctgcccaccgtgaccttgcaattccaacacatcttcaccagtaaatgaatttggcgatttgaaataaagcgcaatcccttgatctaaaatagtgccatcagcatctttaaaaggaagataatctgccattcttggcttagggcatttacctaatatagcttgagcaacttttgttgctaaaggccctgagacccttaaaatcccaatgccaccacgacctggtgcagtagcttgagcaacgattgtttctttcataaaaaacctattattgtctggggaaatatgatattacctagggtaagtataccctaggtttatcccagtgctacccctttggggtagagcttgatgttccccaaaggggaactactattactataattaaccgtgggtatacttacccacggttgattgcctagggtaagtatactactacctagggtaagtataccctaggtttatcctagtgctacccctttggggtagagcttgacgttccccaaaggggaactattattactataattaaccgtgggtatacttacccatggttgattgcttagggtaggtacacactacctagggtaggtatactactacctagggtaagtataccctaggtttatcccagtgctacccctttggggtagagcttgacgttccccagaggggaactattattactataattaaccgtgggtatacctacccacagttgattgcttagggtaggtacacactacctagggtaggtatactactacctagggtaagtatacccctaggttatcccagtgctacccctttggggtagagctttgatggtccccaaaggggaactattattactataattaccgggggtatacctacccaccggtgattgcttagtggtaggtacactactacctagtggtaagtataccctagtgtttatcctagtgctaccctttggggtagagcttgacgttccccaaaggggaactattattactataattaaccgtgggtatacttacccacggttgattgcttagggtaggtacactactacctatggtaggtatacccacggcagtaaaataaagaaaaggcacattccgtgcctttctttttgcctgttcgtgactatttttacgagaatgcaacccttttttctctaaaccacgataaattaattgctgttgggcgatagtgatcaagttagatactaaccagtataataccaagcctgatgggaaccacaagaaaaagaacattaaaactaatggcataaaattcattactttttgttgtgttgggtcagttactggtgttggagacattttttgcaacaagaacattgagatacccattaaaatagggagaatgtaataaggatcttgtgccgataagtcttggatccaaccaaagaatggtgcatgacgtaattcaacggcttctaagaacgtccagtataatgcgatgaaaattggcatttgaagaagaattggcaaacaaccaccaagtggatttactttttcctctttataaagcttcatcatttcttggctcatacgttggcgatcatctccaaaacgttcacgcatttcttgcattttcggttgcaaaatacgca

SEQ ID NO: 389 - DNA, 3484 bp, H. influenzae
  misc_feature (3112)..(3112): n is a, c, g, or t
  misc_feature (3126)..(3126): n is a, c, g, or t
  misc_feature (3153)..(3153): n is a, c, g, or t
  misc_feature (3231)..(3231): n is a, c, g, or t
  misc_feature (3244)..(3320): n is a, c, g, or t
  misc_feature (3323)..(3354): n is a, c, g, or t
  misc_feature (3357)..(3364): n is a, c, g, or t
  misc_feature (3369)..(3370): n is a, c, g, or t
  misc_feature (3372)..(3396): n is a, c, g, or t
  misc_feature (3403)..(3407): n is a, c, g, or t
  misc_feature (3409)..(3414): n is a, c, g, or t
  misc_feature (3416)..(3416): n is a, c, g, or t
  misc_feature (3419)..(3439): n is a, c, g, or t
  misc_feature (3441)..(3442): n is a, c, g, or t
  misc_feature (3444)..(3445): n is a, c, g, or t
  misc_feature (3447)..(3453): n is a, c, g, or t
  misc_feature (3455)..(3461): n is a, c, g, or t
  misc_feature (3463)..(3465): n is a, c, g, or t
  misc_feature (3468)..(3468): n is a, c, g, or t
  misc_feature (3470)..(3475): n is a, c, g, or t
  misc_feature (3477)..(3477): n is a, c, g, or t
  misc_feature (3479)..(3479): n is a, c, g, or t
  misc_feature (3481)..(3481): n is a, c, g, or t
aatgttgttgaaatcgattacaaagatatcgctacataaagaactatattcagaaagcggcaaaattgtacctagccgtattaccggtactcgtgcgaagtaccaacgtcaattagctcgtgcaatcaaacgcgctcgctatttagcgttacttccatacactgacaatcatcagtaattaaggagacacggtaatgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaataatttatccaatagataaaataaaacccagtttaaaactgggtttttttatttttatcatatataaatttagaatagggtaataaaaaatatcccttattttagtagatttgagccctaagtcatatagagctcaaattttctgttgggatagattttttactcgtataagcgaattacatcattccacccataccgcccattccagcagcacctaaatcggctttatcatcttttggaagatcagttaccatacattcagtggtaatcattaagcctgctacagaagctgcgaattgcaatgcagaacgagtgactttagttggatctaagatacccatttcgatcatatcgccgtattgttctgtacctgcgttataaccaaagtttccttctccatttttaaccgcacttgccacaacagatgcttcttcgcctgagttagtgacgatttgacgtaaaggtgcttccatcgcacgtaatgcaagtttgatacccacattttgttcttcgttgtcaccttttaggcttgctgcaactttcgctgctgcgcgaactaatgcaacgccaccaccggcaacgataccttcttcaaccgcagcacgagttgcatgtaatgcgtcatctacacggtcttttttctctttcatttcaacttcagttgctgcgcccactttgattacagccacgccgccagctaatttagcaacgcgttcttggagtttttctttgtcgtagtcagaagttgattcttcgatttgctgacgaatttgagccacacgacctttgatttgtgcttcatcgccgataccatcaataatggttgtgttatctttattgataacaacgcgttttgcttgacctaaatcttccaatgttgctttttcaagctccataccaatttcttcagaaatcacagtacccgctgttaaaattgcaatatcttgtaacatcgctttacgacgatcaccaaaacctggtgctttcactgctgcaactttcacgataccgcgcatagtgtttactactaaggttgcaagtgcttcgccttccacatcttcagcgatgattaataacggtttacctgctttcgctacaccttctaacacaggaagtaattcacgaatgttagagatttttttatctacaagaagaagatatggattatctaattcaaccgttgcagtttctggtttgttgatgaaatatggagaaaggtaaccacggtcgaattgcatgccttcaaccacatctaattcatcttcaagacccgtaccatcttcaacagtaattaccccttccttgcccactttttccatcgcttgtgagattaattgacccacaatgctgtcagagtttgcagaaatggtacctacttgttcaatttcttttgctgtttcacaaggtttagataaatttttaagttcagaaacaaccgcacttactgctttatcaataccacgttttaaatccattggattcatacctgcagctactgctttcaagccttcatttacgatagcttgcgcaagtacagttgcagtagttgtaccgtcacctgcagcatcatttgctttagatgccacttctttcaccatttgtgcccccatgttttcgaatttatcttctaattcgatttcacgagcaacagacacaccatctttagtgatagttggtgcgccaaatgatttatctaaaattacattacgacctttcgggccaagggttacttttactgcatccgctaatacattcacgcctttaagcatttttacgcgtgcatcgttaccaaattttacgtcttttgctgccattttctttttccttaatttaaaatattccacaatcgccaaaatttcgcatttatcaatgattaacacttcttcaccatcaattttttctgctttcacgccgtaaccgtcgttgaaaatacggtctcgccaactttaacatctaaaggttgaacggtgccattttctaaaatacgacctttacccacagctaatactttcgcgcgggttgatttagtcgctgctgaaccggttaatacgataccgccagctgaacgggtttcctcttcttcacgtttaataattacacgatcgtgtaaaggacgaatattcatgattaatttccttcttaagaatttgtaagtgcggtttctatataaggaggattttttttctttcaaggctcttacaaaaaattctgacaaaatatttttcctattttagattttttacgtaaaattcgctgactttcgtataataaattaaggaatgaaaatatgcacttaacttccagagaacaagataaactgatgcttttcctcgcgggcgaacttgcggcaaaacgcatagcacgcggcgttaaattaaattatccagataccattgcttatattgcgagccatttacaagaggctgcaagagacggaatgagtgtagcggaagtgatgcaatatggcgcancacttttaactgtngatgatgtcatggaaggtgtggcaganatggttcatgaagtccagattgaagctactttccccgatggcacgaaacttgttaccgtgcataatccaatcaaaccncggaaaggggggnnnnnnnnnnnnnnnnnnnnnnnnnnnnnnnnnnnnnnnnnnnnnnnnnnnnnnnnnnnnnnnnnnnnnnnnnnnnnctnnnnnnnnnnnnnnnnnnnnnnnnnnnnnnnnatnnnnnnnnccttnncnnnnnnnnnnnnnnnnnnnnnnnnnccatttnnnnngnnnnnngnctnnnnnnnnnnnnnnnnnnnnngnngnngnnnnnnngnnnnnnngnnnctngnnnnnngngngnggg

SEQ ID NO: 390 - DNA, 2069 bp, H. influenzae
  misc_feature (1805)..(1805): n is a, c, g, or t
  misc_feature (1838)..(1838): n is a, c, g, or t
  misc_feature (2059)..(2059): n is a, c, g, or t
ctgtgaaccacggttcggccgcacatataaaaatcggatatggaaggatgatcccatcataaacaattatgcattttaccggcaaagcccccacaataaggacaatgtggtttttcactggttaaacataagttttcattatccacgacaggttgaaaacttgatgcagaccaacttaatcctcgacaattattgacacattgaagacgctccaaagtaccatgtacttcataaacatggctatcattaaaaccagccttttgaaaatgcccatcaacattactggtaaaaacaaaatatccatgaggtttatctcccgcccagcattttaaaatctgatacccttcgtgaggaagagtatttcggtattgaactaatcgatgcccataaaaccaataggctagttcctgattatgcttataagctagtggcgttgcgatctcttcaaaagatatattatgttctttaaacataggataagcattccaaaatccgccaacgctgcggaaatcgggaagcccagaatccacgctcatacccgcaccagctgtaattaaaatgccatccgctttgcggataagttccactgcataattcaaatcatttttcataatacttttctctgcccatttttcattgatgaaataatacccgcttgttccaactgttctaaaatttgcccagctcgattaaaacccaacataaatctgcgttgaatcattgagcaagatgcaaatttttgttgttgcacatatttttttacatcctcaaaaagtggatctcttgccataattactttcattgccattatttgctcctttttcttaattaaaggctttataaatatgtaagaagtaaagaatttctctttatggagaaattatatgaaaggaagcgacaacttgtgtcgtttgtgaatattgaaagcggttatttttagaagattttttgcaaataagatgctctgtattgcaatatgcatatttatctggttatatatacatgttagttattaaggaaaataatatgaataaccaaaacccgattgaaatttaccaaactcaagatggcacaacgcaagtggaagtgagatttgaaaatgacaccgtttggctttcccaagcgcagatggctatgttatttggtaaagatattcgcaccatcaatgagcacattaccaatatatttgatgacgaagaacttgagaaagaatcaactatccggaaattccggatagttcgccaagaaggtaaacgccaagtcaatcgtgaaattgagcattatgatttagatatgattatctctgttggctatagagtaaaatctaaacaaggcattagtttccgccgttgggcaactgcacgtttaaaagaatatctgactcaaggctataccattaaccaaaaacgtttacagcaaaatgctcacgaattagaacaagcacttgcgcttattcaaaaaacggcaaattcatcggaattaacgctagaaagcggtcgcggattagtggatattgtcagccgttatacgcatacgtttttatggctacaacaatatgatgaaggtttacttgccgaaccacaaacacagcaagggcggtacattaccgacttatgctgaggctttttctgcactagcagagttaaaatcacagctgatgacaaaaggtgaagcaagtgatctctttggacgtgaacgagataacggcttatctgcgattctaggtaatttagatcaaagtgaatttggtgaacctgcttatccaagcattgaagcaaagcggcgcatttactttattttgtcgncaagatcatcctttttcagatggaataaacgtnagcgggcatttttatttgggagattcttactagaaatgggcggttggtttgacattatgggtacccagttttcatggtactgggcttgccgggctcactttatagttgctgaatctgatccgaacaaaagaacgcttttaggcttatatgcctatgcttagcagaaaaaaatgataatgcgaccgatccgcttttggtaaaaagggggcattctctatggntttgggggcc

SEQ ID NO: 391 - DNA, 2409 bp, H. influenzae
  misc_feature (2375)..(2375): n is a, c, g, or t
tgacggggaaaccagtgtatcgccttatgcatataattattcacaaggccaatattatttagcgagctttgctgatgaaatttatttaaattcaattggaagcgtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcagtaataattgaaaaagggcagaattaaatctgccctttcgcttacaaaatatacgcttcttgaatatgatgtggcttttggtcttcttctggtggaagcttcatataatctccataatattgcgttaagtgttcgtgatatccattcattacttgaaattgtcgtccttcaaattctttataaacaatgtgattaaaatattctttcggcatataagatttttgccaaccaccgtagtcagataatacaagaccaatataatcgcattgttttatcggatattttatttggaattgtgctaaatttttttgcattttggaaaataaaaagtggcttaatttaccaagtatcgttctttgcaaagtattttcttttgatcttaaccatcttttcttacaagaagaaaatcgaagtttaattcttcggtgctttttcatcagtgggtaaatgatctttggttcattcggtacaccatcgtagataaatatatccataaacatcgggctttttcttcccttagcatctgttatttgagtgcgacaatcgaaaatttttgccatttcaccggtatattgagcaagtatatcttctgccgtttccatattgtagtattcgtgagtttcttgaaaccaaacatcaacgaacctttgatattcatcacggtgcatataaacatcaatatcatcatcccaagggataaagcctttgtggcgtattgcaccgattaatgttccaccaccaagagaatagtgaatttggtgtcgctcacataatgcgtggaaataatctaatatattgagacaaacgagttgttgttctctgagcgttaattttttcattatttttcccttgtttggtgtcaatttttgtaaaatgtggtgatagtcatcaaggttatccatttcaaatatatcatcactgttaagttgttnccgtatagatattaagggtaccgagccgaattac

SEQ ID NO: 392 - DNA, 2050 bp, H. influenzae
  misc_feature (1897)..(1897): n is a, c, g, or t
cggcaccggccaaagcccggataaagtgcaccgttttttagtccaacccaagacccgaatgcgcccgtgttagcttgtttagtggccaaggggattccctttgccagtgccggctccagcattaacccaagtgacggaatgagtacaatgcgaaactgatatgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaagtaaggagatatgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgttaattgatagcaaaaagcacctaaaagttttaggtgcttttaaagttttaatgcttacaaaattagactttcttaaggtttatagatgaactcaattccttcatcatcttcttcagtccaatcgtcatcccaatcttcgtcatcatcaaattgataccccgctagttgttcctgatgataatcttcccatttgaattttacttcttcaggtgcaacttgttgtgtttcagcttcgcgtggatttgctatgataaagtccataatatcacgacaaagtggtggaacatttttccttgttgcagctgaaatcaggtaatagtcttcttcccaacctaattgttcagtgatttctcgaacccgctcttcagcttcttcatcgctcatcgtatcaattttattgaacactaaccaacgtggcttttctgataatttttcactgtattggaaaagttcagattcaataatagcgacattatctgctggattagatccatcaattggagcaatatcgactaaatgaataagcactctacaacgttctaaatgttttaaaaagcgaattcctagcccagcaccatctgcagccccttcaattaatcctggaatatcagcgactacgaaactgtgtgaatcgtctactttcacaacaccgagacttggtactanagtagtaaatggataatctgcaccttttggtttggctgctgaaacggcacgaataaaagtgaatttaccagcattaggtaaaccgagcattccacatcagcaagtagcattaattccaatataaaccgcggttttcgcccgcgtaccaattgc

SEQ ID NO: 393 - DNA, 1952 bp, H. influenzae
  misc_feature (1668)..(1668): n is a, c, g, or t
tggtatcgaattcggactcggtacccattatggctgcgtttctggatcaccaaaacgacaattaaattcgatcactttcggctgcccatttggcataatcattaatcctgcatataggaaacccgtgtaaacactgccttccgctgccatgccattaacggttgggtaaatcacttccttcataatgcgactatgaatttcgggtgttattactggtgcaggcgaatacgcgcccataccgcctgtatttaaccccgtatcattttcgcccacgcgtttatgatcttggctagtagccataggttctacgtttttaccatctaccatgacgataaaacttgcttcttcgccatctagaaattcttcaatcactactcggctgcccgcttcgccaaaggcattaccagaaagcatatcgcgtactgcatcttcggcttcttgcaatgtcatcgcaacgattacgcctttacccgccgccaagccatccgctttaacgacaattggtgtgcctttttcacgcaagtaagtcaatgcaggttcgacttcggtgaagttttgatattccgctgttggaattttatgacgagcgagaaaatctttagtgaatgcctttgaaccttccaattgcgcagccgctttagctggcccaaaaatcttcaatccagcttcacgaaatgcatcaactaccccaatcactaagggggcttcaggaccaacaatggttaatccaatttgtttatcttgagcaaatttcactaatgctggaatatctgtcgcagaaatattcacgttttctactttgtgttccaatgcagtaccagcgttacccggtgcgacaaaaactttatctgctaatggagattgtgcaactttccaagccaaggcgtgttcacgaccgccgtttccgatgatgaggatgttcatgttgtagtccttgcgtatgcctaatttaaaaaaagtacggctattttttacctgcaattccccctcttttgtaaagagggggatagttagataaattaatgtctaaaatgtcgcattccagtcaataccattaccatattatgttcatccgccgcatcgatgacttcttgatcgcgcattgaaccacctggatggatcacacattgaattcccactttcgctgcagcatcaatgccatcacggaatgggaagaacgcatcagatgccatcacacaacctgccacggtcaagccttcatcctgtgctttgatacctgcaattttggccgaatacacacggctcatttgacctgcaccaatgccgatagtttgattgtctttggcgtaaacaatggcattcgatttcacaaattttgccactttccagcagaataataagtcttttaattcttgttcagttggctgacgtttactcacgacttttaaatcatccacgccaaccatacctaaatccgcatcttgtactaataaaccgccgtttacacgtttgaaatccaaacgttcggaacgagaagtccattcaccacattcaagcaaacgcacatttttcttacgcttcattacttcttgcgcttcagcagaacttttcggtgcgataatcacttcaacgaattgggcgttccacaatttcattcgccggttttttcgtctaattcacggttaaaagcaataatgccgccaaagncagacgttggatcgggtttggtaagcgcgattataagcatctaaaatatccttacctaaagccacaccacacggattaagcgtgtttaacgataacacaagctggctcatcaaattctttcacacattcaagtgcagcatcggtgtcggcaatattattgggagataatgcctacctttgcaggtgattagcccggagccacgctcgcttcttttcacattaaatcaacttagaagcggcattttgttgggaaatttggccatacccataatttgttaacccca

SEQ ID NO: 394 - DNA, 2965 bp, H. influenzae
  misc_feature (2937)..(2937): n is a, c, g, or t
gaaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagacaaggcaacggattgtggcaaattgttatgataattaagtttggcaaagctacctgatttgattttaatggttgggccaagataattaccgttgaatccccataccgtcacattgtgtgagccatctaacggataattcgtttcctgcatggttaatacaatcgggcgaccgcgacgaacttcaattagtggcggcacaactagtttttcacggcttgccgctaacaatggtgctggcacggtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgccgcatggaatgcacccgttttaaagggtaataaaccgcgaccgcgattgcgagtgccttctgggaacatccaaattgataaattatcttcattaattcgtcgtgcaagctgtgacatcgtattatgcgcttttgtgcggttttctctatccaagaaaatattacccgttacccaatataaaatgccgaagaagggtatccaaattaagcttttttacccacacttactgtgcgaggttgcaccatataagagattgttaccatatcataattatttttgatgattaccgatataaatggcgcggctaatttgcttctgatcttgaggaatacgatgttctacctttaagccaaaaagtggatataagcgtccaaaccaacgagcaacaatgcctacgttgcttggatttttaaagcggataaaagaataaatcgtacccagtacacaaattagaatacagcagattaatacgaggaaaattcgaagtagttttaacataaggatgccctatacaaaatttcgttaaagtatagcaaattcaatatcaatatgtgttaatctaaacaaaaatcgtggaatttttatgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaagtgcggtaaagcaaaaactcgttattttacttaatgatactagaataatacttatccataaaatcgtacctaaaagctggtggataagcccaacttttagatacagataaaagtgcggttaattttaggattagttttctttcggtaagcgaagcgacgcgtaaattaatcctccccacaataaagtaagggctatgatcatcataataattgcgccagtagtcattttattctcctttagtttcatcaatcgttaatttggtttcgcttttccattttaagcgagaaaggaaaaatgccacgacaagtaagctaatcgacattccccaaccaaaggtatttacaaaccagtttggatagccttcgtaaccttcagagaagacttttgccccttcgctgaaaagcataaatgctaaaacaccactcgttaatacaatgcataaacgccagaagaaacccactttgaaagatgacgtttcatttaagtgattacccaataaaccgagtttttcatttgctacaatcgcaattaaagacgcaaatgctacggcaacaataccgaaatagttcacaaatttatcgaacacatctaacatcggtaagccagttgttgtaccgaataagatgacagaaactagcatcattggtacacccacgatgaatgtcacttttccacggctaatacgaaatttatcttgaaatgccggaataattacttcgataactgagatgaatgaagtccatggcgcaaaggttaatgcacccaagaataacatgcctagcacttcgcccaagggggcctttggtgagatgggtgggaaagcnaaaaatgctaacccattcccgcctttgc

SEQ ID NO: 395 - DNA, 2748 bp, H. influenzae
tatgctttttagtgcgatcttcagaaaattttccaagactgacaaaaccaattaccattacagaagcttcaaaatacacatgccccattgcatgatcggcgtggtaaaacaacatgaaagcagaataaagataaatagtgagcgttcctgtgctgacaaggacatccatattggcaagtccaccacgaatactaccgattgctccgcaataaaatggaatggctaaccaaagttgcacaatgcttgctaatgcaaattgccaaatcggcggtaacattaagtgatgggagccacctatcataccaagcattccaatcagaaatggaatattgattatccaaagtatgattaatcgccaagggattgatgtattttcttctattggtaattcattggcttgtttgatatgagcagaaaaacctgttttatggataatctcgataatttgagtttcgcttgcttgcgtagcgtcaaatacaacttgtgcttcttcgacggcaaaattcactcccgcttgttgcacaaatggttttttatttaaaactttttcaatgcgattggcacaagattggcaggtcatcccaccaatctgaattgaaatttttttactctgtggcgtcaaatccagcatcttcaatgacctcaatcaactgtgcaacattgactcgattttcatcaaaagtaatatttgctttaccctctaattgcacatcagcagattgtacgccatctaattcagttaaaacttgagtaagactttttacgcaacagccgcaatgtatgccttttatgtttaatgtgatagttttcatttttactccttgttagttgttttattgatgaatgcgattggcacaagattggcaggtcatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgatgaatgtgattggcacaagattggcaggccatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgattgttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttggattttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcaaggcaatggcaaccctgaatgttcaattttgaatggcttgaacggataagtgaaaagtgcggttaatattcccaactttctggatcgacgcctaattcacgcataagcactttggcatcttcgggaatttcatcattacgctctttcattaaatctgcatcagtgggcaaaggctgccctgtgaatgcgtgtaagaacgcttcacaaagcaattcactgttagttgcgtgacgtaaacttttcaattggcggcgagtgcgttcattcgtcaaaatttccagtactttaatgggaatggatactgtaatttttttgacttgctcactttttttgccatgttctgcataagggctgatatattttccgtcccaatccgccataatttcccttagagcttatcgataaccttacaaattgtccgtattctaattaaaaatcaaataaataacaatctagacggctaaacttccaaaataagttctaaaaaagtgcgatgatttttatattaaatgctaataaaagctagacagcgtagggttttagtggtaatttatgcgccattcaaagggtgcaagcccaccattcgaataatcaattcttattaattccaacatttattcattatgcatttaacagaacttaaaaatacgcctgtttctgatcttgtgaaactcggcgaggagcagatgggcttagaaaatttagcgcgtttgcgtaaacaagatattgtctttgcaatcttaaaacagcacgccaaaagtggcgaagatattttcggcggtggcgtgctagaaattttaccagatggttttggtttcttcgttctgccgacagttcctaccttgcaggccctgatgatatttatgtttccccaagtcaatgccgtcgttttatcttcaaatggggtaaaggggtaccgagtccgatattcgtataccat

SEQ ID NO: 396 - DNA, 2654 bp, H. influenzae
aacgccaattggcaaaccgcaaaataaatatatggaacttggccctcgtgataaggtttctcaagcattctggcaagaatggaaaaaaggtaataccttaaaaactgcgaaaggcgtagatgtggtgcatttagatttacgtcatcttggtgaaaaatatttacatgagcgtctgccattcatttgtgaattagcaagtgcttatgaaggtgtaaatccagtaaatgaaccaattccagttcgtccagttgttcactacaccatgggcggtattgaagtcgatttcaatagcgaaacacgtatcaaaggtttatttgctgtaggagaatgcgcatcttcaggtttacatggtgcaaatcgtttaggatctaactctttagctgaacttgttgtgttaggtcgcgttgcaggggaatatgcggcacaacgtgcagttgaagctcaatcggtaaatcaaagtgcggttgatgctcaagcaaaagatgttgttgctcgcctagaagctcttcacaaacaagaaggtaatgaatcttggtctgaaatccgtgatgaaatgggtaccgtgatggaagaaggctgtggtatttaccgtgaccaagcaagtatgcaaaaagcagtagataaaattgcagagttaaaagaacgttacaaacgtattcgcgtatcagataattcaagcgtgttcaatacagatgtactttacaccgttgagttgggttacattctagatgttgcacaatctattgcaaattcagcgattgaacgtaaagaatctcgtggtgctcaccaacgcttagattacacagaacgtgacgatgtcaattatttaaaacacacacttgctttctacaatgagaatggtgcgccgcgcattgaatacagtccggtgaaaattactaaatctcaacctgcaaaacgtgtttacggtgcggaagcagaagctcaagaagcagctgcgaaagctaaggagcaagcaaatggctaattcaccagtaatgaatgttgaagtattacgctacaatcctgaaatcgatcaagagccacatttaagcacctatcaagtaccttatgataatcaaacttcattgcttgatgcgttaggctatattaaggataaacttgaaccatctctttcttatcgttggtcttgccgtatggcgatctgcggttcttgcgggatgatggtaaataacaaaccaaaattggcttgtaaaacgttcttacgtgattacagcggccatatgcgtattgagccgttagcaaacttcccaattgaacgtgacttagtggttgatttaagccactttatcgaaagtttagaggcaattaagccttatattattggtaacgaagcaccagcattagatggtaaaccacatccatcgaaagaattgcaagttagccgtactaaacaaacgccagcacagcttgagaaatatcgtcaattctcaatgtgtatcaactgtggtttatgctatgccgcttgccctcaatttggtttaaatcctgaattcttaggccctgcagctattacgatggctcaccgttataatcttgataaccgtgaccatggtaaagcaaaacgtatgtcattattaaatggtaaaaacggggtttggagttgtactttcgttggctattgctcagaagtttgtccaaaacatgtggatcctgcttctgcaattaaccaaggcaaagtggaaagtgccaaagattatgttatctctatgctaaaaccaaaaggctaagggggaaggaatgtcagtacagtgagtaaacgtaaaaaatatgttcgtccaatgacagcgacttggtggcaaaaattggacttctacaaagcttatatgctacgtgaagcgacttcagtctttgctgtatggttttgtattgtattgctttatggtgttctttgtcttgcaagcaatccaatgccaggcttaggcatattgagctttattgagtttttaagaaaccctattgtggtgttcttaaatattattacgcttatcgcaacgctttatcatacggtgacatatttcttaatgacaccaaaagtgatgaatatcattgtgaaaaatgaacgcttaccacacactgttgtaagaaatgcactttgggcggtaaccacattagttagcgtgattgcgttagttttagtttatatttaagggagagaaaaaatggttgatcaaaatccaaaacgctccggcgaaccgccagtatggttaatgttcggtgcaggtggcacagtgagtgcaatttttcttcctgtcgttattctaatcatcggtttgttattaccatttggtttagtcgatgcgcataatttaattacttttgcttattcttggattggtaaattagttattttagtgcttactattttcccaatgtggtgtggtttacaccgtattcatcacggtatgcacgatcttaaagtacatgtgccagctggtggatttatcttttacggtttagccacaatttatacccgttgggtattatttgcggtaataaacctgtaataaaaatgttataataaaaaaacgagtcttagactcgttttaattttatattaagaaaaatttttaagtgggtttacttaaaaatccgatggttttttacaccgctcagcctcctggcctaatttcctt

SEQ ID NO: 397 - DNA, 2751 bp, H. influenzae
aaagcgattttacagccctcgtatcggaaacggtcggggcttttttattgcctaaagacaggcgggagataatatatgccaattaaagagcctgatgtgtgggcgttaatatggtcttggttgcaaacaaatcttagttctagctcagcacagagtgctttttgggcgttatttatttctcttttaagatttgggtttatgcgtaaaaagccagctattcgttatgttttaattgatgcggctatgtgtgcatccattgcgggtgttgcagtgccaatttgtacgcatttatttgggcatacagaatattcttcatttcttggcacgatgattggttttgttggtactgaaaaaattcgcgagtttttatttaaattcattaatcggagaattgaaaaagatgacaatgatgatttccgaagtgacatttaataaaatttttccacacgcagttaaaggtgtttatcaagctatttcggcgcagatagaaaaagcaggttgtgtgaataagatgcagcaagcgatgtttttggctcaatgtggacatgaaagtggcggatttacaagatttaaagaaaatttaaattattcttggcttgggctttctaaaactttccgtaaatatttcccagaccctcttatagcgaagaaatatgagcgcaaacctgaacttattgccaatcgtgtttatgctaatcgtctaggtaatggcgatgagaaaagtggagatggttggaagtatcgtggtcgtggactgattcagatcacaggtaaggataattatgccgcgtttagaaaatggttaggtagagatattgagccagatgatgtggcagggaatttagatttatctgttaaaactgcagtgtggtattggaaatgctatgagttggctgagcttaattctgtggaaaaagttacgcgaagaattaatggtggactaaatggcattgatgagcgttgcaagctctatcgagcattaatggtaacggataatgactaagtacatttacatggcgttagcgggtgttgtcgtggttttgattggtgcattgcgttaccaatctagcgttatagatgagttggaaataacgacaaaacaacaagaaaatactatccagcaacaagaagatgctaacaaatcattaagtcttgcgttacaacaagagcgttatgccattattgagcaacaagagcgtaataatgaaatagaaaggatagcaacagaaaatgctgaatcagttaaaacaatcattaagactcaaccttgtgctcacactcgtttgcctcagtctgttcttgaccgcttgcacgaataaaatcacgactaaaccagaatatatttatccgcctcaagcctatactgcaccttgtgtcaaaacagcatttactggggaaacatacggcgatgtagtcatacagttagttaaggtaaccgcagagcgagataagtgcgcaagccaagtagatcatcttaataagtggattaatcaagcaaaaggtggtaaatagattaaaaatctaattgagcggaattaatgccaagtgctgtcgctattttaatgcgagtgcttttacgcaaggtctgtgaattttcgtgttgtgaataagcagcttgagaaatgcctaaacggcttgccacttccgcttgtgttaaacctaagtgttcacgccaagcacgcaatgcagaataatcgttcaataaagctaatttggcaaccgcttctggaatacctgtctcaagtggattggtaaagatgattttttcataaaatgttaataaatggttcatctttctattttataagttttattcaagtattttaaggatttcctatgtcagacgtgaaaggaaaatctacgtctggtcgtggattaacacctaaacaagaaaaattttgccagctttatattgagctggggaatgccagtgaagcatatcggcagagttatgattgccaagatatgaagtccgaaagtataaaccgattggctaaaaaagaattagataagatcaagattagatcaagggttgatgtgcttcaacaagagcaccgacaacgccataatcttaccctagataatatcattgcggacttgcaagagtatcgtgatatttgtatgggaagaaagccacttactattaccactgtggtaaaaaatgctcaagaaggaacggcacaaagcgttaataccgaatgtttcgtttttgaaccgacaggtgcaaataaagcccttgaattgcttgggaagcatttagggatgtttaccaataaagttgatgtaacaactgatggcaagcccttacctactgtgattaatgtgacatttagcgatgagccagcttaatattcaatttcctacgaaattccgaccgctctttgaatctatttggccgtttattattttctacggtgggcgaggttcaggtaaaagttttagtatcgctagagcattagtattgcgagcctatcaatcgcctgttcgagttttgtgttgccgtgagatccaaaaatccatttctgattcggttattcagatgttggcagatcagattgaaatgttaggtctacaaaatttcttcgatgttcagaaaacgcaaattatcgggcaaaacggttcacgcttcacgtttgctgggctgaaaaccaacatcacatcaatcaagtcaatgacgggcattgatgtagtttgggtagaagaaggcgagaatgttcaaaagaaaggggtaccgagtcgatatcgtaaaca

SEQ ID NO: 398 - DNA, 2516 bp, H. influenzae
tggtatacgatatcgactcggtacccttttatcctcagctttcatattcgagttattcaagatcgtggctatttgcgcatcaaagttattggtgatttgcatggtgaaatcaatggatttaccaatagtgttcgccgccacttgtgcatttaagttcttcatctcattttgatgattcaaattcgccatatctttttgttgttgccgttcaagtgcggcttgagacgcagtgaattgattttgtgcctgatttaatcgactttgattgctataagctaaatcagattgtaattgcgccattccacgctgatgaccgcgttctaattctgcctgcgatgcggtgaattgattttgttgctgattgagcttactttggttttggaaatttaaatcagcttgtaagcgagtttgtttttccgcaaacgcattttgcgtatcttggcttgcaattggtattgccgcatcaagcattgcacgttgagcagattccacaccaatggttgaattttgcaagccgcgattagctgccatacgttctcctttagcagccgcgctattcattaaaagtgaattgctatttaataaattagagacattacctgccattgtctgtgatgtatcttttgtcggagattgagtggaaattgttggggcttgcggtgttttagttttattcaccgcatccgtcatagaacctagaattgacatatattctcctaaaaaaaaaagaccgcttatttcgcagcctcttgttgaaaatttatttaattattacttacggtggtaaaagcaacagcaagctgattcggactaaaccgccagccttcattgctatttttaatgcaattaaaacaccattcactgcaaaaatattttgatcgtttttgtttgatgccgagcacaatcccgacagcaccccaccagtcgtatttacagcccaaagtgcggtcaaaataggctttgatttgtgcttcggttacaccgtcgagcggaattaaatcccatttttctctatcataaacatcaatttgcttgcaacgtacgccaccgtctcgaattgaagacgaataacactcgtacatcacttctgtttcatagtgatgcccactgacaaatacttctttcattactgcaatttcacaatgcgaatacacgccttttgtcaatttacgagtgagccagtcactcaaacgtgccaaagtgcgttcgggtttttacccgtttttttacctttgtataatgcgagatagattttagtgcctatcattgttgtgcctccgctagttgtcgcatttttgaaacaatatcgtcatgaatgtttttcagttcttcatcactcaacgcctcatgctttaactcatacttacgcattctttgcactgctaattgttgttgcaatgcacgtaatctttctgcttgctgaagaatcaaaagtgacgcagactgattatcaagacctgcaaccgttgcaaaactgctgatataaacgcttacttctccagcaaaatttgcttctttaaaggcaatagcggcagcttctcgctccttatactcttcggcaaaccttatccatctagaactgatgttcgccgctgtatcatcaatgctatcaactagatttttaatgagttcacgcttaatttcagttttctttttttcatcgacaatccagctgtttccgttccatttgtgtaattctgttggttgtctatcaactagaatgtattgacttttaaaataaataagttgtttagtctcaagctctgattcgttttctacttccatttccacaaaatcatttaagttttgcggaatagggaaaatttgataactattcaaattttcttttaaaaaatagactttcattaatcactccttcatcgaatatcaatacgttttacaaaacgaccagcaagttcttcaatgtgtattgttgtaccgtttctatcaacagtcacagcgaattcctcgacttctacatgatacacactagttccaccagaactgtgtggaattacttgacgaatactactaaaataaactccaccgccccttttaccttcaatctctgcccctacttcaaaactgacaatttcaatattgttattatcatcaagcctgtggcctgatgatgactgaagatacaaaataagtgttttaccaaaacacttttctgaaatattaatactcccagaacttacattaccttgccacactgtttttaatgtgccaatttgagataaattcttttgtgcctgcaaaaattgctgatttatatcaacttttgcattgtttatttcttgtaaagtagattgtttattttcttttatttcttggtcaaccctcgcagataacgcttgcatattttgcacaagtgtacccgcatctaaaattcctgcgttctcaacaacgccgaatgctttaacccaaaattgcacgtcatcaaatgtgttttttgcttttatacaaagtttgagaataagcgatttagggcgagtgggtaccgagccgaattt

SEQ ID NO: 399 - DNA, 2994 bp, H. influenzae
cggccgagaaaaaaaaaaaacaggccaagggcggaccccgcgggaagagcgaaagcgggaaggggggggaaattcacagaatggccctttgcccgaacttttctgccgggggattaaaaaggaaaaaaggtcctatttgtggaaaatctcaccaggtgtcccccgttaaaactgatggcaatccaaaaatggcaggtaaaaacaccaaagaggacttgaaaattacccgcaattaaccctggtggaagagcagcggaagaagttctaattaatggggcgttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaataactattcagaacacaaggtaaaagcataaagccaatctgacagacatcaattaaattgcatgcctgtcagatttattaatagccactgttgctatattattttaaacatccacgtataaccaatacgccaacatttcgagcttgcgcgacggcttttggtttactcagtttaatttttaatccttgaagttgataacgtgactcaagcaaatccgccacttcataagccactcgctcaatcaacaagaaagatttactttccacataatcaataatcgcttggctcacttcagcataattcaaacaatatacaacatcatccgtttctgccgcttgtttacaatcccacgccatttccaaatcaaacacaagtttttgttttatttgctgttcccaatcatatacaccgatttgtgcaaaaacagtcaattcctcaataaaaacacgatccataagatttcctctaaaattattgtaggcgtatgctatcaattttgggtagaataacgaacagtttttcttgctggagtgcaaaatgagccttttcgcccttttttatatgctttttgcctatcttttaggctcaatttccagtgcgattttaatttgtcgcattgcaggcttgcctgatcctcgtcaaaatggctcacacaacccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataaaaattttaccgcacttttctaaatttccactggagtttcctgtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttggccagatccccgaattatgcaaaattaggggtaccgagtccgaatcgtatac

SEQ ID NO: 400 - DNA, 1512 bp, H. influenzae
tctgacgagtggctgagattgaaaaaaaaccccctcaattttgcgatgaaaaatgcgaatgttgtcacggcatttaatattgtgcgtaccgcacttttttaccgtattagagggcaacatcgccatcctcgtacccagagaatgttacgttattattttgctgcgcaagatattcacgaacgcgccaattctacgcattttgattatcaacaaataacggaaaaactaaaaaatacagatttgattttccgtattcaacgtttgttagaactacaagcacaatcctgtaaagaaatcacggcgagtttgcgtgaaaataaaccttatcattttaatgaacgtgtcgaacgtgcgcttttaggcaccttgcattcctttgaactgtatcgaacacaacatctcaatgatcaagatgaactgattgatattcaaaccttgttagataatttacaaagcattaactggcaacttcgccagttagcacaagaaacgacggatacagaacaattagctcaaattcatacggaacaaatcactgggttaaaaaatataagtgcggtgatttttagccattttacgtttgagtcaccgttgttccgacatgcggtacgcttatctattgtggtatttctgtgctgtgcaattgttgagtttttccaatttaatcttggttattggattttattgaccactgtatttgtgtgccagccaaactattctgcaactaaagtacgtttacgtcagcgtattattggcacgatattaggcgtagtggtagggtctctattaccttatttaaatccaaccttagaattaaaacagggtcttgtggtgctcacaagtactttgttctttttcttccgtagtaataattatagtttctcgacctttttcatcacactacaagtattgctcagttttgatgtcatgggatttgatacggcagctgcgttgatgcctcgtttacttgatactttacttggtgccgcgatttcatggtttgccgtatcttacttatggccagattggaaatatttgcaacttgataaagtgagccatcaagcattgcgtagtgatgcggtgtatttattgcatattattagtcaattgcaatttggtaaaagcgacgatcttaaatatcgcatagcacgtcgcaatgcacatcaatatgcagccgcactgagtacaacactttccaatatgaataatgaaccagtgaaatacaaggcatatttacaaaaaggttttgatttactcaaactgaattattctctattaagctatattcagcactgggagcttatcgagacagaatgaaaatttgcacagaccgcacaggtttttatctggttttttatcctggggcaaagaaaatttattataccttaaaaaccattgaagaatacccgagctattttaaccaacgccagaaagatcgaaaccatttaaagaatgggaaaacagactgactgccgaaaacgcgccgtctttgtttccgtatcccaattaatc

SEQ ID NO: 401 - DNA, 2796 bp, H. influenzae
  misc_feature (429)..(429): n is a, c, g, or t
  misc_feature (454)..(454): n is a, c, g, or t
ttacagagggcataatttatgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttgnggtggtaaattctcaggcgtggcanaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgattacaacggcgagcccgtacatttaggtgcaaaagacatactcggccatgtttacgaatacttcctcggtcgctttgcccaagccgaaggcaaacgcggcgggcaatatttcacgccgaaatccatcgtttccctgattgtcgaaatgctcgagccatactccggccgcgtgtatgacccagctatgggcagtggcggctttttcgtgcaaaccgaacgctttattaccgcccatcaaggcaacatcaacaacgtgtccatctacgggcaagaattcaaccccaccacatggaagctcgccgccatgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgagtaaaattccattaaatgaatttataactttacagcgtggatttgatttaccaagtaacaaaagaatttcaggaagtgttcccgttgttgcttcaacagggattgctggttatcacaatgaaattaaagttaaagcacctggagttgtaattggaagaagcggaagtattggtggtggacaatatattgaaaaagattttttccctttaaatacaacattatatgtaaaagatttcaaaggacattatcccagatttatttattacttattaaaaagtattgatttcacaagttttaatgtaggaacaggtgttcctacattaaatcgaaaccatttatcaagcattttaatttcagatttgggaattgagaaagaaaaagaaattgccaacatcttaggaagtcttgaccaaaaaatccaactcaacacccaaatcaaccaaaccttggaacaaatcgcccaagccctgtttaaaagctggtttgtcgatttcgacccagtgcgtgccaaagttcaagccctttcagacggcctgagccttgaacaagcagaacttgccgccatccaggcaatcagcggaaaaacacccgaagaactgaccgcactttcacaaacacagcctgaacgctacgccgaactagccgaaaccgccaaagcgtttccgtgtgagatggtggaggttgatggggttgaagtgccgaaggggtgggaggttaaagccttagatgaaattgcaaattatcagaatggtttagcattgcaaaaattccgccctgaagatgacgaaccatttttacctgttgtaaaaattgcccaattgagacaaggttatgcagatggcgatgaaaaagcaaaagcaaatattaagcctgaatgcattattgataatggtgatgtcattttttcttggtctggtagtttattagtagatatttggtgtggaggtaaagctgctttaaaccaacatttattcaaagtctcatccaaagaatatcctaaatggttctattatttttataccaaacatcatttaaccgaatttcagcgtattgcttatgacaaagcagtgacaaggggcatataaacggggtaccgagtccgaatcgtaaac

SEQ ID NO: 402 - DNA, 4021 bp, H. influenzae
  misc_feature (3470)..(3470): n is a, c, g, or t
  misc_feature (3668)..(3668): n is a, c, g, or t
  misc_feature (3800)..(3800): n is a, c, g, or t
cttgctttaaactattttgcgtattcatcacttgcctcccgtaatgcttttgttgcggcttgcacattatcggcgtgcgtaattgcagtaatcactgccacaccatccgccccaaattctcgtaaggttttaacgtgagctaatttcaccccaccaattgccacaagcggtttagttatgcccacatttcgcaaagtttgaataaacgccattcctagtgttggtttcggattctctttcgattgcgttggaaaaatcgggccaattccaaaataatcaatttccgctaaattttccccaatttttgcctcgtctaaacgattcaccgaccaaccaataattagcggtttatctgttttagctcgaatctcttgcacaggcatatcgctttgcccaacgtgaatgccatctgcctcaatttccaacgccaaatcaacgttgtcgtctacaataaacggtacgccatattcacggcacaaatcacgacaactcatcgccagtgccttctgtgctgagggcgtatgttctaacgaaaatttgcctttatcccgaaattgaaagcaggtaattccgccttctaacgcttgttttagcacgaataataaattttccgacaagttctcgcccaaatgacggcaatcttgcgtgcctgccacaaagtaaagcggtaagattttttgaatatttttcatctttcaatccttaaaggcgactgtaagcccaatgatttgtcggcccgtgtccttgcccaatattcaatgggtgagaaatcgcagcggtaataaaatctttcgctgtttttaccgcactttgcaacggttcgcctttcgccaactctgcggttaaacaggcagaaaaggtacagcccgtaccgtgtgtatgcggcgtgttgaaacgggggctttgcaaagtaaaatgacgaccatctgcaagtaaaacccaatcttggcacagctcactttgcgaattgagcgaatgtccgcccttaataataacattcttcgctccttgtttttgcaacgcttttgcggcttgttgaatactgatgtcgtccacaatcgcaatccccgttaatgcttccgcttcgggaatgttcggtgtaatcacgtccgccaacggcagcaatttttggcttaatgcacttaccgcttgctgttgcaataagggtgcaccacctttggcaatcattacaggatctagcaccagcgtgccgaaaggtttatcagcaagaaaatctgccacgcattcaataatttctgcattgcccaacataccaattttgcaacttgcaatctggaaatcatttttgaccgcttccagttgcgcttgaattgttttcagtggaataggggtgaatatcaaatacgcccaagtgtgttttgtgcagtaacagctgtaattaccgatgtaccaaacacgccgcgcatttgggaaggttttaagatcccgcttgaatgcctgcaccaccgccactgtctgaccctgcgatggttaaaacttgtttcacattactcattgatgcgccctctttgtccaatggtttcaggggaaaagggcagcaagctcgtccaacaaacggatttggaactgtcccacttgtgtggttaagccttgcgccgcacactcgcctgcaatggtgtatgctacacaggcttctaatgtcgcagaaaaataatttccttcacttaccgctaaaaaagccgcacacacggcactcaataaacagcccgaagccgtaactttcgggaacaatgacgtgccgttgtgaacggtcgcagtttgtgtgccatcgctgacaatatccaccgccccgctaatcaacaccgtacagccatagcgttgagccactttctcggcaacggcttttaaatccacttcgccttgccctgcatctacaccttttgcctgccacgtctcgcctgcaatggcagccagttcacctgcattaccacgaataagtgcgaattttacttctgccagcaattggcgaatggtctcacggcgatagctcgttgcccccacaccaacaggatctaacactacaggaattccaacctcatttgccgtttttcctgcctgcaacattgcctcccgatctttaccaatcagcgtaccaatattaatgaccaatacttgactgattttcggtacttcctgcatttcttcgatattcgccgacatcaaaggcgaagctcctaatgccaacaagccattggcactaaaatttgctgccacaatgttggtgatgttatgaatgagcggattctgctcacggattttggagagataaattgattgcataagcattccttgtattgaatataaaataaacaaaaatgcccgctattcactgtgagcaattagcggatgtaataaaatgtagaaaattggaaaaataaacaggataaaatcgtgatagagaaaggttgaatatgtggcatattagtttcctacgtcagtgctaactgtttcaggttcacgggtatcatctcagcctttcggcaccccgactaaaaattgcatgaagtttacgcttcttttcaagaaaaaacaagcggtcaaatttttccctcattttgcaaataatgagaagaatttgaccgcttaaatagaaaactaaatttgtttaattaaaaacggtaacgtacaccgaaagaggcttcgtgagttttaaaacgcacgttttctaagcgtccccaatcgttataacgataatctaagtctaaggtaatattcggtgtaatgtcatagccaataccaccaataaaaccaaagccaatgcgttttatgcttctagaacctgatgtttcctgatccgccttcacatctccgcctattggcatattgttagtcttaaatgtaagttttgttgtaaattcatcttttgtgtaaccgctggtagcaacatgcccaacttactctgttttataatataagtaaaaatgttttaattaaagcataaaataacagcaaaatctgactgattggttttttatgctttcaatcaaactgtatttataaaataaaaagaattgacgtaattttggttacgtcaattctatttttatttttgattattctgattttgcgcgggttggttcagaataaacgtggctaattgcacaatgatgtcctgccgcaccttttccatagaaataataacgagaatcctgccaagccctaattgggaaagcctctggcatttcatcatttgctttcgctaaagtcatctccgcttttgtatggggtactgaagaaattgtacctaaacgtccattaaattcataagtgcggacaaattttgatactttctcgagcgtttcaggttcatctacattaattgctggatcaatagattcaacaacttcttgaggtttatatgaacttaaacggtctaaagattcttgtacttttttctgtaccgattcattagctggttgagtaataaaatctaatgcaggttttacatncaggggatttttcttcaacgacaattcccattgctggcgtgataaacccttttttagttttctcttgctcaagcaattcatccacagataagaaatgattttcttttggcagatttaccgttgaataatcaatccaagccttgccacttgccaattcaggcgaaaccaccgcagcaaataatggcattggccgatttntggctcttgattacggcgacgacgctgattattcgctgcacgtaaatgacgttggagtacgacgctgacgctctttgacgtcaaacggttggttctgatgacccgggtttttcatcattattttgaaccgtnattacatccacttctggcattttttcagtcgggctgaagttattttcaacaactgtttcataatcttcaacgcgcacgcggttacgtaattacggcgtggcggggggtgagtaccaggctcaattctttcttctttagcctcaaaaccagggtgagaatttaccgcactttagcgatactttcttcccttaattaccgggcggccggggggtgattaccct

SEQ ID NO: 403 - DNA, 3132 bp, H. influenzae
gagtatttgaaggctcaattactgaccttccaaatgcaaaagcgaagaaaaataattcttattgaagaatttttaattctgcttagattaaaaattccagcctaaataaaaatccccaattggggatttttattttcctctctttctatttttttatgatagaatgccaatctaaaaacgtttcttttttttaccgcacttttgagcattatttatgactacacaacttgatttaatcaaatcttctatcaaatcaattcctaattatccaaaagaaggcattatcttccgcgacattacgacccttttagaagttccagcagcttttaaagcaacaatagatcttattgtggaacaatatcgcgataaaggaattaccaaagtgcttggaactgaatctcgtggttttatttttggtgcccccgttgccttagcactaggtttacctttcgaattagtacgtaaacctaaaaaattaccacgtgagactatttctcaatcttatcaattagaatatggtcaagatactttggaaatgcacgttgatgcaatttcagaaggtgacaatgttttaattattgatgatttattagcaactggtggcacagttgaagcgacagtaaaattagtgcaacgtttaggtggagcggtaaaacacgctgcatttgtgattaatttacctgaattaggtggcgaaaaacgcttaaataatttgggcgttgattgctatacactcgtcaattttgaaggtcattaattaaggattcgatgagctatcaagtcttagccagaaagtggcgaccaaaaacatttgctgatgtcgttgggcaagaacatattatcacggcattagcaaatggattaaaagataatcgactacatcacgcttacctcttttcaggcacgcgtggtgtaggaaaaacctctattgctagattattcgcgaaaggattaaattgtgttcacggtgtaacggcaacgccttgtggcgaatgtgaaaattgtaaaactattgagcaaggcaattttattgatttaattgaaattgatgcggcgtctcgcacaaaagttgaagacacgcgtgaattattggataacgtgcaatataaaccagttgtgggcagatttaaggtttacttaatcgatgaagtccatatgctatctcgtcattcatttaatgcgttgctcaaaactttagaagaaccgcccgaatatgtaaaatttttactcgcaacaacagatccacaaaaactacctgtaactattctttctcgctgtttacaatttcatcttaaagcattagatgaaactcaaatctcccagcatcttgcccatattttgacgcaagaaaatattccttttgaagagcctgcattagttaaacttgcaaaagcggcgcaaggaagtattcgtgatagtttaagtttaacggatcaagccattgcaatgggcgaccgacaagttacgaataatgttgtaagcaatatgttagggttgcttgatgataactattctgttgatattttatacgccttacaccaaggcaatggcgaactcttaatgcgaacactgcaaagagttgcagatgcggcaggcgattgggacaaattacttggcgaatgtgcagaaaaatacatcaaattgcactcatgcaacttcttccacaaaaatcttcagatgacaatgaacatttttcatttttagccaaacatatctctccagaagatgttcagtttttttatcaagtgattgtttctggtagaaaagatttatcaaatgcgccaaatcgtcgtattggagcagaaatgacattattgagggcattggcattccacccaaagttccttacggcagtaccaaagactaacactacaattactccaccgccatcaacgccaagtgcggttgaaaatactggtaattatgtagatgtgccagtactgtcgcaaagtataaaatcagcttattctcaagcaaaaccaaataaaacgagcattccaaatttggcaagcctttccgctttagatgcgctggaacatttaacacaactcgaaaaccaagaacgtcaagaacacaaagctgaatcattagctgtagtaagtgaaactttacatcacatccaagaactggatgaagaaaaatctcataaaaaaatgaccgcacttcccgtgcgagaaatgactgaaccaaagcccaagcacatagaaaaaccaacatcaccaccaaatgccgcacaagctcccacagaaatagcccagaagaaaattcaagtgatgataatgcagaagttgctcaagatgaacaagaaatcttgagtgctgacacctatcgttgggaatggagcaatccagaacttgctaaagccgatacaggcgttcgtccttctgatataaaacaggcgattttaaaagatattacgcctgaattacgtttaaaaatcatcacccaaactcaacaacaagatgagtgggcagatatagttgaacgttctggcgtaacaggatttagcaaagaattagcgttaaattgtttcttacaaagcaaaaccgatgatgaaatcaatcttggactacattcagaaaaatctcatttacgccaagacagaagtataaaaaatttggttgaagctttaagtaaattgcaaggtaaagatattcgattaacaatcaatcttgatgatagcaatgtcgcgacgccaattgaatatcgccgtaatatttatcaagcattgcgggaaaaagctcaaaatgaattgcaaaaagatagcaaactacaaatgttgcttaatgaattcgatgcaaaattagatgtagagagtattcgaccagtttaaaaatattgtgttttcccctcaagatttccctgccaaatttataaaaccatcagaatatttttattaagctctaccattttgtatgtttttaatctaaaattcgtcaatttgttttttaagagccaaaaggagagtgaaaatgaaactagttgaagtaaaacacccacttgtaaaacacaaactaggtgtgatgcgtgaagctgagattgatacaaaaaaattccgtgaactggcaacagaaattggtagcctattaacctatgaagcaacctctgatttagaaactgaaaaagtaacgt

SEQ ID NO: 404 - DNA, 3496 bp, H. influenzae
  misc_feature (3150)..(3150): n is a, c, g, or t
  misc_feature (3321)..(3321): n is a, c, g, or t
attcatttatgagtaagtttatgcagggaattccgaccacgcaacaaaactggtcgtcatttcctagcttaggtgttccgtcaattcaaattagttaagaggagaaaggttatggcgttttgggatggtgcatgggatgcaattagtggcgctggtaaatggctgggggaaacagctggaagtgcaatggattggatggacaaccataaagcagcaagtaatattatcggtaatgttattgctggtgctggtggttactttgcgcaaaaacaagctggtaaagatttgatcaatcagcaacgtgagttattaaatctgcaagatcagatgaaatcaaaatattcagccgtaccagatgcggattggtcgtataaaagtttgacagtggatgattctcctggattggcaaatggcggtattttgactgaaatgaagaaacgttctgaaactaaaggggctaacaatggcagagttgcatgatagttttggtgagtcaatggaaaaagctggctatgagcgagctagtgattctgattcatccttttccggtggaggtggttggcgagaagataacagtagtgatagttatcgtagtacgtcagatagatggaatgaccacaaatctagatacggaaaagacaaagtctatactgatgcatttaatgagcgaagaaataactctagttggagcggtggtcatagcgcaattagccgaacaattagtgaaaaatatcattcactttctaatgggcaaatgagcgccgccgttcctgaaaaagatcagaaaacactcactggcggtttgtttggaaaaagttactccaatgcgccttattctgaacgcactccttctatatttgatagaaacatacgtggttcaatgacattaaataacggcgatgtatggtcaagcgatccccaatattcatccgttcgagaacgggcggacatcaatagttacgaccgtattaaacggggcgaagaattgaacttaattggtcgtgctgtaggaggcgtttttagtggggtgggcggggcagcaacaacgccagttggcaaaattgctgaaagtgcggcaaattttgggctttcccacgttggggatttatctcgacaattcaaaagcaaccaagagcaagcgtattatgatagcctcactccagaggggaaagcgtattacgatacaagagtagatttcatcaataagtcctataagaatgctcgggaaaaatatgaaacgaacgataaatggattgatagaggtattacagctgcacaagtcggtttatctgctttagggcctcctggtgcaatgctagggtctgggattggtttattaggtaaagcgatcaacaaaaaagacacgatgacaaaatcattacgtgatttaacagagacgcttaactctaacgcattaaataaccacatcgcacaacaaaatgaattagctgaaaaagaacgtcaagcctataaggaatttatggctgggcgtgatttacgcagtgacaatacacaaccaaaaggcatactgaacactatgtataatcgtatgcaaaatatagatcctgataaacaggtcaaaacgagtgacgttcctaacctaagaaattattgggcaaatatcatcgtatcataggagaaattcatgggcattttagattcaatgacacaacaatcacaaccgcagacaacagaacaaagtgcggtcgaaaatccacagggttcacaacaacagggaagtatggcgcagatgtatcaaatgttgatgcaaaattccattaatgctatcgcaaatgttgcgcaacaacgtattcaagaaaaaggtcccgaagaaggtattgccgatttagtcgcaaaagcaatgatttcaaatcttcaggccgcgcaacaaaatggaaaaactattccgccgcaagtgatgatgcaagtcgctaaagatttagctatgcaattattacagcaagttggtgtgccagaagagcaaattgatgatgtattgattgatattttaatgaatgcgcttgagcaatttggcgaagcaacgcacggtgcgttacctcaggaagaagaacagcaatacgttgatatgatcaacaaagtatctgaaatggaaagccaacgtcgtgcgcaagtgcaaaacggtcaatcaaaaccaatgcaacaaggggcataatttatgggatggggtggaattttaggtgcgatgacacaaggattgggaactggtattgtcaaaaatgttgagcaagggtggaaagatgaagaaactcaaaagttgttagattggaaaacggcagaagccgacaaacaacgtgcttttgatagtgaattgcttgataaaaaatacaagcacgagtttgagcttgaagatcatagaacccgtaatgaaatttcagcggcggctgcaaaagctcgaatttcagcacgttattctcatggtggtgaatcagaagcgcaaaaaaatcttcttggcgcaactcaaacgcttggtatttatgatagccaattacattccttgcaagaaaaattgtccgcaacagaagataaagagcaacaaaatgcgattgcagcaagaatcaatgctgtttctgctgaacgcgagaattatcttaaacgccctgatacaatcgctgcatttaagggggctggccagatgggacaagcgctttatatgactggtggtggtaatatggatttgtacaatccgaaaccagtggagcgcgaaacggtagctgaggatgttaaatcttctgtcgctcctcctgtgcgcaatatgattgatgtaaataatctcactccacaacaggcggcagatattgcaagacagaaaagtgaagatgccgctcgtttgcagttttccaaagcgtcagcggatgctaaagactgggcgcaaaaacgtacacagtatcaatcatcaactttcattccgcgaacattctaaaaagtgcggtcagattttcgcatttcaataaaagcaaaaggcgaggttttagccccgccttcttttgcttgtttaacagtaaagttaatgtttacttgaattaattctaacgcatctaatcgtacgctacagttacaaaagcgaagtctttttccacaatagcttttgcttgctcaaactcttatattccctgttcatcacaacagttntcacacaagactataacaccctgattatcacttttcacaatagctgattgattcgcgatatacaacttgcgcttgagcaataaagtgccccaagtgcttctcatcgtgtagataactacctctgaatgaaatacttcaagatgcattgccatctcgataacaaaacgtganggtttgcagagaaacatctaggagtttgcctcacgcgttattctcacctcgaacttagtacttatgtactagaacagatcgggttacataaagaattcatttaaggtattatttagcttacagccccaaagagaaaggactaccaggtttgttattttggctgtggacaaggcct

SEQ ID NO: 405 - DNA, 4744 bp, H. influenzae
atccacttgatattccagcgaatcctgattattcttctttaaatttagcaatggctgtgcaactggtaagttatgaattgcgtatggctttcttagttcaaaataataagaaaaattcactttctttaatagagaaaaactatccaacaacagatcagttagcttatttttttgactacacagaacgtatatatcagtctcttggatttattcaaaatcaaggagttatgcgtaaattaaagcgtttatactatcgtgcaaaattagagaaaaacgaattaaatattttaaatggtatgctaagtgcggttgaaaaacgaattgatttaacaaaagagaataattgactaaattagtcagatatgtaagtattgcgcaattaatttttagggattctttatgaaacttacatcgaaaggtcgttatgcagttacagccgttttagatattgctttaaatgcagatggcgggcctgtaagccttgcggatatttctgaacgccaacatatttccttatcttatttagagcaactttttgctaaattacgtaaagacggtttagtcaaaagtgttcgcgggccaggaggtggttatcagttagggctaccaagtgaacaaatttctgtaggaatgattattgcggcagtaaatgaaaatattcacgtaacgaaatgtctggggcgtgaaaattgtaaaaatggtgtggaatgtttaactcacgaactttgggaagatttaagtttacgtattgaaagttttttaaatgagattacgttagcagagctggtaaataagcgtaatgtaaaacgtcaatctcatcgtgattttagtaatttattagttaatcaataaaaaggataagcagtatattttttaataaaaaagtgcggttatatttagcataatttaggagtgaaaatgaaattacctatttatttagactacgcagcgacctgtccagtcgatgaacgtgttgcgaaaaaaatgatggcgtttctaaccatcgatggcacatttggcaatccagcctctcgctcacataaatttggttggcaagcagaagaagctgttgatattgcgcgtaatcaaatcgctgatctcattggctcagattctcgtgaaattgtctttacttctggtgcgacagaatctgacaacctcgcaattaaaggtgcggcgcatttctatcaaactaaaggtaaacacattattacctgtaaaactgaacataaagcagtgttagatacttgccgtcaattagaaagagaaggttttgaagtcacttatttgtctccagaagctgatggtttaattgatttagaaaaattcaaagctgcgcttcgtccagatacaattctagcttcaattatgcacgctaataatgaaattggtgtgttacaagatattaaagctattggcgaactttgtcgtgcaaataaaacaattttccatgtggatgcaactcaaagtgttggtaaagttgaaattaatttggaagaattagctgttgatttaatgtcgatgtctagccataaactttacgggccaaaaggtgttggcgcattgtatgttcgtcgtaaacctcgcatacgtttagaggcgattattcatggtggtggtcacgaacgtggcatgcgttcaggtacattacctgttcatcaaatcgtaggaatgggagaggcatatcgaattgcaaaagaagaaatggcatcagaaatgccgcgtttaaaagcacttcgtgatcgtttatataatggcttaaaagatattgaagaaacttatgtaaatggttcaatggaacatcgtttagatagcaatttaaatattagttttaactatgttgagggagagtccttaatgatggcgttgcgcgatattgctgtctcttctggttctgcttgtacatctgctagcttagagccatcttatgtattgcgcgcacttggcttaaatgatgaattggcgcacagttcaattcgtttcacattaggtcgttatactactgaagaagaaattgattacacaattaatttaatgaagggtgcggtagaaaaacttcgtgcattatcgccattatgggatatgtttaaagaaggtattgatttaaataccattgagtggtcagctcactaatatttagttgccattatctgacaatggcatttactagaattgaaaaaaggaaagttaaaatggcttatagcgaaaaagtaattgatcattatgaaaatccacgtaatgtgggatcattggataaaaaagatagcaatgttggtactggaatggtcggtgcgccagcttgtggtgatgttatgcaactacaaatcaaggtagatgataatggcattattgaagatgcaaaattcaaaacttacggctgtggttctgcgattgcatctagttcattaattactgagtgggtaaaaggtaaatctttagaagaagctggggcaattaaaaatagccaaattgctgaagaattagaattgccgccagtgaaagtgcattgctctattttagcagaagatgcaattaaagcagcaattgctgattataaagcaaaacaaggctaatcatgtgaaaaagtgcggtcaattttgaccgcatttttagcggtgtttgggggatagatgggtattacattaacagaaaaagcagctcagcgagtgaaagcctttttggataatcgtggtaaaggtattggattacgtttaggtgtgaaaacatcaggttgttcaggcttagcttatgtacttgagtttgtagatgttttaaattccgaagatcaagtttttgagcagcacggtgttaatattattgtcgatccaaaaagtctcgtttatctcaatggcattgagctggattatgtaaaagaaggcctaaatgaaggctttaaatataataatccaaatgtaaaagaatcttgtggttgtggcgaaagtttccacgtttaaggtaataatctgatgttcaatccttttcaaatttttgatttgccagttgattttcagctggatgaaaaagtactaaatgcacgttatttaaaattacaaaaggccctacatccagataattttgtctcaagtagtgctttagagcaacgtgttgcgatgcaaaaatctaccgaagtgaatgatgccttaaaaacgttaaaagacccaattttgcgagctgaagcgatcattgctcttaatactggtgagcagttagatcttgaacaaaaaagcacgcaagatgtggcgtttttaatgcaacaattacaatggcgcgaacaattagaagatgttgaaagccagcaagatgaaagagcattaaatgtttttgcgaaagaaattaaacaagaaactcaatcattattgaccgcactttttgagagtttgaaatctcaacaatgggcgagagcatctcaatactgtgataaattacgttttacccataaactttctgaagaaattgaacgtgtggaagaacgaatttttgaattagattaaatctgggggcaaatgtaatttgcccctacgagatgtgaataaataacactatgcaaactcttgaacagctcactagtccagaacattctgcttggataaccctttcccaatggattgataacgctcgcaatcattgtgaagtaattaaaaaagatcaatccagtgcggagcgtgagctttttactatgcaaatgccaacatcctcgccaatgggtgcagtaatctatgaaacaggtggaattttaattcattatggttggttacgtattttaggttctggaagttttaaattaccgcgtggcttgatggattggaatttcagtaaatcttttagtgagtcaggcgaaaaaccaaaatatttattagttgcagatgatgtgattggtggttattttgcgttaaatggtggttcgttaggcaataatattggaaaaatttattactattcatcaaaagatcttacttggcataatttaaattttacttacacagaatttttagcttgggcattgaatggcgatgtagaggccttttatcaagggctattttggaaaaattggcaagatgatgtaaaacaattagatggtaaccaagtttttgtatttacgcctgatttaaaccaagacagaaaatagcaattgatgaacgtcaaaaacaggaagtcaatattgaaacccattaccaagcaaactttgcagaaaaaaataaatttgatttggcgtattccgtcgcataactagtagaaaaatagcatatggcattattacaaattgcagaaccaggacaagctgcggcaccgcatcaacatcgtttagccgttgggattgatttgggaacaaccaattctttggttgcatccgtgcgtagtgggcaatccgtgattcttaatgatgaacaagaacgcagtcttgtgccgtcagttgttcattatggcgttgaagagaagaaagttggtttagaagcctttgagcaagcctcacttgatccaaaaaatacggtgatttcagtaaaacgcttaattggtcgcagccttcctgatgttcagtctcgttattctagtttgccttatgaatttgtggcgagtgaaaatggattacctttaattattacggcacaggggcctaaaagtccaattgaagtgtcttcagatattttatcgcgcttaaatcacattgcagaacaacgcctggaggtgagcttcggggtgtgattacagtccagctattcgagatgggaccagccgaatcgaaaca

SEQ ID NO: 406 - DNA, 2540 bp, H. influenzae
  misc_feature (2296)..(2297): n is a, c, g, or t
  misc_feature (2464)..(2464): n is a, c, g, or t
  misc_feature (2496)..(2496): n is a, c, g, or t
  misc_feature (2515)..(2515): n is a, c, g, or t
  misc_feature (2527)..(2527): n is a, c, g, or t
actcaagtaaagatgcaggggaacaacagttagggcgtttctgtttccaaatcgataaccacttcgataagcttctgttttagttggatcagtaataatataacgagatccaacaatatcggtcagtcgtgaaatgagttgttgaacagacattttattatcctcttgttataagaattagtagtactataacagaataattcccatttggataaggacattttaggctttaatcggtgtttttttggaattgctctgcatataaagaaaattctctctttatgataggttcagtgctgtatgggtatttcaatcactcaatatcagcaatgcaaaatccgttgaaacctttaaagataaagaaaaatattatttaacaaacgaaacttttactgaaatacaacctattgatatgccaaacgaacgtaatattcaaaattatcactcgacttacaacaacattcgggattggcttggttatcaaaaagctggcgaggaaaaagcaaagtcgaccatcaattaggaattgggatgaggtagtttttgaagtgaattttaagcacaataaaaaaacatcagaatttttagccgcactttctaaagtatccgctaatttacataaatgatttaaccctacctatgctgctactcttttaattttatgaacagtattttctgtttctttcatattatcttttgataattgagtaagataattaggcatggtttgtttgaataaagataaattttttaaaatttacattccgaccaaggttggcaatatcagatgatagattatcaacacatactcagggagaatggcattcaaagtatgtgaagggaaattgtttagataacagtagaatggaaagcttctttagatgttttaataactggaaaaaaagctccatgagcgtattcagaagaggctaaagactgagtcctgtaaatgacagaactcagtccttgagctaaataagtctaactttttggggtcagatcatttatcaataaactgatcaaaaaaaccgaacttaatgttcggttttcttcttcattacataatacgacgcgattgagtgtaggttctagcccaatatttttcatcaagggaacttattgtcacgccttgccctgtacttgcgtgcataaattggttattaccaatataaacaccaacgtgattatttttacggaagaaaactaaatcgccttttttaagttctgatttattaatttttctacctaaatgacgctgttcagccgtagaacgaggcaattcaataccaaaaacttcagaaaaagtagtttgcataaatgctgaacaatcaataccacgtttagtcgtaccgcccatacgatagcgagtgccaacccattcattataaacactggctagagccttatcgcccatcaaagcagaggaacggtttgttctcactttgtgaaaaatgcctgttcgattatctttttctaaattattaattaaaccagttaattgaatatcatcattttctgaaataacctgatgacttaccgttcgtggtgcattagaacaagcggttgctaatacagctaaaccaataataactaaaattcttttcaacataatttcaaataattaaaagaaataaaatttcgcagcggctatcaaaatttgaataaaattgccagtaaaaatccaattctaatggaatttttgtgatcttttacacaatgacttaatttgttccaccaacagtaatttcatcaatttttagtgctggctgtcctacgccaacaggtacactttgcccctctttaccacaaaccccgatacctaaatcaagttctgatttatctgcaaccatagaaatcttttgcatcacttcaatgccactgccaattaaagttgcgcccttaactggtttcgtgatttttcctttttcaattaaataggcttctgaagtagaaaatacaaatttaccagaggtaatatccacttgccctccaccaaagtgcggtgcataaatcccctgttttacagaagcaatcaaatcatcaaactgactttgtccagcaagcatataggtgttggtcattctaggcattggtaaatgggcataagactcacgtcgtccatttcccgttggagcaacgcccatcaaacgggcattcattttatcttgcatgtaaccttgcaaaatcccgtctttgatgagtacattgcactggcttggcacaccttcatcatcaatagttagtgaacctcgacgattttcaatcgtgccatcatccacaatcgtacataacgggnngaaagtcacttgctcaccaatcttgcctgtaaaaagtgaactttcttttacggttaaaatcgccttctaaaccgtgacctaccgctttcgtgtagcaatacgcccggccaacccgcacctaacacaacaggcatcaatcctgcgggtgctgcaactgcacttaaggnttactaagggctgacgaaccgctctttaccanaagtactgctctatatcgncatcacaacttncaaaaccaatcta

SEQ ID NO: 407 - DNA, 2775 bp, H. influenzae
caaaaatatatgacttgggattctgctcgttcaattcgtatgtttggtacaagtaatttgattaatcaagaaacaggtgcaggtattaatcgtttctatgctccaggcaaaaactatagaatgtcagttcagtttgaattctaacctgttgtaaaaataaaatacgagcatttcctgtttagattgagtttgacactcatatactaaacaggaaatgctcattttttattgtgatttgtcagatgaggtttgatcttctacatttgtagtcagattggcttcttatttaaaagattgataattttattggaatatagattgttaataactaagtataaatcataatcaattttactaaatacccacataacttgtttcagaattttctttaaatctttattgaagatgggatcgtgatgacaaattctgtttcttatgttcactcttaaattctttgtgacttttataataaataatatatccttatctttatttgagttttcaaaagaaattattctataagcatacaaaagaggcattctgtgaagctcacgagaattccacaagaaaaacttcttcaaaaaattcccaaaagtgaaaatgtaaactagatatgatttttccatcagtcgcatttctacctaattcttcaactttttctcttaatttaggactttgtctaagtatttgtctctgtctgataccataatgatcatacgaatctattgatctataaatagcatttcttaatgaaatctcatatatattacataattcaagaaaatagcccgctatttcagaattccattcatataaagcaaccatgttatcattaatactttctgaagttttatttttcacatagtttttgtatgtagataatctttccttactaagtgctttttctaaaacaagaaattgcgttgctgataacatataatcctacttatcacttgacatttgaattatttaaccatagactccgccccgacgatagggaacgttggtcactgatagcattatcatccccccctacaatattgagacaaggccacctaaaaggtggcttttgtcatttttaattcctgaaaagcatcgttttcaactaaatcaataatgctacgcaatccataaaaatccagcttttatgctggattttgtttttagcttaggcataatagcaataacttttcatccctaaaaaggattataaatatgaaaaatatgttactgctcagtagctcaaaatacaagaacacaggttatcttgaacacaccctaccttggttacaaaatttcttggctgattatcgtggtaaaacaattgcttttgtaccttatgctggggtaagccgcacttttgatgaatatgaaaaaactgtgcaaaatgcactttccgatttagggatgaatattgtttccgttcatcatggtaaacagcatcgggatattattgaacaagcagatgtcatctctattggcggtggaaatacattttgtttgttaaaacagctttatgaacacaatttgattgatatcattcgtgaaaaagtaaataacggtacgccttattttggttggagtgctggggcaaatgtagctggcgcatctattatgacaactaatgatatgccgattacttatcctccttcatttcaagcattacaactttttcctcatcaaattaatccgcactttatttcaggtaaaatgcaaggccacaatggtgaaagccgagaagaacgtttggcagaatttttactcgttaatccaaccgcacttgtatatgcattacctgaaggttctgcgcttcatatacaaaatgaaatggcaactgtattgggcgaaaatcctattttgtgcttcagtgaaaatatggaatgtggcacatttgatatcaatacaactttttcttattaacttaaagggaacatataatggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttaccacggacttttggatcaatgatgacgtcgggttttttctactctgcaacgattattgaaatgcacaggattacctctcactcaagaacacctttcccctgttccttaccacacgaacgcgacagcaaataggcgcagttgttcttaatcatttctttccgctggcatctataagatatttggtgcaaacacatcggtcgcgtcttattcttttctaattaatttatgtttacatatgatttgtcatatcgcgtcttattattctctgccccttgccccatctatgatacttctttttgtctgatttcttcgaccccacactatttaccttccctcccttttgcccgcctttccttgtcttttctctctttccctcccctccggccctattaccctcccg

SEQ ID NO: 408 - DNA, 4300 bp, H. influenzae
  misc_feature (1229)..(1229): n is a, c, g, or t
  misc_feature (1434)..(1434): n is a, c, g, or t
acgaatcttggatgattagaaaagcttacgaagaaaaagcgaccgttatcggtttaatcaacggcaaagtgaaaggtggcttcacagttgagttaaacggtgttcgtgcattcttaccaggttctttagttgatactcgtccagcgcgtgaagcagatcacttacttggtaaagaattagaattcaaagtaatcaaattagatcaaaaacgtaacaacgttgttgtttctcgtcgtgcagtaattgaatctgaaaacagccaagaacgtgaacaagtattagaaaatcttgttgaaggttcagaagttaaaggtatcgttaaaaacttaactgagtacggtgcattcgttgatcttggtggtgttgatggtttattacacatcacagatatggcttggaaacgtgttaaacacccaagtgaaatcgtaaatgttggcgatgaagtaactgttaaagtattaaaattcgataaagatcgtactcgcgtatctttaggcttaaaacaattaggtcaagatccttgggctgcaattgctgaaaatcatccagtaaacagcaaattaacaggtaaagtaactaacttaactgactatggctgtttcgttgaaatcttagatggcgttgaaggtttagttcacgtttctgaaatggattggactaataaaaatatccacccatctaaagtggttagcttaggcgatactgtagaagtaatggtattagaaattgatgaagaacgtcgtcgtatttctttaggcttaaaacaatgtaaagctaacccttggactcaatttgctgatactcacaacaaaggcgataaagtaacgggtaaaatcaagtctatcactgatttcggtatcttcatcggtcttgaaggtggtatcgatggtttagttcacttatctgatatttcttggagtatttcaggcgaagaagctgttcgtcaatacaaaaaaggtgacgaagtgtcagctgttgtattagctgttgatgcagtaaaagaacgtatctctttaggtattaaacaacttgaagaagatccattcaataactttgttgcaatcaacaaaaaaggtgcggtagtatctgcaactgttgttgaagcagatgctaaaggtgctaaagttgaattagcaggtggtgttgaaagttatatccgttctgctgattaacaagtgaagtagctattggcgatgttggtgaagcgaaaacactggagtagatcgtanatctcgcattgttcacttatcagtgaaagcaaaagatcaagctgaagaagctgcgcagttgcaagtgtaaatacaaacaagaagatattgttattccaaatgcaatggctgaagcatttaaagcagctaaaggtgaataattaattcacgtaataaggctgggctgatgtccagcctatttgttaggagttattgctaatatatntgtgtaatttattatcaatagatcttaatttaaataatattaaggaagtatagaggatgactaagtcagaacttatggaaaaattgtcagcaaaacagccaactttatctgcaaaagaaattgaaaatatggtaaaagatattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctagagtggatgttcaggcttaattgattaaaatttaattaaaatatttttgattaaaaagtttattttgggttacaaatattttaaaggaaatgaaatgattaaatatattttaggcattgtgatctttattgcgattgtgttagttgcaattaccattggtgcgaataacgatcagattattacatttaattatattgtggcagaaagtcagtttcagctttcaagcctcgttgcaattttatttgggttaggtttaattcttggttggttaattactgcttttttctatattaagttaaaattaaaaaatatggcactagctcgtcaagtgaaacgtcagactttacaaatcaatgaattgacgactacgcgcgataaggtcgcttaatgatagaattactctttctattattgcctattgctgctgcctatggctggtatatggggcggcgtagtgcgaagaaagatcaagatgacataagtaataaactctcccgagattatgttacgggagtgaattttttactttctaatcaaactgataaagctgtagatttgtttttagatatgttgcaaaagcaagaaatcgaaaatgaaatcgaaagccactcccaatttgaagccgagcttacacttggtaatctgtttcgttctcgaggcgaagttgatcgtgcattgcgtattcatcaagctttagatcttagtcctaattatacttttgaacaaaaattacttgcaaaacaacagcttgctcgagattttatggtggttggtttttttgaccgagctgagaatctttatattttactagtagatgaacctgaatttgcagaaaatgctttacagcaacttttagtgatttatcaaaaaacaaaagaatggaaaaaagcagtcaatattgctgaaaaactcgctaaaataaagccacaagagaataatattgaacttgcgcaatgttattgtgaatattcacaaagtttagaacctgaaagtgcggttgaaaaacgcagtgttttacaaaaggctttgtcggtttctccgacttgtgttcgcgcttctttattgcttgcaaatttagcaatgcttgatggtcaatatcaacaagcagtagaaattttagaaaatgttttggagcaaaatccagattatacgggtgaaattttgtcacctttaaaacattgttatgaagaattaaatcagttagataattttgagttatttttaattcgtgcaggtcaaattattaataatgatgaagtagaactagctctagtcaaattaattgaagaaaaagatggtaagtctgctgcgcaagctaagctttatcaacaacttacaaaaaatccaagtactttaattttccatcgttttatgcagtatcaaattgatgatgcagaagacgggcggggaaaagaaagcttaattttattacataaaatggttggcgaaaggattaagcaaacatcgccttatcgttgtacaaattgtggttatcaaattcataagctattgtggaattgcccatcttgccgtcaatgggaaagtattaaaccggtttcaaatcaagaacataattaattgatactcagtgaggtaacattatgacaagcaaaattattgtggcattggattatgagaaagaagcagaggctcttgctttagttgatcaaattgatccaagtttgtgtcgattaaaagtgggtaaagaaatgtttactacacttggtattaattttgtaaaacaattacatcaacgtaactttgatgtttttttggatcttaaatatcacgatattccaaatacggtagcaagagcagttcgttctgctgctgatttaggcgtatggatggtggatttacacgcaagtggtggtttgcgtatgatggaagaggcgaagaaaattcttgaaccttatgggaaagatgcaccattgcttattgccgtgacggtattaaccagtatggaagatttggatttattacaaattgggattaatgcatcgccaatggaacaagttttacgcttagctcatttaacccaacgggcgggtttagatggtgtagtctgttcccctcaagaagttgaaattttacgtaatacttgtggtaaagagtttaaattagttacaccggggattcgtccaataggaactgattttggtgatcaacgacgtgtgatgacgcctactgcagcaattcgtgcaggttcagattatttagttattggacgccctataactcaagcggataatcctgcggaggttctccgttctattaatgtatctattgggtaatcataaatgtcagattttgttttagtgtattctacagatgtggggcgaattaaagaggaaaaggcttctgtagttcgcccaaaagagacggtgttgtacgtatccaaaaacaaacagtggtaggaaaggtgctggcgtatcggttatactggtttagattatctgacaggatttgaaaaattacctgcagatttaagaaccttggggtgtggcggacagtttaaatggattattggatccaggggaaaacc

SEQ ID NO: 409 - DNA, 3262 bp, H. influenzae
gataatcttctgcgctggattttataaaaaagccccccgggccagcaaataacctttaataaggaaggcgtaaattacaatgcccgtttttttgcatagaaaagaaaaagttgtgggataattaatttctaaatcagtatcattgaaattattaatttttgactgtccaagcaatataatttcagcctcaagtttttctgataaaagtgcggttaaattttgctgaaaatctgagtggaataaagcatcgtcttcacagactagtgcatagctatcttcagcaatatcgttgtcttcaataattttttggtacacagaaaggtggcttaaagtacaaccgatctcgcccttagtgacattacgaaaataatgtgctttaaattgttcaatattaaaaatagaggctaattcatcccaatctttttgcatggtattaatggcagaaaaaatttggaaatcctcggtatttttttgagaaaagaataatttccgacgttgaatatctttatctaaagagatcaaatatttttttaacataaaattattccttataaaatccctttccattcttcaataattttctcaatgccataatcttcactcattaaacgagatttgtctgacatttgttgataaagttcaggattattgattaataaatctaaacctttaaccatttcttcaatattattttgttcacaaagaaaaccattttctttatgttcgactaattgctttacgccaggagaacaattaaaggcaacaataggtaagccaaatgccatcgcttcaataacgactaaaggcaacccttctgtttgtgaaggtaaacaataaattgaactgctttcataataaaaagcaacatcattagtacgaggaataaaattaactgaatcttcaatattcaatgctttagcaagattttttaaattttcttcttcctcgcctgaacccgctattttcaaattccaatctggatatttttttgccaaaacttgccaaacttttaataaataatcaaaacctttataagaaaataaatgacctacagataaaacagttttattttcccattttgctaatttattctttggcaaaagcgtatttggattagcaatactgattatattgttcgttttaaatttttcttgccacagcgttttttctgcttctgtcaatgtaactattttatcgcaagttgttacagctaaatatttaccgagcgtgcgaacgagacgattgcccgtaaaattaaaagaataatgctcccataaaatatgttttatatttaaattaaccaacgccaaagcagaaaaaagcataattgcaccatcaaccacaattaaggtatccagctgtaattctttaactaattctcttaattttttagtgatagaaaaatatcttttttcaatgaatatggcaatttattcattgggtaaatattaattttttcatcaacttggaaaaaaggcttgttaccgccaatgctaataaaagaaacatcatatcctgtttagcaagagcattaacaacattaatggaaactcgctccgttccacccgcactttcgatattcataataaagaaaccaatttttttcattttaaatttccttataaatctttaatccaaggtctggaaatgaatcgtaacagaattgccatcttggaatactcgttctaataaaacgaatttctacattaggatgacttaacaaattaaatgcaacagaactgaagaacgtataaataattattattttatttgataaatatttaaatacgtaatcttcaaaaattaattcagattcaacataatttaccccatcaactcgataatcttctgctggatgagggaaataataatcaaaagaaaattgttcttttaatttttttattaatgagatattttcctcttttgtatttaacaatggttgcccaataaaaaatgagacctcaccatctatctcgcaatctatttgattatcccataaagaaattggttcaatattagaaacaatatttttgtaattaggataaaccgtataatgtttttttatttttttaaataatttattcacactatatttatcgccaataaaagctttaatcagtttatatttaaatgtgtcaggctctctcaataaattaggatgtgggaaaatattatctgaaccatcatcaaaggtataaagctctttaaatgaaacatgactaagataagtttgtagccataatgaattaagattggcgagaaaaaccttatcaaaacctttgtgcgtaattttattcttaagctggcgcattaacttgagaaaatcgaaaccttttagatcttttcccgtatcaatattcatcgaatcactacaaacctccgctaatttactcgcatacaaggttctttttttatcccataccctaccaaacattacgccaaagaattgttcattaggatgtaattcaattatttttctcgcaattaatacttgcaatggtgtacaacaaagaatgagattcatagggttttactcactttagatgtcataaaataaagaataggaataatggaaagcgaaccaataattccagcataagggatatatttaatttctgtaaaagttaaagctacaaggcttgccacataaatgattgtagataaaacggaacattgggaaataagtttatttttcccataatagaaaagataattaactaaaatcaaataaggaatacttaatgtggtcgaaattaaaaataaaataaaataatatttcgttcccacaaattgactacctaaaatccaaactaacacatcctcaggaataatccacattattaaggcaggaataggtattagcaaaaaggaaaataacgcccatttatgtagctgttgaataactaatttcttttgttttaaggcttcataaaaatagggaataatcgctttattaagtgcttgaatagcaatagaaacaattaaagcaagttgagcccccatagcataaagccctaaatctgtttcactgaatttgtgataaataaaaatacggtctaactgcccttttaagaaaaaacttgcataatgtaaaataagcggtaatccaaatcctaaaatataaaatagtgcggattgataatgcttaaattgatttttttagatgtcgtactctttctgtaaagaaaataagaaaaaaaccaaacgactaaattactcaataaaatgggggtctcctagagtcgaccgcaggcagcaagct

SEQ ID NO: 410 - DNA, 4037 bp, H. influenzae
aggacccccaactctatggatcgcgatttacttatccaacatttaaaaaatctaaaaaaggcagtgcagtagatgtgcctgtttatagctatgtagaacatactcgcaccaacgaaacaacgcatttcacaccaaaacgaatcgtaattttagaagggattttattgctcacagacgaaagagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccatctaaacaatatgcggatattgtcattcctcgtggtggtaaaaaccgtattgcaatcaatatgttaaaagctcaaatccttcatttattgaatcaaaaataggaaatcttatgcgtctttgcgatactgatattgaacgctatctcgatgatggcattatttctttaacaccacgtccaaataatgacaaaatcaatggtgcgacaattgatgttcgcttaggtaattctttccgtgtatttcgtgaacactctgcacctttcattgatttaagtggcccgaaagaagaagtatccgcccagcttgaatcagtaatgagcgatgaaattcttattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgaattgacccaggttgggaaggaaaaatcgtgctggaattttataattcagggaaattaccattagcattacgcccaaatatggtaattggtgcgttaagttttgaagtattaagtggcgaagcaaaacgaccatacagtagccgcaaagatgcaaaatataaaaatcaacaaagtgcagtagccagtcgtattgacgaagacaaggaataatcaatgaaaaagttcgcgcttatcgtagggatcgtcgctttggcgatcttttcttttttatatattcaactttaccgcgtgcaaagtgctattaatgaacaactggcacaacaaaacattgccgttcagtcaatcaatttatcattattttctcccgcactttcccttgaaaatctaaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagaggtttcgcctttttcgttaaaacagcttttatcaaaaaaagtaatattaaatggcgaaaaccatattcgcattgaatttaataagcctatttatggaaaaacaaaaactttccatttttctttccataaagcgaatttagacttctcaacatcagaatcaaccccacttcaatttgtagatgcaagcctaaataatcagcctatcggttatattgaaagccacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaattttaagtggacacgccgattttgatcttgatttcagcttttcatcttccgcgcttattcaaggtaaattaaattttttagcgcaaaatggcgaaattcttggtgtgaatctattggatatggtagcgcaatatttcccgattaattacaacaatgatctgttacaaaacaaagaattaaacactcgctttgaacaattttacttgcaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaatgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaactgctgatactggtttaatgatgacagtttatgcttggacggtgctaattatgtctttaccagcgatgcttgccacgggcaatatggaacgtaaaagtctgcttattaagcttttcattatatttattgttgggcatattttattggtcattgcatggaatttctggatattacttctcgctcgaatgtgtattgcattagcccattcggtgttttggtcaattactgcctcacttgtgatgcgcatctcacctaaacacaagaaaactcaagcattaggaatgctcgctattggcaccgcacttgccaccatcttaggcttaccgattgggagaatcgtcggacagcttgtcggttggcgagtcacttttggcattattgcggtactggcattatccatcatgtttttaattattcgattattgccaaatttacccagtaaaaatgctggctctattgcaagtttacccttgcttgcgaaacgcccattattactttggctttacgtaacaacggcaatcgtcatttcagcacattttactgcttatacttatatcgaaccatttatgattgatgtcgggcatttagatccaaattttgccacggctgtattattagtttttggtttctcaggcattgcagcaagcctattatttaacagattataccgatttgctcccacaaaatttattgttgtttcgatgagtttattgatgttctctctattgctcctgttattttcaactgaagcaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacctttcttctgcaaaacaataaaaaaataaccgcactttagttctccaaaaagagttttaaaagtgcggttaaatctgtctaagttttatttatcttgcgtttaacgttttgctttcttaataaacttcatcaaacgtttacgtttacgcaattgattcggagtgagtttatttttgcgtcctgcaaatgggtttgagccttcttggaaaagcagacgaatcggtgaaccaataatttttaagctcttacgataataattagataaataacgtttataagaatctggtagtttatccatttggttaccgtgaactactataatcggcggattataaccacctgggtgagcatattttaatttaatgcgacgaccgccaatcatcggcggttggtgctcatccgttgccatttgcaaaatacgagttaaaagcgaagtcgtcattttttgagtggcacaagcataggcttctttaatcgaatcaaaaagattacctacaccacttccgtgcaaggctgaaataaaatgcacccgagcaaaatcaataaaatctaaacgacgatcaagctcagatttcacacgtctttcactctgatataaaccatccctttatcacgacgatcaccaggtacgagccgaatcgaaca

SEQ ID NO: 411 - DNA, 3318 bp, H. influenzae
  misc_feature (3281)..(3281): n is a, c, g, or t
  misc_feature (3291)..(3291): n is a, c, g, or t
gagaccccgggctaagcccccaaaatatcacgattgtttgttggtgggctaaagcccactctacaactactaatcaacaatcaacggctcgcattataggaaacaagcaggtttaaatacagaaaataataagaatagtttttatttcttgatttttatcaaaaatcaatctttattgttgtgagaaaatgcttcctcgtataatatatttgagaattattattatttttttataggattaaatatgaccaattttagattaaacgtgcttgcctattccgttatgcttgggctaacggcaagtgttgcttatgcagagccaaccaaccaaccaaccaaccaaccaaccaaccaaccaaccaaccaaccaaccaaccaaccaaccaaaatagtaatgcttctgaacaactagaacaaataaatgtatctggctctaccgaaaatactgatacgaaaactccgccaaaaattgccgaaactgtaaaaacggctaaaacgctagaaagagaacaagcaaacaacattaaagacatcgttaaatacgagactggcgttactgttgttgaagctgggcgttttggtcaaagcggttttgcgattagaggggtagatgaaaatcgtgttgcaattacggttgatggcgttgctcaagcagaacattatcttcccaaggttttaaagacctgtttgaaggatatggtaattttaataacacgcgtaatggaattgaaattgaaactttatctgatgccaaaattaccaaaggtgcagattctctcatgtctggtagtggtgcattgggtggctccgtcatctataaaactaaagatgcaagagatcttctgcttaacaaaaactacgcgtttaaatataaaactggttttaccagcgagaatgatgaaagattaaattctattacttttgcaggaaaagcaagtatattcgatgtacttgctgtcggcacttggcgtaatggtcatgaaatcaaaaattatgattacaaatctgcagacgacattctaggaaaactcagagaaaagaccgatccttataataaaaaagaccgcagtcttttattgaaaattggtacaaatcttggtgaaaataatcgcattgccgtagcctatgatagaagacgggttgaaaataaaggtctagacaaatcttactcattacatggatgcacgaaatatgtttgtgatgataatgaaatagatactcgccatactcatgatgaaagcattagaaccagtaaatctatagcatttgaaaatacaaatataaacccactttgggataccctaaaactctcttatacagatcaaagtattactcaacgagcaagaagtgacgaacattgtgatggtgaacggtgtcctggggtacaaaaccccataggactacattataacaacgataataaacttgttgataaaaataataatcctgtaacctataaattagaaaatcgttctgtaacatactattcttacattgatgaatctatctttaatcgatacagtaactttaaagaagaagttcctgtagaactcgctaaggaatggaaacttaaagaatatggtggaaaatattatattgactcgcctcgctgctttaaaaatcacggtgatgctaatcacgaggggatgtgtagactaagatctgatgtaaaagaggaaaaggaaacattagtagctaataacatcacttatgatttaaaaaaggagtattttattaactcaaggctcacgaatagtgataatttattatcttgtgatggaattaactgtgataaaggtacaattcaaggtttcgaagctgatggaacgcctaaggatttaccaataaaaataatcccaaaagaaggtaaaaaatttgcacttattgaaaaaatttcagatcaaaatggctacaatattggcccagagaaagcatctcgttttctagtacctaattcacctggttataatagaaacatttggaaaaaacgtgaccttgatactcgtactcaacaaattaatttggatttaacaaaacattttgaactaggaaaaagccaacatgatttatcttatggtttagtttggagtaaaacaacaaaatcaatgataaataaagaagggttaaaagttaatagtggaaaatggtggattgattatccaaaagactgtgaatctagtacatcagatttatgtacaaaaaatagtacagcatcatttcttattcctgtagaaacaaaagatggttctctctattttaaagatgaatttagagtaaatgatcgtcttggcttagatatcggttatcgatatgacaaagtcaaatacaaaaccaattatcaaccgggtataacgccaaaaatccctgatgatatgttagttaatttatttataaaagaaccttttgtaaaaaacacacggagtctaaaccctaatgatccaaatgaaattaatcgacgaaaaaatgcagaagctaatattaattatatttctcaacccaaaaaatttaatgcgagttcttatgctttaagcacaaaattcgatccattggattggttacaagttcaagcaaaatatagcaaaggtttcagagcaccaacagctgatgaattatacttcacattcaagcacccagaatttactgttcttccaggctctaaattaaaacctgaaattgcaaaaactaaggaattatcattaactttacatgatgatgaaatcggttttatttctggtggatatttcatcacaaattataataattttattgattttagttatctaggaacaaaatcatttggttctcaagcaactaagcatgaattatatcaatctgttaatttagataatgctaaagtgacaggatttgaattgaaaaccaaatttacattaggaaaatggatatcatggttgaagaatgttgattttggttaccaattaactaaacaaaaaggtaaagcaagcgataaccgcccacttaatgctattcagccaatgacacaagtgatgagtttagcctatacgcatcctgataatctgtttggggcaaatttatatcttactcatgtttcccaaaaagaagcgagtgacacatataacatttattcaaaagatgctacagcaggagataaagaatatgttcaaaataaacatattaaatggcgtagtaaagcttacacagtgacagattttactttcttcgtgaaacctatgaagaatttaactttacgagcgggtgtttacaatttatttgacaaaaaatatagacttgggatggggatnctatagagtncgacctggcaggcatgcatagtctggc

SEQ ID NO: 412 - DNA, 2035 bp, H. influenzae
atgtttgcttatatcggcctcggtatcccgcttttaatctctctcgaaattttgtcatttttgtactcccatattttaaccagtttggatctacacctaacgcattggcaatctcaagaatatttcttggtttttgagtttcacctttcacgatattactgatcgcaccttgggtagttcccaccatttccgccaattctgcttgtgtaacattcctttcaatcagcaaaaatttcaatcgctcgcccaatgttgtcatatttactccctttccctttctattttattttatagatatttctatagataaaaaaatagatttacctatttataaatagtttattttcctttagaatagtaaaaactttatttacttaataggaaagactattttgatcaataaaacaattaaaattgcgattgatgaatgtggtggtcaagccaaattagcaaagctgtgcagtgtcgcacagcctacggtttttgcttggcttcaccgtggtggtattagtggcaaatacatcccgcttatcgccaaagcatccaatggaaaagtcaccgaaaccgacatcttgcgctcactcacaaagtcacaatagcgcaacgaatagtaaaaatcttcaagaaaaaggaaaggttttaatgaacagtaaagacattcagcgcacgttacatcgcgattgtaaaaacgcatctggcggtatcactacgctggcactcacgctaggcaaatcgccgaatattttaggcaataaacttaacgtagaatgcgaaaacaatcatctcagctttatcgaagccctcgatctcatcgaaatcaccaatagcacgcgcaccgtcgccgccattgccgacaaaatcgatcatcttatcgtacctatgcccaaatgcgccagttgctgcgccgatgtcgtgcaaggctttttagacattaccaccaatgcagggaaaattggcgaacaaatcaaaagcgcagtccatcctaattcagatttagggcgcgagttatccaacaaagaaaaacaaacgatttccgccagcattgacgcgctcattgaaagcgcattgtgcttaaagtgggaattagagcaataaaaaaaccacggcgggaaccgtggctaatcattaaggaatgtatttatggagaatactaatccaaacgaaaaaataagtcaatcgcaatgtgaccgtattttgcgttatttgcaatcaggtaagcgactgacatcactcgaagctttagacaaattcggttgcttgcgtctttcggcgcgaattttagatttaaaaaaccgctggcatcagatttcggacgagttcgtccacgatgcacgcacaggcaaagtatataaagcgtattttatggcggtatgagatgagtgttgagttaatgactaaagcatttaaaagcaaaaccggcaatcctttaacaaaattagtgctggtaaaattagccgataatgcgaatgatgatggcgtttgttatccaagttataaacgtattgcaatccaatgtgaagtttcgcgccctacggcaatttcgcacgttaagaaattggaagcgatgaaatatttatccattcgtgaacgtaaaaccgaaaacggcaacgccactaatgtgtatatcttgcatcccgaaaactgggaaatattagagccttttactagtaaagcagctttaccacccctagtaaacgagcttaaccaccctagtaaagcagctttaccacccctagtaaacgagcttaaccctgaaccatcaatagaaccatcagataaccatcatattaaaaaaactacgcaaaaaagcgaatccgaaatgttgcttgagcagttcggtattaccggacaactggcgaaagattttatcgcacaccgcaaagccaaaaagggcgtaattaaccaaacgcaactcaaccgcctgcaaaaacaagcggacaaggcggggatttcgatttgtgaagcggtggagatttgcattgaacgcaactggcagggatttaacgcatcatgggattggcgtgatgaaaaactg

SEQ ID NO: 413 - DNA, 2996 bp, H. influenzae
  misc_feature (2907)..(2907): n is a, c, g, or t
  misc_feature (2909)..(2909): n is a, c, g, or t
  misc_feature (2918)..(2918): n is a, c, g, or t
  misc_feature (2926)..(2926): n is a, c, g, or t
  misc_feature (2975)..(2975): n is a, c, g, or t
ctgccaccacagaacctttatcacgcaataattgcggatattggtctgcatgttgaatgtcaaattctttctcgcctaagaagcggtgaccgcgaatggtgcgagcacttgccacacctaaaatttcgccttcgattaactcatcacctaacaacatagtcacagtgtgaactgggcggataaattgcacggttttatctgcccaacgcattggttttggaattggcaatttcgctaacgcatttgccacaatatcgttaagtaagtttttggtcggctgacctttaatttttgtacggtgaacgagccattcgcctttatcagttgcaatgcgttctgcttgctcaacagtaatgccacaaccacgcgcccagccttctgccgctttagttggtttaccttccgcatcaaaggcggctgatactgcaggccctcgtttttcgatttctttgctcggttgttgggttgctaagttcaacacttttacggctaaacgacgcggtgccgcaaaccattcgattttatcgaatgataaacctgcttgattcaattccgcctcaacgttatccgcaaaagaggtcgctaatgttttgagagcttttggtggcagctcttctgtgccgatttctacaaggaagttttgggttgtcattttgttttctctggtaaggtgcaacttgctgcattgattacttatttacattttatctatcacatcattaatattttcaataatatattcatgattttctaaaatccaaagaagagatttaattcttgtctgattatcatacttattagttgtgaatttaccataaaagttaccttcattatcaacaatcactggcccacttgtagaatacttattccaaggactttcactgttatacttagagccataagttccgtatttattccaaatactatcgctattatatttagagccgaattcaccatatttattccaaattgatgagttatcatgtttactacagttcaaacagcctaaaaatttatcatgattatctccaccaaaaagcaaatatgctggtgctgcaaaggtatttattgataaaaataataatgggggtaacaaaaatttctgtaatgtcatagcattttccttagattaatataattgattcaatgtggagtgagaattttaatagctcacacacgatttaattgttttcttcgtttaacttctgccacaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataggcttccgccacgcctttggttaaggcacgaatgcgtaaaatatagcgctggcgttcggtgaccgaaattgctttacgcgcatctaataagttaaagctgtgtgctgctttcaaaatacgttcataagctggcaatggtaacggtttttctaaggctaataactcttgtgcttctttttcgtattgatcgaagcagtagaataagaaatcggtgtttgcgtgttcaaagttataggttgattgctcaacttcattttgatggaaaacatcgccataagtggttttgcctaatggaccgtcagaccaaactaagtcatacacagaatctacgccttgaatgtacatcgctaaacgctctaaaccgtaagtcacttcacctgttacgggtttacattctaagccacccacttgttggaaataggtaaactgggttacttccataccgtttagccatacttcccaacccaagccccatgcacctaatgttgggttttcccagttatcttccacgaaacggatgtcgttttgtgttggatcgaaaccgagcatttcaagcgagcctaaataaagttcttgaatattatctggagaaggtttgatcactacttggaattgatagtagtgttgtaaacggtttggggttttcaccgtaacgaccgtccgttgggcggcgtgaaggttgaacataagccaatgccattggctctgggcctaatgcgcgcaatgcgggcattgggtgagaagtacctgcgcccacttccatatcaaaaggttgcaccatggggcagccttgcgttgccccacattcttgcagggctttaaaaatactttggaaagtctctacgttaaaatttcccttataaacccccgtttaaagggattaaaaaggttngnttttatctngacccccncccgcgttaccggtaaaatgccccccaaatcagccttccacaaatttancgcgtgttcccccccccctcg

SEQ ID NO: 414 - DNA, 4255 bp, H. influenzae
tggttccgaaaatcggactcggtacccttatcttccgttaacggccttttcctgtgatattacgtaaggttttggaaggcgatccgataaattctcaaacatggctaacaatcctgtttttcttaaaaaattgtgctgattataccgaaatttaggcgtttttcatcatttcaaatgaaaatggatttttgagtaggcaatttcatgaagaaagcataggagataaggaaaaagaatgattatttagccaatttcaggtattattctgcccactcttggctatttgagcagctatttgatttagcaaaatcaaataacaggtaaaaagtgcggtgaaaaatgaccgcactttttgttgattaacgaacaaaaggattttcccttggatagcattccccttagtactttatttattattcttattatctgtttagttttatcagcctatttttctggttctgaaactggactactctccctcaataaatatcgtcttcgttttctatctgaacaaggcaataaaggcgcgaaaaaagcggaaaaactgctagaaaagccagatactttgttaagttttattcttatttttaataaccttgtgaatatcagcgcatctgcaattgcaacagtaattggtatgcgtttatatggcgatgctggcgtggcgattgcaacgggtttgctcactttcgtaatgcttgtattttctgaaatattccccaaaacggtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtgtcagaagcaggcgaagcaacaccaaatgaacaacatccacaaatgttgctgtctattttggatatggagacagtcactgttgatgacattatggttccccgcaacgaaatcggcggtataaatattgatgatgattggcgagctattatgcgccagctcaatcatgctgcacataaccgcgtggtgctttacaaaggcagccttgatgaacaagtgcttggcattttgcgcgtgcgtgaagcattccgcttactgcttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaatcataaaaaactccgccaaattgaaccgcacttttgacttggatcataagtgcggttctttttttgcgcattttttagaaaagatttttataattctttctaggtatattttgatagagaagaaagatatggaacacgaatatcaacgggcggtgactcgcgtgtgcgtacaaacggcactgctcttgttacaacatggggcagaaagtaccgtggtggtgcaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgtacaaagaaaactggatcaattaaaccgcttaaatatacccgatggttagttgtattcatgattggcttatcttgtgcagcattcgcccatttatctggcggagactggataatttgtagcattacctttgtggcagccgccattgccatgtttgtgcgacaagaattttctaaacggcactataatccccttatcgtcttttccatcacctctttcgtcgcctctctgattctggcgtgagcttaaaatataacttaggtaacgatcctcaaattgctttagcgtctagtgtgttattacttgtgccagggtttcctctgattaattctttggcggatatattaaaaggttatgtgaatatgggattaggccgttggacgattgcgactgttctcacttttggcgcatgtcttggtattgtattcgctttaagcctattacatattacaacttgggggcattaaaatgttatcagacatcacaatatttatcttgaaattactcgatgatatgctatgtgctgcgattccagcggtgggctttgctttagtatttaatgtgccgcccaaagccttaaaatattgtgcaattttagccgcacttgggcatgttacacgcacattattactgcatattaatatgcctattgtatttgctacattctttgccacttgtgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattagctttaccaggcttattgttttatcgacaaaaacctgtggtgtaacactaaaaacagtgcaacaaaaaagccgacatttgtcggctttctactattcttgtgattttttcttgaggtattcataaagctcatctttaatccgtaatttttcttttttcaaataacgatttccattttgtaatcaattcattatttaatgtttggcgcgcttgattattcacataacgaatgtattccacaaaaagttgatcctcttctttacgatcaaaagaggatagaattaattgattaagattattttcttgagaaaacttaaaatgtgaggcaatttgctgaacagtttcattttcaactttagctctcgctttcacaaaatcagattgatttaaaaaagccactaattgagcggatgaagtaagaatttttgtaaattcatgatacgcagaatctgtcgccttacgctcaatttttaccatatcgtcggcatcagcatcaccactaactaaatggggcgtggattctaatacaaagtgcggtcaatttttctttatttttatacgttggcttttaaactggtttatttgaagaaagctcgttagaataagattgttttcatttcaacgaaaaaagtaaggaaattctatgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagtgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcatacatttgattttgaagtgaaagatcatatcactttgggtgaagaagcaaatggcttagattttgctgctggggctaaattagctggtgcgcgttttgccgtaatgaaaggtcaaatcgctaaaatgcaccgcgcattggcacaattcatgttagatcttcatactgaacaacacggctatttagaaacctatgtgccttattagggggtcccctagagtcgaccgcaggcagcaagtctggc

SEQ ID NO: 415 - DNA, 2912 bp, H. influenzae
  misc_feature (2906)..(2907): n is a, c, g, or t
acatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctagaattaaaagggcgactggcaataaccataacaacgccgtattccatttgaatggcggtttgtaattcacaaaatcaccaaatctagccgtcattttatcgataatttgctgattgcttttgccctcatccaccattttgtacacttcaagacgcaagtcataagcaattggagaattagattccaccaaattttggttttgacattgtgggcagcgtaaagattttgccaactctacggcacgagtacgatcatcttgattttggaattgataggtatccaccatttccgcttgagtaaacaaggaaaatgcgaataaaagtgcggttgcaaaaacaaatgttttttgaactcgagtaaaaatatctaataggcttttcatttattcttcaatgcttcaatttttggcaaaaataccgtttgccaagtttctttatccaataaaccagaatggcgataacgaatcacaccattttcatccacaagataagtttctggcgcaccatccacgcctaatttgagggcaagttctccctgactatcatcaatagttaagatgaacggattgcccattctcttaagtatttcaataccattttgcggattgtcgcgataatctacacccacaataggcaacgtttttgcaatctcaattaacaacggatgttcttctttgcaataaccacaccaactgccccacacatttaataaaaatggctgtttaggaaaatctttcgggcttacgatttgtgatggatcatgtaaattagcctgataaaactctggaacgggtttatcaattaaagccgacgcaatttttttcggatcttgatttaacccagcaattaataatacacacacgcctaaaagcacaaagagcggtgcaaaaaagagaagttttttgttcattatttttcctgttttctgcgtaatccgaagacgctaaaaagtgcgccaaaggccattaaaataccgcccgcccaaagccaacgaatcagtggtttataatgtaagcggaaagtaaattcccctttgccgagagaatcgcccatcacaatatataaatcgccccaaaaaccgccattaagccccacttcactcattgtcattgtacgaacatcgtaataacggcgttcggggataatttctgcataaggtttaccattttcagttacgtcaaaaaaggcgacttctgccgtaaagtttggtccgatttcattagaaaattggcgatagtgaaattcatattgtcccagcgtttgactttgttgcggtgctaaacgcacaccaatttcactgccaaaataaccactcattaccgcaccaatagttacaatcgccacgccacaatgcgctaaaatcataccaaattgagacaaacgaatttgtcgccaattttgccataaagtgaccaacaaaagccaaatcgcaagagttaataacacaaaagcgaaagcgtgaaaattcaacgcagaattatggcgtagctgttgccaaatcattaggcctgcaagaattaaagacggaataagcaaccacccacaacgtatcaataatgtgcgatcaaattgccccttacgtatgctaagcacaattaccattaggattaaaatcgccgtaataatggggaagaaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaggcgtgcacagaagtgagcgcgccagaacgaacaataaacgtgcctaatacgctaaaggcaaaagcaagcagagaaaaaagcgttgtccaataactaaatacgccttgtttttccgtcgccattaaactgtgtaataacgctaacccaagcaaccaaggcattaaagacgcattttctacgggatcccagaaccaccaaccgccccagccaagttcgtaatatgcccaccaagcaccaagcacaatgccaatggttaaaaacaaccaagaaaccaacacccatccacgcattgagcgggcaatttgtcgtgcagattggttataaatcaacgcactcaaactcattgcaaaatttaccgcaaagcccacatagccaacatataataaaggcggatggaaaattaatcccacatcttgcaacattggattgagatcgcgcccttctgcgggagcagggaaaatgcgtccaaatggattggaataaaataaaataaacaccgcaaaaccaaagcaaatcaatcccaataaagtaaaggggatnncttta

SEQ ID NO: 416 - DNA, 3833 bp, H. influenzae
tgaagggtgggggcgagaaaaacgagaactcgtgagagacggcgatacagaagaagcggagaaagagcgggaagaagaaagagaatgcggcagggagggaaggaagaaggcgggaaggaaaggaggggaggaaggaggaaaaaaagggggcggaaaaaaagaaaaaaggggaggggaggaagaaggaggaggggaagaaaaagggagaggaaggaggggggaaaaaaaaaaacgcgagaaaggaaccaggagaacaagaacggagagaaaaaacagggggtaaagaaggcgggaaaggagggaaaaaaggataaacggggaacggaagggatgaggggaagaggggggagaataatgggacggaggaagtgggggagggttctccaaaggcaaaattgcgtacaatagcgtaaccaaggggctgagagtacgttaccagcaaaacaatcgcctttttcagcaagcattgcttgagcaaaataaattaatccatatcccgttgcttccggacgaattaaactaccaccgaaagaaagaccgcgaccagtgaaaacacaggctgattggtttgataattttttcatatagccagctaaatagccaacttcgcgcccaccaacacctatatcgcctgcgggaacatctgtatcagctcctacgtgacgataaagttcagccattaatgcttggcaaaaacgcataacttcagcatcagatttgcctttaggatcaaaatctgaaccgccttttgctccgcccataggcaatgttgttaaagcatttttaaagatttgctcaaaacctaagaattttaagatagataaatttactgatggatggaaacgcattccccctttaaatgggcctatggcactattaaattgtacacgaaatgctctgtttacttgcacttgccctttatcgtcagtccacgccacacggaattgaaatgcacgttcaggctcaactaaacgttctaataatgcttctgaacgatatttaggattggcttctaaaaaaggccaaattgatgtgaatacctcgcgaaccgcttgtaaaaattcaggttgataaccatcgcgttgagcaacttttgttaaaaatgcgtctaaggaagcaacttttgacataatgaatttccctctttgttgatgttgtgtgtattgtattttttattgtatacgcctcgtgaagcgcatagacaatatgcaatggctaatttaatcttgcaaccatttttataaaggaaatttaaagaaaaggaaaaagtaaagaaattatctaaaaaatatcgtatttattagataaaaaataaaaaacgacagaaaaccatcaggtaatgatattttcaataaaaatatagagcagactacaaatcatatttctagtaaatcactacgaaaatatgttttatgaaaaaacaaaattagggttatatcaatataataaaaacgggggcaaagctcccatactattaacaattaagttcatcattgtgttttttctgattcatcattatttttaaccgcactttcgtcgtcttttggttgataaaatcgagcgaccaatagaccgagctcaaacagcaagcacatcggtatggcaagcaaagtttgtgaaaaaacatcaggaggcgttaaaagcattccaataaaaaatgctgcaacaataatataagggcgtttttcggaaagagcctttacagtggtaataccagtccagcaaagtagaataatcgcaattggcacttcaaaacaaacgccaaaagctaaaaataacgctaaagcaaaatctaaataactactaatatctgttgcgatggtaacgccttctggggctgtttgtgtaaagaagctgaatacaagaggaaagacgacatagtaagcaaaagcaacacccgcataaaataaaatcgtactggaaaatacaacggataaatcatccgtttttcgtgctgatataaagcaggtgcaataaaagcccaaatttgataaagcaaataagggacagaaataaaaattgcaacaatcgcagttaatttaattggcgtaaagaaaggagtttgaatattggttgcaatcattgttgcgccttttggcataacagccgttaaaggtgcagcaacaaaatgataaatatcattggaaaaatacaccaaagcaacaaaaaccaacactacacaaatcacacagcgtaataaacggtttcttagttcaacaaggtgcgtaattaaaggttgagattcatccacattactcataaaaactcgctatgatttagtttttgaagattgagattttgacgctggagcgatttcaatatcatcaggaggataatagctagataaatgtgtgttcagttctactttctcgtgagtttcaagtgcggtcaaatctgtaggtgttttttctgcttcagataaagtttctgcagcctcctcaactgagattgcattttgaggtttttctgcattttcagccgcatttttgatttctttgatttgatcttccaccgttgtaccagcttgagctgctttatcttctagctccgctttcatcttatctgcttgagcttttaattcttcccaccgttttactcaattctggtgaaagggcttgcaagttaagggattccgcttttttaatactatcttgtaattcttgcaattttagctcttgtttcaactcattttgaacgttagcagctaaaccacgaattgtttttacccaatccattacagtgcgaattgctataggcaaacgtttcgggcctaatacaaccaatcccaaaaccattagtaaaataagttctgaaaaaccaatatcaaacacggattaagcctgctctttctcttttatattttctttttttgcagacgctgtttcattatctatagacttaaattccgcatcttttactttttcatcttctttcatcgcctttttgaaacctttcactgctgcaccaagatctgagccagcatttcttaattttttcgtgccaaaaatcaataaaataacgactaataaaataatcagttgagcgggggataaaccaaacataataaactccgttctgtaaaaaagaaaaaatttggctcggaatatactctttttagccatttagaacaatagctataggagattatttttatgttatcctgatcttgatcacaaaacctgatttttaacttattgatgtaataaaaaagttaaaatttatctatctctaaaaattgtatttttcttctaattctgtgatgtgagcacttttatccttttagctcgtttcaggaatttgcggtaaattcacagcttttaccgagcctagtgctttcgctttttggtaaaacgctaatttgtattcaagcaaatctaaataacgttttaattcggcaatttgacactttacattttttgtttgattttcaaataaggaaaggcgttcttcaatagtatcgtcgccaatgatggtacattctgcaaagcgtttgatgtcttttaagctcattcctgtatttttcaagcattgtaataaactcaaccattgcaaatccttgtcggtaaaacggcgattaccgtattcatcacgtccgacattaggtaacaagccttctttgtcataaaagcgtaaggtgtaggcggaaatgcctattttttcagcagctttagcggtggtgtaagtcactttttattccctttaaacaaaaatggtaaaaaaacacttgctttagagtgaactctaaagtgtaaactgttgctatcttgcttacgtaaggcaactttgtcaatggattaagaggaaaaacaatggaaattaaacaaatcaactca

SEQ ID NO: 417 - DNA, 4463 bp, H. influenzae
  misc_feature (4164)..(4164): n is a, c, g, or t
  misc_feature (4169)..(4169): n is a, c, g, or t
  misc_feature (4196)..(4196): n is a, c, g, or t
  misc_feature (4213)..(4213): n is a, c, g, or t
  misc_feature (4216)..(4216): n is a, c, g, or t
  misc_feature (4225)..(4225): n is a, c, g, or t
  misc_feature (4247)..(4247): n is a, c, g, or t
  misc_feature (4252)..(4252): n is a, c, g, or t
  misc_feature (4292)..(4292): n is a, c, g, or t
  misc_feature (4354)..(4355): n is a, c, g, or t
  misc_feature (4362)..(4362): n is a, c, g, or t
  misc_feature (4381)..(4381): n is a, c, g, or t
  misc_feature (4427)..(4429): n is a, c, g, or t
  misc_feature (4436)..(4436): n is a, c, g, or t
ctttatacgaatcggactcggtaccctgttctctttccaaccccttgtgttttcagaaagatatcatcgcggtaacgttccccgatttaattttcttcattaaagcattcgtaaccaccgcaattcctttagccttgcctttttttatagcttcggcaaattctgcattatcttttttacgattttgaagcgttctctctgaaatacctaagctatctgcaatttgttgattagtaagcccctgagcggcaagactttcaaccattgataaatctatctcaatcttaggttttgtttttttcttactcatagctggacattcttacacattaaagtacagttgctaataatcactaaggagataaatatgatgaagaaaattgatgtattaaaagatttgatggctaaaaatgaatggaaaaaagcaatctcactagcaagtaaatttcctagattgggaaatgctaaagatgcaattaaatcagcgcaaatggcttacacaaaccctaattttgtccgccagataaaaaaagaccccgataagttaatttatcagggcatccaagcattgattgccaaatacggttaattgtcttcattcgggatgtacacgtctacatctccacaatattcagcagcaattttaggatttcctttcacaaagaccaagacattctgatgcacctttcctatcttgcggctacctttaaaaggcgtagccgcacgcataggcatagtcccacatacattaactaaaatcatttcattatagtagcttaaaccggcttctaagaaagcctgaatagtatctcctacgaaattatagtaattcccttttttatccctaacttcaccgacaacaaaacaagcaaagcgattatctttcaacatatcacaagattttttgataatttcaaaatacgcttttttaaaattatcataatccatattagataaatcattagggttattagaataaacttctagatcggcataagggggcaactaaagactaaatcggcggagacaccattagctaatttatcaatatttatgctatcgccacaaatccatataggctgcaactcatcattagaacaaaccaagtttcgttgcttcaaattagcttcaatttgctcggctctaagatcaacaccgatataatttctatttaatttactagccacaataccgcgaacactaccacctgcaaacggatctaaaatttgacagcctttagggctaaaccaagaatacagtatttcacaaagcacaggatcaaatattgaatcatcgctttcagacattgaagtatcttctttcgagttataccttgccatactgttcataccgcgctgcataccgctatcgcgacctgaaccgctatcaatacccaaggctttccattttctttttctatcctgccaccaaccttctctagaatttaaaattgagaaagggggggctaaaaacgcctgtttaagatcaagtttttccttagaattggaatcaccgcttatatcagccaataaatcaccatctaaactttttaaaaaatcatcatcaaagccaagcaaatcaatatcaaaaccgagatcttttaattcatttaattctaaacttaatagctcaaaattccagccggcattcaacgccagtgagttatcagcaatcacgtaggcttttttctgaatatcggataagcccgttaatctaatcgtcggcacagtatataagttcagttttattgcggctaataatctaccgtgacccgctataattccattattctcgccaatcaaaattggatttgtaaaaccgaactcttcaatgctttcacaaatctgatcgatttgttcatcagaatgagtgcgactattattgacataaggctttagaacatccgtagaaatatattcaatatttaaatctttattcatcatttatctttctaattttccgccgcactttcccgcgccttcacatactcccgcaccccgtccaccttattcgcacataaccgcaattcttgcttgagcaataacgcatattccaccgtctccccaaaggttgaaccgtggaatgatggaatagggcagggggcaagcaaactcaccggcggcgaaaaggcaagcgtgcggtattcaatttctggcttacttgcgcaactcgtcagcaacaccgttaggcagtacagtacggctgcactgattactttccagtattttcttaatggattgaatttgcgcataactttgctccctgattaactgctcttgcgctaaccgcttttcggcaatctttctttgctcgtccacatcttcgtgtaattcatcaataatcttatcccgcttaatgactttttcatgcagagaatcaataacagctgattggcgttcaatattgagcttatttgtgtgctgcatataaagcaacgcaagaataaacactcctgcaaatacagcgacaactttattgaaatgcttgcaaccatgactaaacacgttaagcccaagtttttttataacaaatagccaccacgtcatggatatacactccgtaataactcaaaatgcggtccatcataaaaacgctcatcattagaactctcattcatattccaatcaccgccccagcgaatagcaacgcccaattgtttagcagcttgaaacatagcactggcaacattcttaaatggctcgcgatcattccaattcactggtaacggcactaaatccaccgcatgaccagttaaatggcgactattcattgtctttgtcgctttcttggcaaacaattctttttgtcgctctaacgtgcgtttaccctcaataactttaaaatccaccacacttaattcaattgcacggtgcaccactttcactaaatccgcgtgaacgcctactagtttttcttcactagcagcagatagcttaaatttgctcatctttaatccccaatttagacgcaaagaacccccgccaaatggcattaagcaccgcgccaccaccataaccagaaagccctgagcctacataaactaaatcgctatcaagaccggaagaaagacaaatcaatcccccaatccaccccgcaaacatagacacaagcacttggcataaaaaaagccccacgctaaagtggagctttcccgcttgaatatcgcttgcgtattttgcaacgccggcaaataatccgataaaaaccaatgggagccagcgtaaaaaagattccaagttagtcggatctttagtcggcataataaaacctattttacagatacagaaaagccccaagcatttctgctcagggctgtaaatattttttgtgcgttctcaacgtgctaaaaccgcactataaataaaataatacacctaatagctagccatttcaaggattttttgaaacttttttaggggaactcaaaaaatttaggggaaatttccccttttcttataaatcctctgcaacaatagaaaattttcgcacgcaacgacccagtacgtttaaacgtgacaaatcatcaatttcaaagctcgatcccacgcgctcattctccgccaccgcatttaatacaccgctcggtgtttgatataaacgacgcacatacaactcattattcattacaaacaaataaatcccttcgccagcatattgtttacaagtcgtatccacaaacatcaaatcttttttattaattaccggcgacatactctcattaaacatcgttatcatcgccacgttcgccgtagagcgtaatttcaataaatccatcatcccatcttgcgaaaggtgcaaagcttcaaaagggcgagggaaatgcacattaattatatctgtctcagctaaacgatttacatctaaggcaaaaacccattcttccgttggcttcgtttttaatgaaatctgctgcttatgcaacatctcgcgtaattcatcacttccactgtcaaaaaaattattgacggtctgcccctgattgttattgatctgagaattttccaaagtggaatgactaacggtcatatcgccatacaacaaataatccggcgttgtaccgagctcttttgctatttcaacaattttgcgtggatttctggtttctccggcaaggattttctgcatagagggttgagcaatgccgatcatattagcaattcgggnttggnttattcctttttctaccagcaacgctnttaatctctctgataanttntgcattttntgtactcccatatttaaccagnttggnatctacacctaacgcattggcatctcagatatttcttggnttttttgagttcactttcacgatatactgatcgacctggggtagttccaccattttcgcatnnctgctgngtacattctttcatagcanaattcatcgtcgcccatggtgctattactccttccttctatttatnnnaagaatncatagaaaaaaagattactttataaaa

SEQ ID NO: 418 - DNA, 3068 bp, H. influenzae
  misc_feature (3040)..(3040): n is a, c, g, or t
tgtttacgattcggactcgtacccagcgtgatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaggggtctcntagagcagaccgcaggcagcaagctggc

SEQ ID NO: 419 - DNA, 2244 bp, H. influenzae
gccagacttggctggcctggcaggtcgaattcttaaaggatccccttttccccagcactataacagtgatgactttttatagatatttttaaagtatgaaaagcgcggtaaaaattttatgcaggaacgcgttctgttacgagcatttgtagttttcgtaaaataacatttaatactacgccataggctggtacgaataatataatgccgacaaatagcttaaataggtaatctacaaaaccgagttgtgcccagtgttcagccatgaacggatctgcactttgatagaaggctacactgaagaaaacgaatgtatccgccattgagccaaatgtcattgagctagttggcgccacccaccaagtttttaactggcgtaagcggttaaatacgatcacatcaagcaattgtcctaccacgtaagcggcaaagctcgcaatagcaatacggaatacaaacagatcaaaatgcgttaatgattcgaaaccttggaatttgctttcagagaataaaacagatatgacgtaacttacaataagtgcaggaaacatcaccacgaagatgatttttctcgcatcttccgcaccgaaaatgcgtacggttaaatcggtagctaaaaagataaatgggaatgtgagcgttccccaagtgctgtggaaagaaaaatcgtttgctgcaccaagtgcggttaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggctgaatatagggagctagatgatacgcatatttctaataattgcaagagtcgattgcatttgagttttatattttatgaaaattgacgaatgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctccttagtaaattgagcataaaataaccgcactttagttgtatcccaaaagtgcggttaattttttctaaattttagcgtttagctttatttattaatgcgtgctagtacttgttgttgtacgatttgcacgtttacgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtaggggctaaagcttgagtaaagtaagcctgtaccagaagtcattgtcataaagttctccacgaaggccatccatccacgactaggggaat

SEQ ID NO: 420 - DNA, 3014 bp, H. influenzae
gagaccccgattgaaatactcgaaaacgaccgcactttatttgattggtgcagtaaacaaacttatatcgcccttgcaaatatgcttactggagcctcagcccttggcatcgattcttgcccaattgaaggttttcattacgacaaaatgaatgaatgcctcgccgaagaaggattattcgatcctcaagaatatgcggtttctgtcgccgcaacctttggctaccgctcacgcgatattgcgaaaaaatcccgtaaagggttggatgaagtggtgagatgggtggggtaaaaatcccattaaaaaagggctgcaaatgcagccctatcttttttgattatttcacttctttaaataaaatctcgcttgggattacggaaccttgccagtaaagttctgtagagactttttctgcaagttgtaagaacgcttgtgaaatttcattttcaggcactcgcacaacggtcgggttgcctgcatctaaatcttcacggatacgaatatgcagaggaagttgagctaatactttcacattgtatttttccgccattttctctgcaccgcctgtgccaaaaatcgcttcgtggtgaccgcacttactacaaatatgcatcgacatattttccacaatgcctaacactggtacggatactcgctcaaacattgaaataccttttactgcgtcaagcagagcaatatcttgtggagttgtcacaaccactgcgccagtcacaggaatttgttgtgataaggtaagttgaatatcgccagtgccaggaggcatatcgataacaagataatctaaactatcccatagggtttcatttaataattggcttaatgcactactcgccattgggccgcgccaaattgttgcactatcttcattcattaaaaagccaatggaatttgcagataaaccatgtgctttaattggggtgatgtgttgattatctggcgaagttggacgttgattcgctgcgcctaacatgtgtggaatagaagggccataaatatccgcatctaaaattccaacacgtgcgccttgtgcttgtaatgctaaagctagattaacagaaaccgatgatttccctacgccgcctttaccagaactcacagcaataatatttttcacaccttttactgccggttgattatttgcacgtttaagtgtggcgatttgataagccaccgcccatttaattgatttacaatctgttgctttcaataacgcatctgaaaccgcttgttttaactgttctgcaccagaattccacgcaaaaggcaatttcaattcaatgcgtaacgtatcgccgcccttttccacttttttcaaagtattaagcacaatcagatccttttgcagagttggatgctgaaattgttgaataatctgctgaacttgattttgctggtcggcagtcaaattatcagaaaagtaggttgccataataacttcctgtttagtagagtaaatttgtcggacatatttaatcacggaaagtgcggtatgttaagttaaagtttttcaaactagaaaaaatcccctatttaaagtaagataagcacaatttttgtatgctaaaaaagagaataataaatgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgctaaagcaaaagccgatcacattcgtgattttgcaggtttcaatattagttttgataactatcattccactcacagcgaagaaaacaaacagctcactgcagaaatttacaataaactcaaagccaatggctttattaagagtaaagttatttctcagttattcgaccctgaaaaaaatatgttcttgcccgatcgttttgtgaaaggcacttgcccgaaatgtaaagcagaagatcaatatggcgataactgcgaagtttgtgcttctacttacagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgcgaacaaaatgcaagaatggtttgagagcggtttacaacaatgggatatttcacgtgatgcaccttatttcggttttgaaattcccggcgcaaaagataaattcttctatgtttggttagatgcgccaatcggctatatggcttcattcaaaaatctatgtgagcgtgaaggcattgatttcaacgaattttgggctgaaggcagtgatgcggagctttatcatttcatcggtaaagatatcgtttatttccacagtctattctggcctgcaatgcttgaaggcagcggctatcgtaaaccgactaatgtgttcgctcatggctatgtaacggtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtaaatacagatatcgtaaacaaattagtgaatttagcttcacgcaatgcaggttttattgcgaaacgctttgaaggcaaactttcggataaactggaagacgaagcattatttgcagaatttaccgctcaagccgagcaaatcgctgcttattacgaaagccgtgaatacaataaagccattcgtgaaattatggcattaacggataaagccaataaatacattgatgaaaaagcccctgggtgattgcaaaagaagaaggcaaagaggcagaatt

SEQ ID NO: 421 - DNA, 3120 bp, H. influenzae
ccagcaccagggtttggctggatcatgccggtaatgttacgccccgcaggccccagcaataattactttatagccatttttttgtgcattttcagcaaattcaaaaagtttatcaggcgtacgatgagcagagacgatttccacatgataaggtacttctaattcatctaaaatctgagttgcctcttgcatggtagcccaatcgcttttggaacccatcacaacagcaatttgtgcagtttttgacatgctattttctcaattttctaattaaaaaggtggcgtagaatagcatagattacatatattgagcaaacgtttgctatttatgtaagtattaatggggattattttataattatttgatttttaaattttagtaactatacttgataccaaattaatgggcgatagtttatatgggacgaactgaaaaattattagataagctcgcacaatcaaaatctacatttaattggaatgaattagtttctttgttagctcaacaaggttatgaaaagcgagaaatggcaggctctcgagtgagattttataatagaacactcgaacatacgattttgttacacaagcctcaccctgaaaattatattaaaggtggtgctttaaagtcagtgaaagaatcattaaaacaggtaggtattctatgaagttattaaattataaaggttatgttggcacgattgaggcggatttagaaaacaatatattgtttggcaaacttgcttacattcgtgatttagtgacttacgaagcagagtcattatctgagctagaaaaagaatttcgtcaatctgttgatttatatttacaagattgtttggaattaggtaaagaaccgaataagccttttaaaggtgtatttaatgtacgaattggcgaggaattgcatagagaagctacgatcatagcaggcgatcgttctcttaatgcttttgttacggaagcgattcaagaaaaaatttttcgtgaaaaaccaagtttaagataacaaaacgtatttacattttctttcatcaaaagtaggtcaaattatgttagccaaagcaaaatatagaaaagattacaaacaaccagattttacggtcacagacatttatttagattttcaacttgatcctaaacatactgtggtaaccgcaagcacaaaattccaacgcttaaatgatgaagcgacttctttacgtttagacgggcatagcttccagttttcttctattaaatttaatggcgagccattttctgcttatcaacaagatggcgagagtttaacgctcgatttgaaaggcaaaagtgcggaagaatttgaacttgaaattgtgactttccttgtgccagctgaaaatacttcattacaaggattgtatcagtctggcgagggtatttgtacgcaatgtgaggcggaaggtttccgtcaaatcacttatatgcttgaccgtccagatgtattggcgtgctatacaaccaaaattacggcggacaaaagcaaatatccattcttactttctaatggcaatcgcattgcaagtggcgaattagaagatggtcgtcattgggtggaatggaatgacccattcccaaaaccaagctatttatttgctttagtggcaggggattttgatttattacaagataaatttattactaaaagtggccgtgaagttgcgttagagctttatgtggatcgcggtaatcttaaccgtgcaacttgggcaatggaaagtttgaaaaaagcgatgaaatgggatgaagatcgctttaatttagaatacgacttagatatttatatgatcgtcgctgtcgattttttcaatatgggtgcaatggaaaacaaagggttgaatatttttaattctaaatttgtattagccaatccacaaacggcaacagatgaggattatcttgctattgaaagtgtgattgcacacgaatatttccataactggacaggcaatcgtgtgacttgccgtgattggttccaattaagtttgaaagaaggcttaacggttttccgtgatcaagaattttcttcagatacaggttcgcgtgcagtgaatcgcattaataatgtgaaatttttacgcactgtgcaatttgccgaagatgcaagcccaatgtcacacccaattcgccctgaaaaagtgattgaaatgaataatttttataccgtaaccgtatatgaaaaaggggcagaagtgattcgtatgttgcataccttattaggtgaacaaggcttccaaaaagggatgcagctttatattgctgaaaatgatggcaaagcggcaacctgtgaagattttgtttctgcgatggaacgtgcaaataacctcgatttaaaccagttccgccgttggtatagccaatcgggtacaccagaattattgattagcgatgcttatgacgaaaaaacgcatacttatcgtttaacggtttcacaatccacaccgccaaccgcagatcaaatggaaaaagtgaatttacatattccattaaaaatcgcgctttatgatgcgaatggcacgaaacaaatgttacaacataatggcgaattgttgagtgatgtattaaatgtcactgaaaaagaccaagtctttgaatttcacggcatttatggtcgcccaattccagcattattatgtgatttttctgcgccagtaaaactggattatgattataaaacggaacagttattaggcttgctgaaatttgcagacaatcaatttatccgttgggatgcagcacaaatgctatttgcgcaagaattacgtcgtaatgttgtgcgtttccaacaaggcgaggcactagaaatttcgcctgaattttgaccgcactttcttatgttcttgataattacgagaaagatattgaactggcacattaattctcacactgccgaaagaatggatttgcggaggttcaaaatatcatcctgagggattttaggcgcaagagctttatgccagcccaattgggggatcgttaaagaatgatttttggggggtaatccctattcggttggtgatatataatcacgccaaagaattgcgcttgggggaagtggaatttttgtttattaattgggttttccaatttggggaaact

SEQ ID NO: 422 - DNA, 4004 bp, H. influenzae
ctttgttgggacggatgcgggagaattggcaggaattggtcatcttggcgttgcagtttcagacgatcttgaaagccaaaaagataaattcgatttattaatcgattttacccgaccagaaggctcccttgaacatattgcattttgcgtagcgaataataaaaaaatggtgatcggtacaacgggttttgatcaaaatggtaaagcagcgattaaagcagcttcagataaaattgctattgtgtttgcatcaaatttcagtgttggcgtgaatttagtcttcaagcttttagaaaaagcagcaaaagtgatgggggattattgcgatattgaagtgatcgaagctcatcaccgtcataaagttgatgcgccatctggcactgcactttctatgggcgaacatatcgcaaaaaccttaggtcgcgatttaaaaacgcacggagtcttctgccgtgaaggaattacaggcgaacgtaaacgggatgaaattggtttttcaactattcgcgcttcggatgtggtgggggaacacacggtttggttcgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataaatcaatttcaaggtcactttctacgtgacagcaacataataaaatctcatcaggttgaataaaggcaagaggcatttctttataagacaccttgccttttttgatcttaacgcgacaagaaccacaatagccactacggcattgatattcgtgatgaatattatttttctcgagatgatcaagtaaacttgtttcattattgaattctaatgtggtgttatggcggataaggtggattttcataataacgatatgttgtaatttgtcgtactattatataaggaaaagatgaaattattgataaaaacttcacttagtcagtggatttgcttgaattttgccaaaattcctatttttaaaatgctaggttttataaccgcactttttattacggcttgtagttctattagcaaagaaccagtgaagactgtggatatttatattaaaccttattattctgctgaaaatggaaaagcagaaaatgtatttgtacataaagaaattgatcctatgttacgtgaaaatacgctaaaaggttataaaagtacggtaaaatttttagaagaaaatccagctcgcatttcaccaatgacaatgtttaccttagccgctcgggcttacgattttggcttaagagatgaagcggttacttggttttatcgtggtcaaaatcgtttgatcaccgcactttatgtgttggatttaccaaaacaaacggtgcaggataatacagggttcagccatgttgtagggcagtttgttaatgcttatgcgttttgtgattttgataaacaaagtcgtgctgccgaaaatgcggtgaaatggacaattgcgcatccttatgaagtggttttcttaccagcattacccgcaaaatttgcagatcgtcaaaaagcgttaaaagaatcggaagaaaaattagttcaacgtttacaggaacaagcccgtttttttgctaatccaaaaaataaagaaaaatggcaaaaaaagcggtcagaaaattttgtgaatgaacgattttgttggtaacaagaaaaaatggaatagcgaatacgttattccatttttatttttgataagccaatgatttttcgcattattcttttactttttaaggacttggtattatcattactcggttttttattttatagagaaaagagaagcaggggaaactatgcaacatctgaacgagcttgttgagaaagcgaaattagcgattgaatccattcaggataaaagtttaacggctttggatgaaatccgtgtcgaatattttggtaagaaagggtattttacgcaattaatgcaagaattgcgtaacgtgtcagcagaagaacgtcctgcgatgggcgcaaaaattaacgaagcaaaacaagctgcgttagaatttttaaatgcaaaaaaaacggagtgggaacaggctgaacttaacgcaaaattagaaaaagaacgtgtagatgtcagtttaccaggtcgcaaagttgaaactggtggcttacacccagttaccatgacgattaatcgtgtaacaaaatttttctcagaacttggcttttcagttgaaaatggccctgaaattgaaagtgattattacaactttgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcaccgaattgaaaggtttattgcacgatttcttacgcgctttctttgaagaagatttacaagtgcgtttccgtccatcttatttcccattcacagagccttcagcggaagtggatgtgatgggtaaaaatggtaaatggttagaagtgttgggctgcggtatggtgcatccaaatgtgttgcgtaacgttggtattgatccgaatgaatattctggttttgccgtgggaatgggtgttgagcgtttaacaatgttacgttataacgtaacagatttacgttcgttctttgaaaacgacttacgtttcttaaaacaatttaagtaatttctcggatttgaattaaaaggataacaacaaaatgaaatttagtgaacagtgggtaagagaatgggtgaaccctgcggtgtccaccgagcaattatgcgagcaaattaccatgcttggcttagaagtagatggcgtggaaagcgttgcgggtacatttaatggtgtcgttgttggtgaagtagtggaatgtgcacaacatccagatgcagataaattacgtgtaactaaagtgaacgtaggcggtgatcgtttattggatatcgtgtgtggcgcagcaaattgtcgtcaaggcttaaaagtggcttgtgcaacagaaggtgcggtattacctggcgatttcaaaattaagaaaacgaaattacgtggtcagccatcagaagggatgctttgttcattttctgaattaggtattgatgttgaagcggatggtattattgaattgccacttgatgcaccaattggtactgatttacgtgaatatttagctttagatgataatgccatcgaaattagcttaacgccaaaccgtgcagattgtttgagcatcgcaggtattgcgcgtgaaattggtgtggtaaataaacaactcgtaaatcaaccgcactttgaagcagtgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgctgtggtattcgttctatcgatcctattgtcgatattactaactatattttgcttgagttcggtcagccaatgcacgcgtttgatgcagctaaagttacacaacctgttcaagttcgtttcgcgaaagagggggaagaattagtattattagatggctcaaccgcaaaacttcaatcaaatacgttattaattgctgaccaaaatgggcctttagcaatggcagggatctttggtggtgcaaccagtggcgtgaatagtgaaacgaaagatgtgattttagaatccgcatttttcgctccattagcgattgcaggccgtgcaagacaatatggtttacatactgatgcatcgcaccgttttgaacgtggtgtggattttgaattagcccg

SEQ ID NO: 423 - DNA, 3125 bp, H. influenzae
  misc_feature (2746)..(2746): n is a, c, g, or t
ggaagtaatatttcttgttctaagaaagttttatccatgatgaaataattcatgttttttagatttatttctgaaggttttctttgtttccctgataggtaataataggttgtccacaatactggtaaagaactattattccaaatatcttcatatctttgaattgaagcatcaaaccaaaatctaaaccagcagtgacgtttatttttatatgttcctttttggttaggacagtctgctaatgttaatagaatataaggaatttgatactcttcaagtttattgtattcccaaattttttgttgattagctaatataataaattcaataggttataagttttttgccgaaaaactaatttgacgataatatttttgccaattttttctgaatgaattttttaattcagtccatgcgttttatttggtgataatggaaaatatgattggtataaattgctttagtttaattttatggggcagaattcgctttttgggtaattagaaaaattgctattagaggatggcactgtattaacatttttctcaaataaaacttgagcacaaatagggcagtggcatttgggtgtagtatcttttaaacctaacggtttattaccaaattcaataatgtactccttgacagtgattaaaatttctttgcttggatggttttgctttttccatttttatcctatttgttatacactaaagaataaagcataacaggcttaaattttgatgaattatccacagtacaaataaggcgttattaaaataatttacattctactataggataataattattctgatgattggatgagttttctagataatcattctgataaaacaaaaggattacaggtaaaattacagacttgtgagtattttgggttagtatcaaaaaagtatataggtactggtagagataaatggtaatacacaatatattattttattgtggttttaaaattacgattttggtacttttagtataaagtaagggctatttttattatttacgagcaccaaatatcgcaatcaattctttcacttttacgcgtttttctgggttttggctaatagaacgttggacttttacccgtttaaatttagcaccgttataaatttcacgcgtaaatttagtatcgtgattcgagatcaatatcgaaatttgtttttctttttgtatagatttcgctaaatctgccaaagcacgttgctgcactagtccaaactcattccctgcataaccagtaaaattagtctcttgttgtagcggagcataaggtggatcacaataaatcaccgaatccttatcggcaaattcaaaagttttttgaaaatcacagcataaaaataccgcactttgcgctttatgagcgaaataacgtaattcatcttctggaaaataatgagttttgtaagctccaaaaggcacattaaattcattcttgctgttataacggcataatccgttaaacccaaaacggttcaaatataaaaaaataatcgaacgttcgaaaggatctgttgatgcattgaattggcgacgtttagcatagtaataatcgggtgtattggcatcatcagcgaagaaaatcggcttacaatcttcaatataaccctctacattttctttaacaatattgaatagattgattaaatcagggttgatatctgccaaaatatagcgttcaaaattagaattcagaaatatcgctccagcacccacaaatggctcaattaagcagttttttttgtttggaaaggctttatttatctcgtccgttaaacgaaattttccccccgcccattttaaaaatggacggtgttttaacttaggttttaaagattgttttttcggacgtaacatcttaatccgtttgagtacaacgacgaattgcgtttaacacgagggtatgatcggtatcattcgccacataagcttggcctagagatttgagtaacaccagacgcaatttacccgatagaacttttttatcacgcatcatatgcggtaaatagtcttctggctgcatcgtatccggtgatacggtgggcaaattggcacgagcaagtaatttttcaaggcgagacacatctgcaatagaaatatctccaagttcttccgaaagcaccgctgccatcatcattcccgtcgaaacagcttcaccatgaagccagtttccataacctaagtgagtttcaatggcatgtccaaaagtatgtccaagattaagcaatgcacgatcgcctttttctgtttcatctctcgcaacaacatctgctttaatttggcaacaacgagaaatacaatgttgaagcgcctcaggatgcaaagcgacaagttcatcaatatgttgctctagccattcaaaaaattcgtaatctaaaatggcaccatatttgataacttcggcaagccccgcgtttacttcacgtttaggaagcgtattaagcgtgagcgtatcaataataaccattgatggctgatagaacgcgccaatcatatttttgcctaattcatgattaaccgccgttttaccgcccactgaagaatccacttgtgaaagcaatgtggttggcatttgaattaaacgcacaccgcgctgataacttgccgccacaaagccagcaacatcgccaattacgccgccgcccaatgcaataatcgtggtatctcgcccatgattatcttgcaaaagtgcggtgaaaattaagtttaaagattcaagtgtttntgtatttttcgccatctggcaataaaacatgatcgactacgcaaccacgtttttccaacgcatagatgactgtatcaagataaaactgtgcaacccgtggggattcgttacaatcatcacgcgatccccacgtttaatcggggtaactacgttcatcttgtaacaatccgctaccaattaaataggatagcgacgctcttgcattccacattgacgcacacatatttatcttaagtgggttaaagcgcacatttaatcattcatattatcattaaatcaacatttgattaccatactttggcatttggtcatcagtggcaaaaggaggccgcatttctctaaaacggatgcgaatttgctaatcttcaacctgacagat

SEQ ID NO: 424 - DNA, 3834 bp, H. influenzae
  misc_feature (3744)..(3744): n is a, c, g, or t
acacttcattaaagcattttcttttagtacatttgcataaattaattggtttactggcactgcgataccaagaacgaaagttaccgcaatcccaagaccaaacgcagtggacacctttttagataccgctaagaaagtacacattcctaagaagaaagaaagtgccatattttcaatgaagactgccttaacaaataggctaatataatgttccattgattacttctcctgttgttctggtttccaagttcttaatccccagatcacaaatccgatgataaagaatgcacttggtgcaagtaggaataaaccatttgcttgataccagccaccattttgaatagtttcgaaaatagtcataccaaataatttacctgaaccgataagttcacggaaaaatgctacgataattaacatcgaaccataacctaagccatttccgataccatctacaaaactttcaactggaggggatttcatcgcaaatgcttcagcacgccccattacgatacagttagtaataatcaaaccaacgaatactgaaagttgtttagataaaccataagcataggcttttagaatttgatccactacgataacaagcgaagcgatgattgcgagctgtacaataatacgaatgctgttagggatataattgcggattagggaaacaaataagtttgataatccagttactaaggtaactgcaatcgccataacaaaagcagtttctaattttgttgttacagctaatgcagaacaaatccctaagatttgcaatgcaatagggttgtttttagcaattggcgctaacaacagatctttataacttgtttttccagacattagtttgctcctgaatgaagtttttcaagatatggaccaaagccatctttgctgaaccaataattaaaggtaccttgaacaccattacctgttaaagttgcaccagataaaccatcaatgctatgttcatcttgtggagcttgaccttttacaatacgaatggcaggttgatgttgctcatcaaataattttttacctttaaatagacttgcccagtttggattttcaatttctccgcccaatcccggtgtttctccgtgttgatagtaagtgattccattaatagtattaccatctggttgaacagatactaagccatacatcactgaccacaagccagtgccataaattggtaaaataacttgttgagtttgaccctgttcatcttttacaagataaacttcagttgttttgctacgagaacgaatacgtgctttatccgcatcagcaggaattgcttgttggctatcatctgcttgttgtgtgtattcacccgttgctaaatcaacgaaacgcggctcaataaattttgcataagtttcttttacattcgtatttgcttgtaaaagaccagctacatttaaaatatttttttgtttatcaagcaatttttgttcttcttgtgcaggctttaacattactgcggaaccagcaacaataatggaacaaactaaactcagtagtagcacaacaaggattgtgccgcctacgctgtctttattaaacttagccatttgttcttgctctccgacgtttgatatttgcttgaacaacgatgtagtcgaaaatcggtgcaaataagtttgcaaataaaatcgctaacatcattccttctggataggctgggtttacagtacgaattaatacagccattacgccaattaatgcaccgtaccaccatttaccagtattagtaaaagatgctgaaacaggatcggtcgccataaataccatacccaatgcaaacccacctaaaacaaagtgccaatgccaaggcattgagaacatagggttagtctctgagccaattaggttaaacaaggttgaggttgcaatcatgccaatcatcacaccagcaataatgcgccaagctgcaatgcgagtgaatacaataacagcaccgccaattaaaattgcaagggtagaaacttcccccattgaaccaggtaagttaccaacaaaagcatccatccaagtaattggagcgcctgttacggtatgttgcaatgcaccttgaccaccttgtgaccactgtgaaagtgcggttgcaccagagaaaccatctgcggcagtccaaaccgtatcgcctgaaatttgagctggatatgcgaagaataagaacgcacgaccagcaagtgcagggttcataaagttacgacctacgccaccaaaaatttcttttgcaacaatgataccaaaagtaatacctaatgcggcttgccatagtggcaatgttggtggaacgatcaaggcaaataaaatggttgaaacgaacattccttcatttacttcgtgaccacgaaccacagagaataacaattcccaaatagtacaaacggtaaataccactaagtaaattggtaaaaagaaaattgctccaagagccattttagagccccaagttgcattggcagttaaatctaaacctaatgaacttgcaagagcatagtgccaatcgttagcaattagttgatctaaattgcctaattgatttaacgctggaatcgcttggttacccacattgtacatcccatagaaaatcgcagggaacaacgcaaggaaaaccgtaatcatcatacgttttgaatctaacgcatcacgaacgtgagtgtttttgtgcgttaccgtaccaggtgtataaagcaaggtataaatcgattcaaagatcggataaagcttgctgtatttaccaccgggtaaaaacgcgggttccattttttcaaaaagatttttcaaacccatttttaaccttccttctcaatcttatctaagacttgacgcaagattgaaccgtattcatatttgcctggacaaacgaaagaacataacgccaagtcttcttcgtctaattccagacaacctaactcttgagcgccatcagtatcgcccacgattaaatcacgtaataataatgtaggtaaaatgtccaacgggcattacgcgctcatagctaccgattggcaccattgcacgttcgccaccattttctgaagtagtaaaattaaacaattttttactgaagtggcctaatacggtacgagtcacagaatatttattggcttgtggcataatccaaccaaaaaattctttttcattaccttcagcgattactgatacttgcagagcatagcgacctaaataatcatgtgaatcttttgctatttgaccacaaagaactgagccagaaattacacgatttttacccgcacttaattcattttgggttaattgagaaagattagcaccgattattgtacgtactaaacgaggttctttcacttgaggacctgcaagagaaattactcgttctgaataaagttcgcctgttgtaaataatttacctacagcgatcacatcttgataattgatatgccatacagttttttgaataccgacaggatcaataaagtgaatatgcgtccctacaagaccagctggatgaacaccagtaaaatcatgaatctgtaaattttcaagatcagcagtgggaatattagaatcgcccgctttacataagtgtaatggttttgaagggaatagacgacttaatacggttaaaccgttagtgaagtcttgcgaatattcttttaatacgacagagggatcggctgctaatggattggtatccatcgcgtttacaaaatagaagagcttcactttcatggatggactttactnatggacgagtacgtatgccgtccatagccagatttatcaggtttgtttacttgtcagagaaagtgattcattgttctggcttatttgcaa

SEQ ID NO: 425 - DNA, 3711 bp, H. influenzae
tttttcggcaaataatttttttggatacccccaaaattttttcttgaggaataccgccctttctagcaaattattgttgaaataatcttgtgggataacttgtagaagtaattctcgctgttgtgctgcgattaccgcatcaattttatcttttgttaggaagaaaattcctgtagaaattattgtgcaaagtagggcaataaagcctaacaatatgccataacgcgatgtgatttttactgtacccattattttcttccttttgttggataaccagatacgcgcggacgtgtgtaatgatcgataagtgggacgcaaatattacttaataaaatggcgaatgccacgccgtctggataatttccgtgataacgaatgagataaacaaataaccccactaatgcgccaaaaataatttttccgcgtggtgtaatggaggctgtgacaggatctgttgcaataaaaaatgcaccaaacatcattgcgccactaacgagttggctaatcgcacttaaatgcgtgaaaccagtaaaagcggtcgcagtggctaaacagaaaaaggtgacaagcatcgccactggaatttgccagtgaataatgcgttttaaaataaggaaaattccgcccgctaagaaagccacgttgatttgccaccagccttgagcaaaatcggttccattacccataaaaatcggcagtttaattaattcataaaaatcacttaattgattgtgacttttatagaaaatttttgcgctatccaaaggcgttgcttgggtgatgccatcaatgttatgtgtaagttgtgaaagggtaaatccatccgtggttaaacctgaaaatattaatgaaaaagtatctgaaaaagtcggtggttcctgtaataaattaattggtggcatccaagttgtcatttgtaatgggaatgaaattagaagaattacatagccaatcatcgcgggattgaatgggttttgccctaaccccccataaacctgtttacctaataaaactgcacagagtgttccaatgatgataatccaataaggtgcataaggtggaatagccattgccaaaattaacgcagttagggctacgctgaaatctgaaagataattgagcggttttttacctcgtaattttattgcaataaattcagcaatgattgccgtaccaatggctaatgcggattgaagcaccacgccaaatccaaaataataaatttgcgtgaaaaaagcgggcatcattgccaaaatgacccaaagcataatatgcgctgtgagttttcccgaatgggtatgtggggagctaaccattttaaacattattttattcctgattattttctaatgttgcttgtgtttttgccagtttcttcgcttttgcccgagcaatggcggcggctacggctgcttttttagggtcaagtgcggttgaattttcttgtgttttttctaccgcactatttgtttttctacttcattttctgcggtttgagagtttgaaatagcttcgctggtgctatttgcttgcgcaagtttttttgcttttgcgcgcgcaatggcggcggctacggctgcttttttagggtcaagtgcagttgaattttcttctgttttttctaccgcactctttggtttttctacttcattttctgcggtttgagagtttgaaatggcttcgctggtgctatttgtttgtgcaagtttttttgcctttgctcgagcaatggcggcggctactgctgcttttttcgcatcggttggttgagtttgttggtcttggttttcgcactgagatgctgcttgctgacgagctaaacggcgtgccttacgttgtgccattaaatctgtgttatcaggtaaaacttctcctttttctgaggttagtgttttaatctgcgttggttctgtttcattggcttttttcgctttcaagcgttcgagtgccgccttgactggatcttcccctttagtttgtgctaattcttcacggcgagcctgtgctgcacgttgtgaacgtgctttacgctcttgttcttcacgttccatccgtgcttgttttgcttcaaagcgaattttggcttcatctgatttcttttgtttttcttttatttgccagattttagctttttcttggcggaaatattgaattagaggaatatggcttgggcatacgtatgcgcaaattccacattcaatacaatctttgagagcgtattcttccgattttttgtgatcttcactgcgcgcaaaccaataaagttgttgtggcattaaatttactgggcaggcatcagaacagctagaacaacgaatacaagcctgttctgcttcaggttcggcatattcaagataatctggcgcaagtaaacaattgacaagttttgtcacaggtgcatttaggtttggaagctctagccccatcattggcccacctgcaaatataggaaaatgcttgtcaaattgatagcctgcatcgctcaatatttgggaaatgggtgtgccaagacgcacccaataattgcctttttcagcgattttatttccagtaagggtgacaacacgctcaattaaaggctcgtcatttataattgctctttttattgcgaacattgttcccacattttgcattaatacgccaatgctggatgaacgtgcaccgcttggcacttctatccctgtgagcaaataaatcagttgtttggtagcacctgaaggatattttgttggaataacccgaatgctaatatcatttgctccctgtagtgctgtgcggattgccgatatggcttctggtttgttatcttcaatggcaatgacaactttttcagggtgcaatatataacgtaaaatacgaatgccttttatgatttcatcagcgcgttcacgcataagacgatcatcacaagtgatataaggctcacattctgcaccattgataattaagagtttgactttttgctctgctgactgaattttggcagcagttgggaatactgcaccgcctaaacctgctatacctgcttgatagattttgtgaataagttgttctggcgatagcgttgaaaaatcatcaataggattacgttcgatccattgatctaaaccatccgcctgtaaatgaattgtgggttcatcaagacctgaaggatgcgtggcaacataaggtttaatcgatttaattgtgccagaagtgggcgcgtgaactggcaacatacgcaagccatcgccttttgttaaggcttgtccttttaagacataatcgccctcttttattaaaagattgcctgttgttcctaggtgctgtttgagtggaatgtaaaaatccgtgccgagaggcagatggcgtaatggctgtgaattagattgagatttcatttctggcgcatgaatgccacctttgaaatccccataatttaccggaattgaaacgagataatacgtccgccatttattcccccacaaccaattttttttcagagccatcgacattcattactggaataacgagttttgcatcaaattttcaatcccaattatcaatattttttttcacgggaatcattaaaatacaatctgtcgggcagggccgcacacaaagctcgccacctgttacaagatcggggaatgacgcgtgcattgctttatttggaccaataatggcatcacgggaacagccttggttaccttttgggcagcccatcccata

SEQ ID NO: 426 - DNA, 4326 bp, H. influenzae
  misc_feature (4163)..(4163): n is a, c, g, or t
aaagcattgcataaaacccattcttaatctcacaaagtgttttatttatcagccctgtgccgtaaaactccgtccttcagggcggagatataaggcacagggctgataaatttctaaccgcactttttcaaaaattaaattaatttaacaggtacttttacgactaattttttaattttttctgtttttccattcactacacagcaaggcttgtgcggttcataaggatagaatacagcgaacatttttggtttcattgtgacggtgaatttatcatcaatatctgcacaaagttgataatcatccgcttcgttgtaatcttcatacttagataaattcggataggttgcgcccacttcgatattttccgtgccacgaataagcacttgtacatctaagtattcatgatgtaattctgcttttttactgcttggttctgcagtttctggttccattacgttcatataaatttgatcgttaatatcatggcgaccattctctaacgcattcaaatctaacgtatttaaataatcacatacttcagcaatcacttttggcaaaccaactttaaaatttgggttggttaaactgctaataatcatagaattttccttatagtggataaaagttacactatgataccaagtcggttaaatgaaataaagccaccgattacatcatctctcttgattaatccaattagctcttgtagtaccgagtgaaagagagcaaatatttgccaacttattgacgcataaagtctaaacaatgaaattacggcattaacacaagcattttcagaaaaaatattatcaagaggcttatgaggacctgtaaaatgaaaaataacaagagaaatatcaagagtattaattgaaatcatatgaactaattgtaatgttgaatagcgtttagcaaaataaagttgaagatcattttgccacgattcagaaatatctcctgtatgtaaaataaaaacagagagattttcattgtgcattaataaagatttcagtgtgatttctacataaggaagataattagcatcactagccatcattacattatatttcatataaaagaacctaatttcagagagaacaatcaatttttaggaggaaaatactgtcgaaacaatgataagaagttggtaatgtgaaataaagttagccattaaagccaaacatcctgtataatgcacgggctttattttctacattagcgtgcggctatcaaaagaaatttttaaacgcccaaagtgcggtcattttttcgaaagatttcttttgctagtcgcaatctgggaaataaggcattgtttttaatataaattttaaggaaaacattgtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcataacgtggtgtagcggctgttatgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaataatcttggaatatagaatcaaaacttggtagcattcgctgccaagttttgttgttttccaacttttaggcataaagaaagcaaatgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgtgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattatgacggcgcattggatgctttcaatacggtgtttgaattagattcaggttatgactatacccaccttaatcgtggtttaaatttttattatgtagggcactaccatcttgctcagcaagatttcttacagttctaccaagccgataaaaaagatccctatcgtgtcttatggctatatttgaacgaacaaaaattaaaaccacaagaagcccaaacaaaccttggtgaacgagncaaagggctatcagaggactttctggggtacacacattcgttcaatattacttaggacacatctttgtaagagaattacacaacgtgccaggggaattgccggaaatcccaacattttgctggaaatctcacagaaacctatttttatttagcaaaacacaat

SEQ ID NO: 427 - DNA, 4574 bp, H. influenzae
  misc_feature (4057)..(4057): n is a, c, g, or t
  misc_feature (4130)..(4130): n is a, c, g, or t
  misc_feature (4311)..(4311): n is a, c, g, or t
  misc_feature (4325)..(4325): n is a, c, g, or t
  misc_feature (4545)..(4545): n is a, c, g, or t
  misc_feature (4556)..(4556): n is a, c, g, or t
aagtgtactagaaagcgttaaaaacgcagttaataacagggcaagtggagtactccactgactatctgtatctaagcgatgtatttcacgattaattttgtttaattgttgtttaatacgatttttaaatttaaaaattgcaccacctacaataaataaccctaagaaatacataagtaaataaggtaaattgtcataattagttggaaaacctaattttttcaacataccattaaactgttcaattaaagctcttggcagcatttttatccaatctaaattaatgggattattacttttcacccaaaaactttgctgctctaatttagattgaatttgatcactgatttgtgtaatttgctgctgcgttaattccaaagaaatcgcgagatttaattgattatttaaagatttaatcagatcagatgtcatttttcgacgctcagttaatagcgttttaacctgcgttctttctgcctcagtaaattgttttccatcttcactttcaactttattaatatagttatttagatcataaagttcattgcgtttttgagtaatgtcaaaaatatgcacacgcaaatcggcaatttgttttgataaaccttgaatatttaagttagtcggtaatttttgtttttgttgctggataatacgtgaaagaactaacgtgccttgtaatgcactaatttgttcatcaatagtatgttgagtttgagtgaggctatctaaaatattccgcattcttaactcatcttgagttaatgaattcgctttttctgtttgttgtaatagatactgaccaagctgtgcattgcgatcaagttctttttgaatgtaatcattttgcacagttttttgctgttgctgctgagcttgttctagttgattttgtgattgctgaagatttttttgattaatgacttcttgaatcgcaataatattttgttgttgcacctgcaaacgtaaattcaataggtcgtaacgactttgataaagtaaagaaagctgatcattattttttaataaattttgattataactattctttaaatcaatcagttgtaattcaatctgatattgttttcgtaatgcgctaccaatatcattattggccaattgttgattaatttgctgagtgcgtacaacattttccgttaatgccgcttgagctcgttcagaaatagaattttgccctgccaattgtgcatttgccgcgcctaatgcgttttgcgtatcttgtaattgatcatttatcttatcgagactattttgtaaatcgtcctgtgactgtgcattataatcagtacttgttgctgtttcttgttgtttttttaatgcttgaatttctgcattattctttctaatttcactctctgaatggcttaatgttgttagcaatgcatcattgatctttttgtgagcttgaatttgctgcaataaaacaattgatgtttgtaattctgctaacaacgtatttttttgcttccccctcactcattttttgagcgttagccaaatcggctttaagcgattgctccgttggtaatacatttgttgaatttgcccctaatgccccttgtgaaacactaagggtaaacattgccgaggcaaaaagtacggtaaaaaatggaggtgttttcataagtttcctaatcattattttttcctaatctaaatggtaaaattaatttatcttatcttgctttgccagccaatcggcaagctgtttacgtgagatcttaatgcctttcccaagcatcagtggtaaaggataatatgcaataggttgtttaaaacgtgcgagtttatcttgtaaaaaaaacattaaattttcaaccgcacttttgctaaaggattcattaaaatccactaaagcgacaggacgctgaccaaattctttgtttttttgtggtaaaacaaacacttgattaactgaagaatgttgaataatcacttgttcaatttcttctggctgaatattttcgccaccagaaataaacatattatcaagtcgtccgataataacaagttcgccctcttgccaaacacctttatcttttgtcggaagccaaccttggttattcgttaatgaaacaatttgtcgatccttccaataacccatcgccaaacccgcacctttcagccaaacttcatcatttactaagcgatattctctgcctaagagcggttgccccacaccttgtttttcatcagattttttggcaaaaactgtcgaagccatttccgtcattccgtagccagaataagtttcaataccatatttcactatttttttcgtgagttcagcaggaatatgcgtaccaccaagtaaaatatgacgtgtagaaaatgaaataatcgaattttcctgtaaataatctaacaaacgttgtaattgcgttggcacaagagaaacgtgggtcgtttctaataatgaagcataaaaatcatcttttgggaaatgtaattgtgcaccacaatataaccaacgccaaacaataccttgtcctgaaacgtgatataagggtaatgaaagtaaccaagattgattacaatcaaacttcattaagttacataccccttttgcattatccaaatgcgcttggacattatgcacaactgcttttggtaagcctgtagaaccagaggttagcgtcatcgtcgcaggacgaaaaaaattagctttttgtgtaaaagcatcaatttcttgcaaattcagcaaatctttatcataaaaacaaaaatcaatttgataaaactcacataattctgcaattttttcttgtggaaaagcaggattgatgcctaaaacttttgcgccaagctgaattgtcgccagatataaaaataaaattttctctgaattttttcccacaaaagcaaccgcactttccgcatttacgccttttttttgtaaaaaagccaccgtttggttaatctttgtagttaattctatccaagtaagcgcatcgctctgcgtagtacgtaaagcgattttatctgagaaatcaggttgaatagcaaaattttgccaaggatacattattaatttaccgtgaaatatgatcgcacttcatcaatcaatgtttcaggtaattccatagattgcattgcaccttctagcatcaacatttttcgtccactatttgtattggtaataacccaataaggcgtatctggaatttgttttggttttgtatgattgccagccattaataatgtcgcttcgtcacgtgcaaagtaaactcgagtacgtccttgtaaagattccgttgcttgcgcaaaactttcaggatttgtacgataaagcacacgtaaaatcgctaagaaacgcaccaccgccttactttcttcttgaaattcagttgaatttaataaagtttggactttttctactatctgattaattgcggttattgattgcttttttgttgttttgatatttacttctttcacattaatagcctgttctggcttttgatctgcggatttgttagtttctgctgaagtaagaactaaatcatcaacacttgaagtatgcacaggtaaactaagcaaacggcgtaaaatatccgaagcactttccccaatagagcgggtttggctcgcaatatattggtataattcttcatctacttcaatgatcttcatttttatctctctgtttgctaaaatttttttcaattataacgacttctttacaaattctcacgtaaaaattatggcaaaatcattactcaattatcaatttcatcaagtaaaacaaacgattaatacacctgttttaatttttattcacggtttattcggcgatatggataatctcggcgttatcgcgagagcttttagtgaacattacagtattttacgtattgatttacgcaatcacggcccatagttttcattcggaaaaaatgaattatcaactgatggctgaagatgttatcgcagtaatccgccacttaaatttatccaaagtgatattaattggtcattctatgggggaaaaaaccgcccatgaaaatcaccgcactttgcccagaattagtcgaanaattaatcgtaattgatatgtcccctatgctttatgagggatttggtcataaagatgtttttaatggcctatntgcggtaaaaaatgcaaagcctgaaaatcgtcagcaagccaaaccgattttaaaacaagaaattaatgatgaagacgttgtacaatttatgttgaaatcttttgatgttaattcagctgattgttttcgttttaatcttaccgcactttttaacaattatgccaatattatggattggganaaagtacgtgtatntacgccaactctttttattaagggtggaaattcctcttatataaaaatagaaaatagcgaaaaaattctagaacaatttcctaatgcaactgcctttacgattaatggcagtggacactgggttcacgccgaaaaacctgattttgttattcgtgcaattaaacgatttctaaataagaattaagtagtttaagtgagaatgctttatgaggggatctcntagagtcgacncgcaggcagcaagctgcc

SEQ ID NO: 428 - DNA, 5452 bp, H. influenzae
  misc_feature (4858)..(4858): n is a, c, g, or t
  misc_feature (4868)..(4868): n is a, c, g, or t
  misc_feature (4870)..(4871): n is a, c, g, or t
  misc_feature (4892)..(4893): n is a, c, g, or t
  misc_feature (4917)..(4917): n is a, c, g, or t
  misc_feature (4944)..(4944): n is a, c, g, or t
  misc_feature (4946)..(4946): n is a, c, g, or t
  misc_feature (5158)..(5166): n is a, c, g, or t
  misc_feature (5174)..(5179): n is a, c, g, or t
  misc_feature (5201)..(5207): n is a, c, g, or t
  misc_feature (5231)..(5231): n is a, c, g, or t
  misc_feature (5247)..(5248): n is a, c, g, or t
  misc_feature (5253)..(5253): n is a, c, g, or t
  misc_feature (5263)..(5263): n is a, c, g, or t
  misc_feature (5266)..(5266): n is a, c, g, or t
  misc_feature (5268)..(5268): n is a, c, g, or t
  misc_feature (5271)..(5272): n is a, c, g, or t
  misc_feature (5274)..(5289): n is a, c, g, or t
  misc_feature (5322)..(5322): n is a, c, g, or t
  misc_feature (5338)..(5344): n is a, c, g, or t
  misc_feature (5386)..(5386): n is a, c, g, or t
  misc_feature (5390)..(5393): n is a, c, g, or t
  misc_feature (5407)..(5410): n is a, c, g, or t
  misc_feature (5418)..(5421): n is a, c, g, or t
  misc_feature (5424)..(5430): n is a, c, g, or t
  misc_feature (5432)..(5432): n is a, c, g, or t
  misc_feature (5435)..(5436): n is a, c, g, or t
  misc_feature (5441)..(5442): n is a, c, g, or t
  misc_feature (5444)..(5444): n is a, c, g, or t
  misc_feature (5448)..(5448): n is a, c, g, or t
aaaaacccctcccccttgcatgtgcttacaatggtaaagcaagtaatattagcagcccataatgtaaaactttggagaaaagtcctgcaacacgggcgtgacttggttcaaaacaataaagcagaaagtctttacgtttgaaaacaatcaaacaaaaaatatcgcagaaatgaccgcactttgaatcagctcttgatgacttacacccaacacattaccaaacaaaatatgggttaaatgctgttctgtttgaattttggtaaacataaccaaaccaatagcaaacattccagaaaatacaatacccattgctgtatcttcttttatacggctattttctttcaaatatcccacaccaagcgaacaaaaaatacctgagaaaaatgcaccaatggctaaaggaattcctgccaaataagcaagtacaataccaggtaatacagcgtgagaaattgcatcacccattaatgaccaacctttcaagactaaatagcaagaaagtaacgcacagataatcgaaacaatcaatgcggtcaataaggcattttgcataaactcaaattgtagcggttctaaaagccaatcaaacattttctaccgcctttttattacgagttaataagccatattttggtgaaaataagaaagcgactaaaaacaataatgtttgcaatgtcacaatcacaccgcctgtggcaccatctaaataatagctaatataaacaccaacaaaacttgtcaccgctcctaaaataatggcgatgattgacaaggttttgaatttatccgtcagtaaatatgctgttgcaccaggggtaataaccatcgcaatcactaaaatcgcccccacagtttgtaatgcagcgaccacacaagcacttaataaagtaaaaaataaaactttataaaataatggcgaaagccctaccgttcttgcttgtgtttcatcgaaaaaaatcagtagtaaatctttccaaaataataaaagtaatactaaacaaacaccgataataattgcgacttggtaaatatcgtcatcggcaatgcctaaaatattacctaaaatgatattttgcacatttactgcggttggatttaaagaaacgattaacaaacctaatgcaaagaaagtactgaaaataaaacctatcacagcatcttctttcagtttagaaatggatttaatccaaagaatggaaagtgcggctaaaattccggcaaaaaatgcaccaagtgcgtaaggcaacgcaaaagcataggcaattgcaacaccgggcacgacagaatgggaaagcgcatcgccaattagagaccagcctttaagcattaaatatgaagacaaaaaagcacaaatgccacccactgcggtactcaaaatcatcgccttgagcatataatcataggaaaaaggttcgagcaataaatctaacattacctaatccctcttatttttaaccgcacttttataaggacaatcttcaaaatgacaattttgtgttgttggcgcaggtggatcttgcttagtttcgccatagaatacaacggctttttcatcatctgttaagacagtaacagaacgtttatcttcatcattatgtaaattttcgcccaataatttaatatgacgtaataccccaccaaatacaatttccaaattatgttggttaaaggtgttttctgtttttcctgcggcgataactgtgcgattaatcattaccacttgatcacaaaaatcaggaacagaacctaagttatgggttgaaacaagaataagatgaccttcttctcgaagctgttgaagaagatcaacaatggcattttcagttttcacatcaacgccagtaaaagggtcatctaataaaataatgggactttgttgtgctaaagcgcgggctaaaaacacgcgttttttctgcccgccagataactcgccaatttgacgatgcgcaagatgttcaatatttactcgctgcatcgcctcttgaactttttgtttatcaatcgctttggggatacgaagaaaattcatatacccatagcgtcccatcatcacgacatcatacactgatactggaaattgccagtccacttcttctgattgtggtacataagcaaccaaattacgtttcagtgcttgggaaattggcaaatcacaaagtttaatttcgccttgttgtggctttacaagccccattatgcttttaaataatgtggacttgccacttccattcacgccaactaacgcacaaatagttccactattgagtgagaacgtcatattgtgaatagcagtatgaccattgttgtaacgaacagttacatcattaacccaaattgatgtcgagaaagagtccattattttccgaatcctttaacaatggttgatacagtgacgttaagcaaatcaatataagttggcacagggccgtttttcgcagaaagtgaatcaacgtacaatacgccaccgtattttgcaccactttctttagctacttgttgtgcaggtttcgctgaaattgtactttcactaaacacaactggaatattgtttttacgaactaaatcaatcactttacgcacttgttgtggtgtgccttgttgttctgcattgattggccataaataaccttcttttaagttgtaatctttcgccaaataactgaaagcaccttcacttgttacaagccagcgttgcgcttctggaatttgtgctaattttgcacgaagcggttcatcaagttgtttaattttttgagcatagtcagcggcatttttttcatacacagctgcattttgtggatcgtatttcactaacgcattcttaatattttcaatataaattaaagcattagatggcgacatccaagcgtgtggattaggcgcatctttatacgggccttcataaatagataatggttgaataccttctgttactaccacagcaggtttatctttaacattttggaagaaacgctcaaaccaacgttccaaatttaagccgttccataaaattaaatcggcagattgtgcttttacaatgtcttttggcgttggttcatattcgtgaatttcagcacctggtttggtaatagattccactgttgctgcattgcctgccacattttgcgcaatatcttgaatcacggtaaaagtggttacgactttaaattttgcgttagcttgcattgcaaataaaccaagtgcaagtgcggtcataattttgaatgaatttcgcataagatgtccttatttaaaaaagatagattgaatgcctgaataatcgttcaacagcacaacaattattcatcggaaataatagtactactttttatgttgttttggaatggaaatgattatcaaaataataggtttatttataattatttcgtacaaaatgtattgcttttatgaaaaaagcataaaacaaagaattttcttaatcatacaagcaataaaggtattttctgtcattagaatgactttttatcaaattaagtctagaatattgaaattattatagatttaccatttgaggataagatatgaaaaaagcattttggttagtattaagttcagcaatagtcttggctgcttgtgatgataaacctaaaatgacggagcaaactaaaacaactgaccaagcgaaaatggctgcagaacaacctgatcaaaagcccgtattgatcaattataaacaaattgccttagacaaatcccagcaagcgattgatacagcgaaagtcgctcaagacaaatcagttcaagctaatgaagccgtgaaagtagcaatgcaaaaacaacaagaggctgaaattgcgctaagtcaaggtggcgaagaggctgaaaaattgtctaaacaaaaaatggacgaatctaatgcagctgcagaattagctttaaaattgtcggaagaatccaaagctgcttctgcactttcaatccaactttccaaagaagcggaagatgcggctaataaggcgaatcaacaagctcaagctgagaaatagcgtaagatttattcttctaatttctatttaaatcaactaaaaaacgcgagataaaacaactcttatctcgcgttttttgtgtttatgaacattatcttgataatttctgaattagcgtattaaatcccacttcatcatagccatcttcatattgagcttctccagctacatcacgaattgttcttccatttaatgctgtgcagccgaatttttctaatttgcttttagtaaaactagaacgatacgcagaggaagtgttatttaaactaattacgccaatagttgcatttttgcataggtgtttattaatgaaaacgagattataaccagattctcgaatgtagcccgttttattcactgccgcatcaaagatttcatcacgcactaacttattagtatttttaatataaagtttatgtttcccagcttgaatataagttgcactaagattagataaaagtttaatgtccgatttatttaatgaatatttagcgagtttaaccaaatccatcgggctggaaatattgtagctagataaccctgaactatcgtgaaaacgagtagaatacataccaagttgatgggctttttcgttcattttattaataaattggcgacgacttattcccgctgcacgagaaagcgcgtgggcagcatagttatcagaatggacaagcattgctttcaataattcgttacaagagataggaatatttttaggtaattttgttcctgtacctttaattcgatccgtatcctcttttgtgattgcgattcgacaattaggatttttattattctctaaaaatacattagccgtcattaattttgttacagaggcaataggctgnatatactatncnnaggcgcattagctttccaatnnactcgattatggggtaaaatccanaccaccaaccataagactgtgccgcananagaaggacacaagataaattaaaaaggctttttaaacatttttgggacccctttaaaaagggggggcccccttttttcccccgcgctttttttttcgcgcgccgggggggggggaaaaaattttttgtgcctttaatcccccaaaaggggggggggagaaaatccccccgggggtttaaacccccccccattaaattagggggggggaaaannnnnnnnnaaaaaaannnnnnaagatagttggcggtagagggnnnnnnncgggggggggggtgggggaaaaanaccccccccacccccnnggggnaaggagaganaananaannannnnnnnnnnnnnnnntgtgttttttgggggggagaagccccccccccnaaaatggagggttttnnnnnnnggggggcccccccccccccctggtggggttgttttttttttncggnnnngggggggggggggnnnnaaccaagnnnnatnnnnnnngnggnntgttnntncttntggg

SEQ ID NO: 429 - DNA, 3166 bp, H. influenzae
tgatgcagtaattgacagcagcccaatgaataaccaaatttccagacttaatcttgataaacctattgagccttttgaattaggtatttgcacccaaaaaagaaatctcgaacagcccctagtccgtgcattttgggcgatgttagaatagaataaataatggtttaaaataaggatttcttatgtttaaaggtattctcgtttcattattagcctcgtttttatttggctatatgtattatttttctacgttactaaaacctttgagtggcacagatattttcggttatcggatgatatttacttttccttttgtcctgttgtccgtcacattatttaaacaaaaagcagctttaattgaacgtttaaaacgcattcaaaaacgaccgcacttagcattgtcatatttactttgcggattattaatgggttttcaaatgtggctttttctttgggcaccgaataatggcagttcattaagtgtatcttttggttatttacttttaccaattgtaatggtggcggcaggtcgcgtgttttttaaagaacgcatttcaacattcaaatttattgccgttatcattgcaacattaggcgtaatttctaatattgtgctaaaaggcggtctttcttgggaagccattgttatctgtttaggttacaccgcatatttttctatccgaaaagcattaaaaaataccgatcttgcctccttttgtttagaaatgttaagccttatgcctgtcagtatttattttgctttacaaacagatttcgcgacagtacaacaaaccaatccgtttatttgggggctgcttgtattactaggattaatcagcggtactgcgttaattgcctatgtaatagccagtaatatgcttcctatgaatttactcggtctgcttggttatgttgaaactattatgatgctatgcgtatcatttttgatcggagaacaaattgatagcggaagctacccactttttatttgtttagttatcgcgatgattcttgttatggttgatggcgtttacaaacaacacgcaaaaggaagtttataaatgtcatttaaagaaataactccacagcaagcttgggaaatgatgcaacaaggcgcaatattagtcgatattcgagataatatgcgctttgcttattcacatcctaaaggtgcttttcatttaacaaaccaaagttttttgcaatttgaagaactagcagattttgattcgcctattattgtgagttgttatcacggcgtgagcagtcgaaatgtagcgacttttctcgtggaacaaggctataaaaatgtatttagtatgattggcggatttgatggatggtgcagagcagaattgccgattgataccacttactaacccattcatcaaaaatataagatataaaaaagtgcggtaaaaatttaccgcacttttgttgttattctaattaactgaaaattagtttttcgctgcagctgctgctttaacaattactgcaaatgcaggggcttttaatgatgcgccacccactaatgcaccatcgatgtctggctgagtaaataattcagcggcatttgcatcatttacagaaccgccgtattgaataattacttgctctgccacggcttgtgatttcgctgcgatgtgaccacggataaatgcatgaacggcttgtgcttgtgctggagttgcagatttacccgtgccaattgcccagattggttcgtatgcgatcactgcaccgttgaatgcttctacgcctaatgcattgatgactgcatcaatttgacgcgcacatacttcttctgttttgcctgcttcgttttctgcttcagattcaccaatacataatactggcactaaaccagcttcttttaatgcaccaaattttttcgccacaaattcgtcgctttctttatgataagtgcggcgttcagagtggccaataatgatatattttgcaccgaaatcttttaacatttcgctagaaatatcaccagtaaatgcacctttcacattgatatctacgttttgtgcacctaattgaatcacacttttaccgccacagctgcaaccacaaccagaaagtgctgcttcagccgtacctaaatacataacggggggggcaattgctacatcacaacctgttacatcatgtaattccgcttttaatccctcgattaattctttcgtgaatgctttgctaccgtttaatttccagttacccataactaaaggacgacgtgccatttttgtttctccatagttgataaaattaacttgcttactataccaaaatttcgcccctattctttgcagaagatcataaaattaaaaaaattctcacagaaagatgattatcttgagctaaaaagctacaattacctgtatggaaccaataaaaaataaccaattatgaaacttttcaaagctgaacaatggaatattgaagtgcttcttcctctttttgaagcctatcgccaagcctatgggcaagcagagaatccagaacgtaccttagcttttttaactaatcgtatgcgttttaatgaaagcctgttttttattgcggtggatgaaaatgaaaaggctattggctttgtgcagcttttccctcgcctttcttctttacaattgcaacgttattggcaaatcaccgatatttttgtgttggaacatgcgcaacaaacagaaatttatgcggcgttgatttctaaagcaaaagactttgtgcatttcacgcaatccaatcgtttagtggcagaattagcgcaaaatcaatattcaatgttggaatcggaagggtttaaattgaacccaaaagaacgtttatttgaattgagtttgtcatgctaacagcgttaaatcgttattgggattatttgcggattgaacgccaaatgagtcctcacacaatcactaattatcaacatcagcttgatgccaccatcaaaatcttatcgcaccaagatattcattcttggacacaagtgacgcctagcgtggtgcgctttattttaccggaaagcaaaaacaagcttaaaagacaaaacttggtttgtgttaatccgcatacgtcaattttcagtttttatggcaccaggcgaattaataggaattctgcccaggcatttctgcccctaaacaggttgttttttacctac

SEQ ID NO: 430 - DNA, 3674 bp, H. influenzae
tgatgggctttctttgatagcttggcgattacttggtgtttatatcgccactatcgttgggcttgtgcttaaaccttatggcgagcccgttatcttattggctgcaattgcggtttctggcgttatcatcggtaatactgaaggggcgaaagaattggttaaagtcggcaatatgttggatggttataaatctggcacaacatggcttatttttaccgcattcactttgagttcagcatttgtaatcacaggtctaggtaaacgtatcgcctatcatatgatcggcgcaatgggtagcacaaccctacgcttaggttatgttaccatgttcttagaccttttactctcgccagcaacgccctctaacaccgcgcgttcaggtgggattatctttccaatcattaatagcgtagtggttgctcttggttcagatccagaaaaaagcccgaaaaaagcagggcgttatttgatgatgaacgtatatatggtggttaaaactacctcttatattttcttaaccgcaatggctcctaatgccttagctctttcattaatggcaccaattcttggttttgaaaccacttggatcaaatggttcttagctgcatccgtacccggcttactctgcttattcttaattccgttaatttgttattgggtatctccaccagaattgaaaaaagtggataataaagccattgcgaaaaaaggcttagaagaattaggtccaatgtcttttcgtgaaaaagcactcagcgtgttattcgtaattgcattattcggctggattttctctaattcacttcatatcaatgctaccattgttgcaatcattgtaatggtgctttgtattgtattaagtatcgtcacctgggacgatatcttaaaaagcaaaggcgcatggaataccctagtatggtatggtggtatcatcggcatgtctggcttgcttgaaaaatctggctttttcaaatggttagcaaacaccttaagtaccatacttcagtttgagggacatggtatgatggcgttaatagtgattcttaccttaagtgtctctgtacgttatttatttgcatcaggcggtgcatatgtagctgcaatggtacccgtatttgcaacagtcggacatgtaacaggtgctcctactgaattgcttgctctaggcttagtctttgctaattcttatggtggttcagtaactcactacggaggcggaccaggtccaattgcattcggtgcaggttataatgatataaaatcttggtggattactggtgcgatcattgcttttggtagtttaattatccatctaactatcggtatggcatggtggaaattattaatgagtttaggctggttataggctgatctttttttaatttaactgctattttgacggtgtagtagacaaagtagttgattataaatatatgcttgcgctttcctaaaaagtgagctctatttaatccttttggtttaccttgaatatacacatcgttgtaatcgcgataagctagtatttcctttaattttatgaactaatatttacctcatactgcattatatcttgagtatatttatgaatatcttattttttaatgatttacaagcctttctagcttatcaaaatatcctgtttagtgtctttcaccgaatattcactagccagaattatcgtaagtctgtagaatagccgaccgctttattcgactaattatttataacacctaacgatattgtagaaaatgactcaaaaattacatattaaaacttggggctgtcagatgaatgaatatgattcatctaaaatggccgatcttttattaagcactcacggattagaactcacggaagcacctgaagaagcagacgtattattattgaatacctgttctattcgtgaaaaagcacaagaaaaagtgtttcatcaacttgggcgttggaaagaattaaagaaaaataatccaaatttagtgattggcgtgggcggctgtgtggcttctcaagaaggggagcatattcgtcatcgcgcgccttatgtggatattatttttggcccacaaactttgcatcgtctgcctgaaatgattaatcaaattcgtggtggtaaaagttctgtggttgatgtgagtttccctgaaattgagaaatttgaccgcttacctgaacctcgcgcagaaggcccaactgcatttgtttccattatggaaggctgtaataaatactgtactttctgtgttgtgccttatactcgtggggaagaagttagtcgtcctgtagatgatgtgttatttgaaattgcgcaacttgcggaacaaggtgtgcgagaggttaatttgcttggtcaaaacgtgaatgcctatcgtgggccaacgcacgatggtcaaatttgtagctttgctgaactgcttcgtcttgtcgcatcaattgatggtattgaccgtttacgtttcacaaccagtcatccaatagaatttacaaatgatatcattgatgtgtatcgtgacacgcctgaattagtgagtttcttgcatcttccagtgcaagcaggatctgaccgtgtattaacgatgatgaaacgtggtcataccgcattagaatataaatctattattcgtaaacttcgtgcagtgcgtccagatattcaaatcagctctgactttattgttggtttcccaggggaaactgcggaagattttgagcagactatgaatttgattgcacaagtgaactttgatatgagcttcagttttgtgtattctgcccgaccaggtacgcctgctgcagatatgccagatgatgtgacggaagatgaaaagaaacagcgtctttatgtgctacaagagcgtattaatcaacaagccgcacaatttagtcgtcgtatgcttggcacagagcagcgcgtgttagttgaagggccatcgaagaaggatattatggaattaacaggacgcactgaaacaaatcgtattgttaatttccaaggttctccagaaatgatcggtaagtttgtggatgtaaaaattactgatgtttatactaattcgttacgtggcgaagtggtgcgtactgaagatgaaatgggattacgtattgcacaatcgccacaagaagtgatgaatcgcacacgtaaagaagatgaattaggcgtagggcgttatcacggctaattaaaatgctgaaatattcaaccgcactttgagagattaaagtgcggttattttttagagatatatggtttagatttgccaatcaattggtttcattccattactttccaaatatgaatttgttttggaaaaatgatgacagccaaaaaaacctcgatgggctgaaagtggggaagggtgcggagccgttaaaacaaggtgacgagtgcggtcaataatttgtccttttttttgtgcgtgactgccccaaagtaaaaacaccagtttttcacgatgttcattaagcactgcaataactttatctgtaaacctttcccaacctaaattggcgtgtgaatgtgccatacctcgttccacggtaagcactgtgttaagtagcaataccccttgctctgcccatttgactaaataaccatttgatggcatttgaaatcccgaaatattttgtgtgagttctttatacatattaattgggagggtaccgagtccgaatcgtaaaca

SEQ ID NO: 431 - DNA, 3694 bp, H. influenzae
tgttatacgattcggactcggtacccgttactaagtgggtgcagaaacaatgttacggatagccctcgcaattcaattcctttctggaatgtggctaattttgaccgcacttttagatcttggtttttggccaatggcaattggcgtcgcctttttcgtcggtccaaacccagtgatttcatcaaatgcaatggcatcagctttagaaaaatgtcctcaaatggcgggaacaacaaattctttgattggtagcgtacgttttgcagtgggtgcaattatgggaagtttagtcgcgtcaatgaaaatggatactgccgcaccaatgctctttactatgggggcatgtgtcgtgatttccgtgttggcgtattactttctaaccagccgaaatcttaaaagccgtgggtaaattccccacggcgcaatgattgttttctttattaaacaaaaaccatccataacggcaagcaaacagcaataaataataggataaataaactattggtagataatatccacttttggaaactatgcagaatcagaatagccgcaatcacaaaatggcaaacaaaataaatgatgtaggcaaaaacactgtcagaattaaccgcactttccataccatttaaaagtaaaaataaaaacattgccaaagcatttagagcaagcaatataatcattgctaagggcaacaatgctataaaaccttgtaaacgatttcgtgcaataacaagcgcaagatttgctaaaatcacgccagataaaattggtgcaaaagggttatattcagcaaaatcactcgcaggaagcacggtaaaaatcattaaataactcaagcaacctaaacccgcaattaatgcagccatcaataaaaagctgttacgaattttttcagttttgggttgtttccaaataaaatacacgacagaaagaccacatacgctcattacgttagtaagcgtgtgattattttgtaataggcttatcagcaaccacactgcccaataaatagcaaaagtcatattcactttgattaaacgaccacgttgtcctgggcaaatttcgccgcgataaaacaccaacaacgaaattaactgtgcaaccaacacgcctacacctaaatgaggcattgtttgcttttcagattgcaaagaaaaaataaatagatcgatgccaagcaccattgagatcgataataccgcaagcaatgctgcgatatatttagaagattgttctgacataattttgacgtctgaaaaaataatgcgtcattatgctaaaaattcattaaattttaaagtaaaatgaaaccaattttaaccgcacttaggtacatgaatgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgcccggtgtttaattaccaagacctcacatcggaagaacaagataagctgccaaataaaaaggaataaattccataaagggaataactatgttagaacaaatgggtaaacaagccaaagatgctgcattatcttggctcacttcaccactgctgaaaaaaattgtgcattatccattattgcagaaccacttccaacaacaagcaccgcttatcttagccgaaaacgcaaaaagatattgaacttgctaaacaaaatggattatcggatgccttgattgatcgcttactgctcacacaagaacgtttacaaagcattgctaatgatgtacgccacgttatttctctagcagatccccgtggggaaaatcatagacggcggtacattggatagcggacttaaaattgaacgcgtacgcactccgctcggcgtcattggtacaatttatgaagctcgcccaaatgtgaccattgatgtggcaagtctttgccttaaaactggcaatgcggtgattttacgcggcggtaaagaaacacaattttctaacaagattttaatcgaagttgtacaaaatgctttagagcaagcaggcttaccaaaatttgcggtgcaagccattaccgatccaaaccgtgaactcgttatgcaattattaaaactggatcgctatgtggatatgattattcctcgtggtggttcgggtttacatgaattgtgtaaacaacattcgactattcctgttattgtgggtggtgtgggtgtttgtcatactttcgttgaaaaaagtgcggatcaaaataaagcgatttttgttattgataacgccaaaacccaacgtccaagcacctgtaacacattggaaacattgttagttcaacattctattgctgaagaatttttaccaaaactcgtctctcacctcgctaccaaaaacgtaaaatatcacgcaaaatccaccgcacttaatatattgaaacaagcaggtgcgaatgtctgcgaagtgacagaaaaagaattgcgaaaagaatggggatcattggatttgaatgtggttgttgtggaagatattcatgccgctattgagcatattcgccaatatggtacgcaacattctgaaagtattttaacttcctcacaaaacctagcacgtcaatttatcaatcaagttgatgcggcagccgtttatgtgaatgcaagtacacgctttactgatggcggacaatttggattaggcgcagaagttgccgtgagtacccaaaaacttcatgctcgtggccctatggggttagaagcattaacaagttataaatgggtttgtgaaggcgaatacaccgttcgcaaataaaacccaaagtgcggtaatttttagaagagattatttgcatataaaaaagtccgcgaaatgcggactttttcattatctttatttgtcagatttacccaagttatcaaagaattttttcacaccgtctaaaaatcctgaagattttggtgcgtgtttacttaaatctttaccttgtaaactttcctcaagtttgtggagtaattctttttgttcgctggttaaattaacgggcgtttctaccacgatacggcaaattaaatcgcccgcataaccactacgtgtagaagcaacaccttttcctcgcatgcggaataattttcctgtttgcgtttcagcagggattttaagtttcactctgccatctaaggtcggcacttcaatttcaccgccaagggctgcagtagcaaagctaatcg

SEQ ID NO: 432 - DNA, 3999 bp, H. influenzae
  misc_feature (616)..(616): n is a, c, g, or t
  misc_feature (3989)..(3989): n is a, c, g, or t
tgtatacgatatcgactcggtaccctttttcgtttaaagtgcggttaaaatttcaatctttttaggaagaacgtatggacattcgtaaaatcaaaaaataatcgaattagtagaagaatctggcattactgaattagaagtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaataatttccaatattttcgtcggggcggactttagtccgcctgtttcatatacaaataattagagcgaatttatcgtangcgatataaattgaaatctgttcacaccaaattttataggggagaacaatatttcaataacctacataaaaaatcacgtctatctgactaaacggactcttttatgttagaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctctcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataattaaacgttaaatggctaacaatggttagccatttcttatatatgccgatatttatttaatgataataaaaactaaagctagtaaagcgttttgaattattcaaaaaagttgtaatatgaataagtataaggggcgtaggatatatgtgcctcttataccattcaaaaaatatactttcacttataaaaatttaaggaagaaacatgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaatgaatctaggtattattcttcccttaattatttatctcacttttgtttttggtgcggcaatttttgcctatgtaaaacgtacaaaaggcgattttttaacagaatattatgtaggaaatcgctcaatgacggggtttgtacttgcaatgaccacagcctctacttatgccagtgcaagttcttttgtaggagggccaggggctgcttataaatacggcttaggctgggtattacttgcgatgattcaagtccctgctgtatggttagcattaggtgcgttgggtaaaaaattcgcactcttatcaagagaaaccaatgctttaaccattaatgatcttttcttttatcgctataaaaacaaatatttagtttggctatcaagccttgctcttcttctcgcattttttgctgcgatgaacgtgcaatttattgggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgctttttagtaggtaataaattgggcgaacgtcgaatcgaaaaaactcaattaaaagctaccggggtaccgagtccgatatncgtataacat

SEQ ID NO: 433 - DNA, 4461 bp, H. influenzae
  misc_feature (1537)..(1537): n is a, c, g, or t
  misc_feature (4385)..(4385): n is a, c, g, or t
tgttccgattcaactcggtatccctttatgcgtcaaagcaggcggtggcggcaaagcgatgttctttggtaaaagccgagccaaaatgttgaatcaagatcagattaaggtgacttttgcggatgtggctggttgcgatgaagcaaaagaagaagtgggcgaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggcggcggacacgatgagcgtgaacaaaccttaaaccaaatgctagttgaaatggatggctttagcggtaatgacggcgtaattgttattgcggcaactaaccgtccagatgtacttgatccagctttaactcgtccaggccgttttgaccggcaagtagttgttggcttacctgatgtgaaaggtcgtgagcaaatcttaaaagtgcatatgcgtaaagtgtctgttgcacaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtacctgagcatgatcctgtacataaagtgacgattattcctcgaggacgtgcgttgggtgtgacattcttcttacctgaaggtgatcaaattagtattagccaaaaacaattagaaagtaagctttctaccttgtatgcagggcgtttagcggaagatttgatttatggtgaagaaaatatctcaacaggtgcatcaaatgatattaaagtcgcaactaatatcgcgcgtaatatggtgacgcaatggggattctctgaaaagttaggtccgattctttatacagaagatgagggcgaggttttcttaggtcgttcaatggcgaaagcgaaacatatgtcagatgaaaccgctcatgcaattgatgaagaagtgcgtgcaattgtaaatcgcaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagccntgaaagtgcggtagaaaataccgacaattttaatgtttaacttatcaaagcctttcttcggaaaggctttattttttcctaatgatttttttcttggatgtatttcgctataatcgcccaccaaaatcactctaaaaattaaccgcactttatgaaactttacgcaaataataaatgtcttgatttaagcgttcctaagattatggggaatccttaattttacgccctgatctttttctgatagcggacagttttttagtttggataaagcgctttttccagttgaaaaaatgttggaagaaggggcgacaattattgatatggtggtgaatctacgcgtcctaatgatgcggatgaagtctctgaacaagaagaattgcatcgtgttgtgccagtagtgaaggcggtgcgaagccgttttgattgctggatttctgtcgattcttcaaaagcagttgtgatgcgtgaagcagcaagtgttggaatggatttgattaatgatattcgtgctttgcaagagccaaatgcgttagaaaccgcagtaaaactagctttacctgtttgtatcatgcatatgcaagggcaacctagaacgatgcaggcaaatcctcattatgagaatgtcgtacaagatgtattcgcttttttacagaaacgtactaatgaatgtctttctgctggtgttaaaaaagaaaacttaatttgggacatgggattttgttttggtaagtctgtacagcataattatcaattattacaaaatctgaatgaattttgtcatagtggatatcctgtgttagcgggattatctcgcaaatcaatgattggtgcggtgcttgataaacccgtcgatcagagagtgataggtagtgcggcaggtgcgcttattgcagcgcaaaaaggtgcaaaaattttacgcgtacatgatgttgctgcaacatcagatatgctcaaagtttggcaggcaacagaaaatgcctgatggttttataaaaaaattaaaggaattgtattatggcaaatcgtaaatattttggaacagatggtgtacgtggaaaagtaggtagttatccaattacaccagatttcgcattaaaattaggctgggctgcgggaaaagtattggcttctcaaggttctaaaatggttttaatcggtaaagacacccgaatttctggatatatgttggaatcagcccttgaagcaggtttggctgctgcgggtttatctgctgcatttactggccctatgcctacacctgctattgcttatttgaccagaacttttcgtgctgaagcgggtatcgtgatctcagcctctcataatccttattatgataatggcattaaattcttttcagcaaaaggcactaaattgcctgatgaaattgaagaagccattgaagcgatgttagagcaaccgatggattgtgtggaatctgccgaattaggtaaagcaagccgtattaatgacgcagcaggacgctacattgagttttgtaaaggtacatttccagcacacttaggcttggaaggttataagatcgtggtagattgtgcaaatggggcgacttatcatattgcacctaacgtattgagagagcttggtgcggaagtcattgaaattggtacagatccaaatggtttgaatattaatgaaaaatgtggtgcaactgatgtgacagcattgcaagctaaagtagttgaaacgaaagctgatgttggtttggcttatgatggcgatggtgaccgcattatgatggtcgatcatttaggaaataaagtcgatggcgaccaaattctctttattattgcacgtgaagcattgcgctcaggtcaattaaaaggcggtgtcgttggcaccttaatgagtaatatgagcttagagattgcgttgaaaatgcttggtgttcccttcttacgtgcaaatgtgggagaccgttatgtattggaaaaaatgcttgaaaatgattggacgcttgggggggagaattctggacatattatcattgcggataagaatacaactggcgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgtgttatggtggaatgccaagatgctgaacttgcacaacaatgtgcagaagaaattgcagaagccgtgaaaaaaattaattaatttttgaccgcacttagtaaagtgcggtttatttttataaagtttttaggaaagcaaaatgaacatttttattatgcgtcacggcgaatcggaagtaatggctaatagtgataaagctcgtcgcttaactgcttatggtattaaacaagctttttctcaaggagaatggttaaaacagcatttaagcacgctagtaattaattcactagaccgtattttagtgagcccttatgtcagagctcaagaaacctttcatcaagttaatcaagcgtttgatttggagttagaaaataaatttgaaatttgggagggaataaccccttatggccatgcacattccgtcattgattatttagaagtgctaaaagacgagggcgttaaatctgtattgattgtttcccatttgcccttagtgggagaaattgttgctgaactgtttgcaaaacgaaatccatatcattttatcctgcactattgctcattattatgggatgtnataaatcagaatattgatgcatcaagctctcctgtatttatttaaaataactattcttttttacaaaataaattta

SEQ ID NO: 434 - DNA, 4175 bp, H. influenzae
tggggattcatcaccgccgagtttttaatgggctcaagggttaatgaacatgtaccgcattttggtcacctcgaagtctgcgtaacacgccgcacaaccgaagtggtgtaattgaatcgctttaccttcgattaagatcggttcaaaacgcttggatacccaaacggtgaagtgttggcgcacggttcaatagaattgggtgttcacgaataacttctgcaagaatatcccaaacgatcgcctcttcacgctcaaccattttcttagccgctttgattgtcgtagcataaccacggctttctaatttcgcatagataaacggacggaataattccaatgccattttcttcggtaaaccacattggtgtaagtgcaagtatgggccaacagtgattacagaacgaccagagtaatcaacacgtttacctaataaattttgacggaaacgaccttgtttacctttgatcatatccgctaatgattttaatggacgacggttagaacccgtaattgcacgaccgcgacgaccattatctaataaggcatcaacagattcttgtaacatacgtttttcgttgcgcacaataatatctggcgcaattaaatctaataaacgttttaaacgattgttacggttgattacacgacgatataaatcgttcagatctgaagtcgcaaaacgaccgccatcaagtggtactaatgggcgtaaatctggtggaagaactggcaataccgtcatcaccatccattctggtttattaccagattgaacaaatgcttctaataattttaagcgtttagtgatttttttacgtttagtttcagagttagtttcttgtaattcttcacgtaatttttcacattcagcttcaagatccataccttttaagagatcttgaatcgcttcggcacccattttcgcttcaaattcatcttgccagcgatcttcagcgtcaaggtattgttcttctgttaataattgaccgcgctctaagtccgtcatacctggttcggtcacgatgtacatttcaaaataaagtacacgttcgatatcgcgcaatggcatatctaaaagtaaaccgatacgagacggcaatgattttaagaaccaaatatgtgcaactggcgatgcaagttcaatatgacccatacgttcacgacgaactttagtttgagtgacttcaacaccacatttttcacaaatcacaccacggtgttttaaacgtttatatttaccacataaacattcgtaatcttttacaggcccgaagatacgcgcacagaaaagaccatcacgttcaggtttgaacgtacggtagttaatggtttcaggtttcttcacttcaccaaatgaccaagaacggatcatatctggggaagctaacccaattttaatcacatcaaaatcttcactggtttttgattgtgcttttaaaaacttaactaagtctttcacaaatgttctcctgtcggagttaaaggtttaaagtgcggttaaaaatttcggagaattttgaccgcacttcggcgatttattgtttcgtcattttttctcttcgctccccctgtttacggggggagctgccgcaggctgaggggaggaatttgttggcagtagaatcattgcaatcgctataaatgtttcacttaatttatgtggaagcggacgattacctaaatacaccgccaccattaatggcacagcaagttttacaatttcagagggttgaaaacgaataaatcccagatcaagccaacgctgcgcacctttacttgtcgtgccaatagcatctactaagatcaacaacacaaaaccaattaaataaagataaggtgcgatgcgttggtaaaatcttggtggaaattgagccattaacaacataacaataaatccaagtaaaacctgaataattcggttattaaacatcatttcactggcacctgatgcactatataacaccagcataccataagccgttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgcgctaacggtgcggcattacttgaaccaccacctgcattttctaaaatcactgtcacaaccaatctagggttttcataaggcgcatatgcggtaaaccatgcgtgatcatgcaattcttttttcaatcccaccgcattgtatttttcattttcttttaaactaaacacttgagcagtaccagattttcctgcaacacgataattggcatctgcaaaggcttttcgcccagttccatttgcagcattaacaacattgtacataccgcgtttcgctgcctcccaagccgtcactttaggtgtactaatatcaggataaattaacggatcttcataaggctctagaactgccccctcaattgctttcatcaaatgcggcgtatttactttgccattattgaccaatatcgtcgttgcttttgctacttgtagtggtgttgccgtccaataaccttgaccaatcccaaccgaaatcgtatcgccttgtacccaagggcgtttatagcgtttttgtttccattctcgagttggcatattggcagccgtttcttcttgaatttcaatccccgttggcataccaaaaccaaaatccttcatccaattagaaagacgatcaatacccatattataagccacttgataaaaataagtatcagaggattcagtaatcgctttattcaaatccgtatctccgtggcctgtttttttccaatcacgaaaacgttttgtggagttaggtaatacccaatatcccggatcaaaaatcgttgtgtttggtgtaatcacattttcagtttgtgcggctactgcaataaaaggtttgactgttgaagcgggcggatacgcaccttgtgtcgcacgactataaagcggacgagcaggatcatttaataaacgtttataatcttcggaggaaataccatcaacaaataaattattgtcataacttggtgtagataccatcgctaatacactactatctttaggatcaagcacaactacagcaccttttagtcccgataaaagttcagtaatataacgctgtaatgctaaatcaatagttaaatgaatactttttcccgccacagcaggtcggctacgcaaagtacggattactttgccgcgattattaatttctacttcttcaaaacccgtggtaccttgcagtatatcctcgtaataacgttcaatacccaattttccaatatcgttcgtccccgcataattcgcaaatttatcctctcgtttcaaacgttctacatctttatcattcattttacctacatagcccaaaatatgcgccattgtttcgccatataaataatggcgtttgaaataaggacgtacctctaaactcgggtattggtagccatttaccgcaaagcgtgaaatttgttcttctgttaaattcggctttaataaaatcggtgtataacgcgttccgcggagacgttcttttttaaaatgttcaatatcgttatccgtcaatcccacaatgtagcgtaattcatctaaagtgcggtctaaattttcagttttttccggcacaatgtataaaccaaaaaaagtaagattttcggctaataatttaccgtaacgatcatagattaagccacgcgttggcggtaaaggtaataatttaattcggttaccattagaacgcgttcggtaagtatcgaaattaacaatctgtagctgataaatattggtgaataaaacacctgttagtagcaaaatccccaaaaaagccactaacgttcggcgtgcaaaaaggctacgctccgcttttttatcgcggaacggctcatgagttggcgtattgaaaaattttttaaattcatctggctaaaaataaggatgtattattctcgatgataaggatgattagtagtgagcgaccactcgcgatacaaactttcagccactacaacacgaacaagtggggggaaggtaatgttcaatggcgaaagcgaccaactttgctctgcagcgggtttacaattcggc

SEQ ID NO: 435 - DNA, 4056 bp, H. influenzae
  misc_feature (4003)..(4003): n is a, c, g, or t
  misc_feature (4010)..(4011): n is a, c, g, or t
  misc_feature (4022)..(4022): n is a, c, g, or t
  misc_feature (4026)..(4026): n is a, c, g, or t
  misc_feature (4029)..(4029): n is a, c, g, or t
ctggtatacgaatatcggactcggtaccctttaggttcgttaatccttttacattttcagctatgaataatttgggttgagttatagatattacttctctcatccacatgtataattgtcctctattttcaattgagggttcatctatatttgatatttttccatgatgatttttgtgagaatcaaatcctaatcgttttccagctacagaaaaatcttgacaaggaaatccacctgttaatatatcaatgtcttttgggaaaatattgtgagtttcccgttctttttttacaagatcaacaatgctttctaagtggtagatttcgtttgcattcgctttttggtctaagaaataagaaacccatgctgctttagcatcaggtttaatatcattagcaaaaattgtctcaaaagaagtgggcgaaacggtaacccattcattttctgtggagctgatccattcagggtggagctcctcattaatagatttttttagacaagagaaactaccttcaaatccgatatccattcccccacaacctgagaatagagatattagtttcatttatcccccgaaattacatatggaaatgcgtttagatattgataaaagtgcatttatatcctaattagagttaatgttagaacaatagttataaagattttttccaatcatatatattcttctaacagtttaaggtcataataatctagtttggaattataagttaaaagtatgatattgtaaaaatactctattgatatacaaagtgcggttaattttgaaaacttttttgaaattgaccgcacttttttaatttaatctcttaagcaaattttctcaaattcactaaagaatgtaggaaaggttttggcagtacatttgggatctaaaatcgtcacaggtgtgtttgatagtgcgattagagaaaaacacattgctatacggtgatcgttataggtctcaatattggcgtgtttaaattgattgagtggaagcggttgaatatgaataaaatcttcaccttcttcgacttctgcaccgactttacggagttcagttgccatagccgttaaacgatctgtttctttcacacgccagttataaatattgcgaatgacggtttcgccgttggaaaaaagtgcggtggtcgcaatcgtcattgcggcatctggaatgtggttcatatccatatcaataccatttaattcagcgtgttcggcttggataaaatcctctccccaagtgatttttgcccccattttctctaatacatcagcaaataaacgatcgccttgaattgagtttttgccaatgcctgttactttcacttttcctttaatggcgccagctgcaagaaagtaagaggctgatgatgcatcgccttctaccaagtatttattaggcgaaatataggattgatttcccttaacttgaaatttttggtagtgatgattttcaaccttaacaccaaaatctcgcatcattgcaagggtaatgtcaatatagggtttagagactagttcaccgataatttctatttctgtgtcattttctgcaagtggcgcagacattaaaagtgcggtcaaaaattgagatgaaattgaaccatcaattttgacttttccaccttttatccctttgttgcgaattgcgagcggaggataaccctcattctctaagtagcgaatatctgcacccgcttggcgtaaagcatcgactaaatggagaattggccgctctttcatacgaggttcacccgttaagatgatttcgctttcggtttttccttttaagcaaagtgctgcggttaatggacgcattgcagtcccagcattgccaagaaagagtgaaagattgtcctgtatattgaatgttccacctaatccttctacttcacaaatagttttatcatcagacagttgatagcgtacgcctaatgctttcagtgcgttaagcatatgtcgaatatcatcgctatctaataaattggttacttttgttgttcctttagctaaggcggctaaaagtaatgcgcgattcgataaacttttagaacctggtaaattaattgttccttcaaccgcacttattggtgcaagagtaattttttccattacaacaccaccgttttatttttataaacaaaaattctatcgtgtaaagcgagatcaagggcgcgacttaacacggttttttccacatcacggccagcacgcatcatcgcttctgcattataagtatgatccacattaatcacattttgcataatgattgggccttgatctaattcgttattaataaaatgtgccgttgcgccaataatttttacaccgcgttcataggcttgttgataaggcttggcaccaataaaagcaggcaagaatgaatgatggatattaatcactcgatttggataacgtgcgacaaattcagggtttagcacacgcatatatttagcgagaacaatataatctggcgtatattcatcaattttttctgccagtaatttgtcgtgttctacacgggttaagttttcgtggctaactaaatgaaatggaatattaaaacgttcaacaagttcacgtaaattatcgtgattgccgattacggctgcaatttctacatcaagcgcaccataataatttttcattaaaatatcgccgaggcagtgagcttctttggtgactaaaattacaattcgcttacgttgggtgccaattaatcgacaattcgtttcttcgggtaagctatattttagatcttctaataaagtagcttcgttaaaaataccttccaattctgtgcgcataaagaaatgtttggtttcaaaatctacaaattcattattatgaagaatatttagttgatgtttgtaacaaatattagttatttttgcgattaagcctttatcatcagggcaatcagtgagtaatatttttttttcgatcataatgttgtgtgctatgtttagataaaaaaatagaacccataaaataggttctagtttcaaatagaaaaattaaatttcgaaatcagataatgatttacctttgttcaacgcattttgaattgggcgtggtgtgcgaccttgacccgtccaagttttatgctcgccattttcatcaataaacgcatattttgcagggcgtggagcacgttttgctcgaattgatacagtttttgtgccaaaaatttcgtgtaattcttcaggtgtaataccttctttttccattaattctttatatttagctaaacgctcttttcgctctgtctctgctttaattaattctgcttcattagcacgtttttcttcgatagctgtttgtaatttttctagggcattttctgcttgttctaacgttaattcacgtacagctgcacgtaaactacgaagatttgttaaacctcttactaattcgttcataataaacctcaataaataacattaaatgtgggaaaatttatttaataatagagaaaataaaatttattgtaaatatctattattaaataaatggtcgaaacagatatatttttttgtgtttattttctttatatttttattaaagtttataaaatttttataaaatctgttggcattttgtttgttttacggtaatctccccaatcactacaaaagtagaggcgcaattattataagtattttttcagagtggataacgaagaagaaaaaagaaaggaatagttgccgaaatcaaataaaagtcgttttgtttggttggtggcgtgctcgaaaggggcgacactgtcatagtttttctgattaactatggagtgctacggttgttctggtcttattctgtcctatgctttccgttctctccattaattataggtattatttaatggaacttattgatttttcatcatctgtttggtcaatcgtccctgctttgttggcgataattttggcgatagcaactcgccgtgttttggtttcccttagtgcggggattattattggatccattaatgttnaaggggnnatccccctagnagtncgnacctgccaggccagccaaggtctaggc

SEQ ID NO: 436 - DNA, 3599 bp, H. influenzae
  misc_feature (318)..(318): n is a, c, g, or t
  misc_feature (3557)..(3557): n is a, c, g, or t
tacgatatcggctcggtacccttacttcagcacgctgaattagcagaacgttgtgatttaccattggtcgcaactaatgatgtgatgtttttgaatgcagaggattttgaagcccacgaaattcgcgtagcgattcacgatggctatactttagacgatcctaaacgtccgaaatgttatacctcacagcaatattttcgtagtgaagaagatatgtgtaagctgtttgcagacattccttccgctctcgaaataccttattaattgcgcaacgttgtagtgtgactttgcgccttggtcaatatttcttacctcaanttccaactggcgatttaagtacagaagatttcttagtgcaaaaatccaaagaggcttggaagaacgtttagtttttttattacctgatgaaaagtgcggttagaaaaacgaccaaaatatgatgaacgcttgcaagttgagctagatgtaattaaccaaatggggttcccaggttatttcttgatcgtaatggaatttattcaatggtctaaggataacgatattccagtagggccaggtcgtggttctggtgcgggttcattagtggcttatgcattaaaaatcactgatttagatccgttagagtttgatttgctatttgaacgtttcttaaatccagaacgtgtgtctatgcccgatttcgacgtggatttctgtatggatggtcgcgatcgcgtgattgagcacgttgcagaaacctatggtcgtggcgcggtatcacaaattattacctttggcacaatggcggcgaaagcggttattcgagatgtagggcgagtgctggggcatccttatggtttcgttgatcgtatttctaaattgattccgccagatccaggtatgacgcttgccaaagcgtttgagaccgagccgcaattacagactgcctacgatagcgatgaagaagtgcgagcattgattaacatggcgcgcaagctgaaaggtgtgacacgtaatgcaggtaaacatgcaggtggcgtggtcatttcgccaaccttaattactgatttcgcaccactctattgtgataatgaaggcttacatccggttactcactttgataaaaatgatgtggaatatgcagggcttgtgaaatttgacttcctaggcttgcgtactctcactatcattaaatgggcattggatataattaatgttcgtatggtgcgtgaaggcaagcctcgagtagatattgccgccattccacttgatgatcctgaatcttttgaattacttaaacgttccgaaaccaccgctgtgttccagttggaatcacgaggtatgaaagatttgatcaaacgcctgcaacctgactgttttgaagatattatcgcattggtagcattgttccgtccgggtccgttacaatcgggtatggtagataactttatcgaccgtaaacacgggagagaagaagtatcttaccctgacgcagaatatcaacatgcaagtttgaaacctattcttgagccgacttacggcattattttgtatcaagaacaagtgatgcaaattgcgcaggtgttggctggctatacgctgggtggggctgacttattgcgtcgagcaatgggtaaaaagaaaccagaagaaatggcaaaacagcgtttagtgtttaaagagggggctgagaaaaacggtgttgatggcgagctatctatgaagattttcgacttggtggaaaaatttgctggctatggttttaataaatctcactccgctgcttatgccttggtgtcttaccaaactctttggcttaaaactcatttccctgcagaatttatggctgcagtgatgacatctgaaatggataatacggataaaatcgtaggtttgtacgacgaatgtttgcgtatgggcttaaaagtgacgccaccagatattaatatcggaaaacaccattttagtgtcaatgaacaaggcgaaattgtgtatgggattggcgcgattaaaggcgtgggggaaggcccgattgaagcacttgtggcggcaagaaatgaaggggggattttcaaagatttattcgatttatgcgctcgtgtagatttgaaaaaaattaaccgccgtacttttgaaagcctaattatgtcgggtgcctttgataaattaggcccacatcgcgccgcactttctaagaatttggaagatgcacttagagcttccgatcagcatgcgaaagatgaagcaatgggacaaacggatatgttcggtgtgctgactgaaacccatgaagacgtggaaaatgcctatgctaatacaccaccttacactgaaaaacaaatccttgatggcgaacgagaaaccttggggctttatttaagtagccatcctgttagccgttatttgaaagaactttctcattacacatcaacgcggttgaaagatctcgcaccaaatcgccgtggacaaattagcactgtggcggggctagtcgtggcatcgagaattgcgatgacgaaaaaaggcaatcgtctaggtattgcaacattggacgatcgttcaggtcgcttagatttaacattatttggtgaaagcctagaacaatttggtgagaaattacaaaaagatacagtgattgttgcttcagggcaggtgagctttgatgatttctctggtggcttgaaaatgacggtgcgcgagttaatgaccttagatgaggcacgttctcgttatgtcaaatccttggctattagtctttctgagcatcaaattacaccaagtttcattaaacaatttaaagcattacttgagccagtgagtggtggaacattgcctattaacgtgtattatcaaagtccgaaaggtcgtgcgttgttacgtttaggcgtgcaatggtcgatcattccaacagatgaaattctgacggaattggtgaatttactcggcgaaagtgcggtggaattagagtttgaataagacaaaggcgtgaaaaatatcacgcctttttataagattaacgtaagaaataacgataagatttgctttctgttacatcttcaaaaacataattgagttgggcaagtgcctgttcaaattctgcttgttcgcgttcttcaatttggaacccagcaaggatatttccatagtccgcaccgtgggcacgatagtgaaataatgaaatattccaacgattttgcaaggtttccaagaattttaataaggcacctttttgctctgggaattcgaaggtatataaacgttcgttatcattcgatgctcgaccacccattaaatatcgaacatgcgttttcgcaatatcatcatcagacatatcctcaacatcaaaaccattttttcgtgaggtctgcaataatatccgctttttcttgcttatttggcgttcctaccccacaaacacgcaagcacgtttatcatccgcttaacgataactgaattcggttacagctccgttacctattacataaccaaattttaagaaattacttgttgttcagtccggttacccctcataaacccttctattttaccaattcccacttttaaaaacttaatgtagnggggaaattcagtttttccataaaaacgcttccctattttca

SEQ ID NO: 437 - DNA, 4214 bp, H. influenzae
  misc_feature (2887)..(2887): n is a, c, g, or t
  misc_feature (4183)..(4183): n is a, c, g, or t
  misc_feature (4186)..(4186): n is a, c, g, or t
attaaaaagcggcactaatgaatccaacaaccgccaatttcacgcagcagtaagatgccatgcccaatcaaaaaacctgccaattaacgtaacaaggggggtaagtgggtatgtgatcacttgatcttttttaatcgaaaagtaccatttgtgtggctaaatataccactaagcaaacaaaaattttggcagaaatttcacgatcaagtcttccaataaatgaaccacaaataaagacagaaagcataataaccggagctaaaatgcgaactgcctgccagactatgttacataatttatgatgacgttgtgccgatccaatgccagtaatcacaatggtagcaaatgatgtgccaagtgcggtagacatcaacaaagattctggtacatctacaatgggcagtaaatacactaaggttggcacaattactaaccctccgccgataccaaataatcctgcaagaaaacccgctaatgcaccaacaagtaaacaaagaagaataaaagtgaacattattgaccttttgatttgtaaaaatggcgttttgtgtattttgtctgagaatattttttatttgccgaattagactgtgaatttgcttcacgagatgcggaaaatattggtggattatccgtaaataataccgaagcaaactctttcattacctttcgataaacatctcgcttaaaagacacaacttgacgaacaggataccaaaaacttacccaacgccacccatcaaattctggcgatttggtcgttttcatattgatatttttttcatcgccaacaagctgtagcaaaaaccagcgttgtttctgcccaatacacatcggcttgctatcataacgcaataaacgctttggcaatttataacgcaaccaatgtttagaaacatataacaaacgcacatctttaggttgtaaaccaacttcctcgtgtagttcgcgatacatcgcttgctcggcactttcattatcattaatgccaccttgcggaaactgccacgaattttgcccacaacgcttcgcccaaagcacttgccctttgcgattacaaatcacaatacccacatttggacggtagccatcaaaatcgatcactatcgttttaccttacatttttcctataaaaatagctcaagattgtttcataaatcagtgcttttatcaaccaaagggcattatgacaaaataatcatatcatcacgatgcattgccaccgcaccatattcatagcctaaaacattttcaatatctgctgattttctgcccttaattaattgtagagcatcgctgttatagcgtggcatacctagtacaatgtctttaccagattgagtgcatattttgactacttcaccacgcgaaaaacgcccttccacgttaataataccagcgggtaataaagatttattttgttcaagaatggcatttttcgctccatcatcaatagtgataatgcctgccgatggcgcggcgaaaagccattgtttgcgactttctaatcgatcagattggtgtgcaataaattttgtaccaatattttgttcataagcaagatctgcaattacatttggacgattacctggtgcaataattgtttcaattccagagcgagtggcaacatcggcagcaatgattttagtcatcattccacctgtgccaagatttgtaccacttcctcctgcaattgatcgaatgtgatcagtgatttgttctacaactggaattaattttgcttcaggatttttacgcggatcactatcaaataaaccttgttgatcagtcaataaataaagttgttccgcttgcacaagaatagcgactagtgcagataaattgtcattgtctcctacttttatttccgcagtcgccaccgcatcattttcattaatcacaggaataatgtggttatctaaaagtgcatgtaaagtatctcgtgcatttaaaaaacgttcgcgatcttcaatatcagcacgagttaataaaagttgcccgatatgaatatcataaatagcaaataatttttcccaagcctgaattaattggctctgaccaaccgctgcaagcagttgctttgaggcaatagtgggtggtaattgaggatgatttaaataatggcgacccgctgcaatagcaccagaagtcacgattactatacgaaatccatcattatgcagttgtgcaatttgacgaacgatttccatcatatgtggcgaattcaattttggcgaaccctgagttagcgtgctagtaccgaatttcacaacgattgtttttttgttcatagtcctttccaacgttcttaaaattgacattaacgttatcactaaatcaatgaaaaatcacttaatatcaggtatagtaacggcaaattttagggggatctatgacatttagtttaattgtggcgataacattaaataatgtgattggtaaagataatcaaatgccttggcacttgcctgcagatttagcttggtttcgtcagaaaaccactggtaaacctgtcattatggggcgtaaaacctttgaaagtattggtcgtccactacctaaacgtaccaatatcgtactttctcgccagctttttgaacacgaaggtgtgatatggaaagatagctttgaaagtgcggtcaattttgtcagagattttgatgaaattatgttgattggtgggggcgagttattcaaacaatatttacccaaagcagataagttataccttactcaaattcaaacagaactagatggcgatagtttttccctcaattgaattgggaggagtgggaaattgaatttgatgaatatcgtaaggcagatgccaaaatcgctatgatgccgatttttattttttacccgaaaataaatcaaataaatgaancaatacttctagaacattcattaatctagcaaaaacaaagagatgataatttccccttgagttcccctttttaaagtttcataatgacctttcattttatttttgatagttttaaatatcccatttttaaacattatcccaaatcagggaagacattatgacgaaaactgcaattgaaactccatcaaataaatctgtatcaaataaaactaaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagttttgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcggtggtatctaatgaacaaatgtggttagaagctaacttcaaagaaacccaattaacgaatatgcgcattggtcagccagtaaaaatccattttgatttatacggtaaaaataaagaatttgatggcgtgataaatggcattgaaatggggactggcaatgcgttttctcttttaccttcgcaaaatgctacgggtaactggattaaagtggtacaacgtgtaccctgtgcgaataaattagatccacaacaatttacagaaacgccattgagaattggtctttctgcaacggcaaaagtaagaatttcagattcatcaggcgcaatgctacgagaaaaaacagaaccgaaaacgttttttctactgatacacttaaatatgagaaagtgcgtagaaaaggggtnctntagagtcgactgcaggcagcaagctgtc

SEQ ID NO: 438 - DNA, 4151 bp, H. influenzae
gacaaatccaaaacatttttcaacgccaatgtcgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaggatctcaaagcaggcaagctacgcttaattggcgatcctgttacacgttatcaagaagatcctgtgcgcatgctacgctcaattcgttttatggcaaaacttgatatgttccttgaaaaaccaagtgaacagccaattcgtgaacttgcacctttattaaaaaatattccaccagctcgcttatttgacgaaagtttaaaattattgcaggcaggacaaggggtaaaaacctatcggttattacgccaatatagtttatttgaacaacttttccctgcattaagcgcatattttacagagaaagaagatagctttgcagaacgtatgatcgttaccgcccttagttcgacagatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgtgctttggctgcaccacgtcgtcatactgcggtcattcgtgacatttggttcttacaattgcaattattaaaacgtactggctcagcaccaatgcgtaccatggaacatccaaaattccgtgctggctttgatttactggctatgcgtgcagaaattgaaggtggcgaaaccattgaattagccaaatggtggcacgaatatcaatttagtaatggtgaacagcgcgaacagtttgatacacgagcaacaacgcttacatcctaaaccaaagaaaaaatactaccgtccacgccgtcgtaaaataacccgttcagcagagtaaggggagacacgactactgcataattgctctaggtagcaatttaaacacaccagtagaacaattacatgctgcgcttaaagcgataagtcagttaccaaacacgcatttagtaacgacgagctctttttataaaagcaaaccgctcggcccacaagatcaacccgattatgtgaatgccgttgcaaaaattgaaaccgaacttagtccgctcaagctattagatgaattacaacgtattgaaaacgagcaaggtcgagtgcgtttacgtcgctggggcgaacgcacgttagatttagatattttgctctacggcaatgaaattattcaaaacgaacgcttaataattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctagaaatttcaccgcacttttatgaacctcaaaagtgcggtagaatcagcccacatttttcttcattcatgacccgttatggaaagcttaactcaatatatccctgatgaattttctatgcttcgcttcggcaaaaaattcgcagaaattcttttaaaattgcataccgaaaaagcaattatggtttatcttaacggtgatcttggggcaggaaaaacaacgctaacgcgcggaatgttgcaaggcatcggtcatcaaggtaatgtaaaaagcccaacttatacgctggttgaagaatacaatattgcaggcaaaatgatttatcattttgatttatatcgtctagcagatcctgaagagctcgaatttatgggcattagagattattttaatacagatagcatctgcttaattgaatggtcagaaaaaggtcaaggcatattgccagaagctgatattttagtgaatattgattattacgatgatgcacgaaatattgaattaatcgcacaaacaaatttgggtaaaaatattataagcgcattttctaattaacttatttatgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataaatgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttagcacgacatgctacgagtaaaatagccgatcttgacgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaaccagcatcacatcctgtcggcacaacagttgaagttgccaatctttttttcaacacgccagcccgccgaaaatttttgcgcacagataaaacagaatttgctcatattgatgaagtcattcgtcgcattgctttaacaaaattcaatacggcatttacattaacgcataatgggaaaattatccgtcaataccgtcctgccgaagcaatcaatcaacaactaaaacgtgtcgccgcgattgtggggtaccgagtccgaattcgaatacag

SEQ ID NO: 439 - DNA, 4494 bp, H. influenzae
  misc_feature (4037)..(4037): n is a, c, g, or t
agagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgataccataccgaactcagaagtgaaatgttgtaacgctgatggtagtgtggggtttccccatgtgagagtaaggcactgccaatcatcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccattaaaaaacctttcattttcaataatttactacattgtaaaaattttcttgtgagaaataatcctattcttgtagtgtaaatgtgacatttattcataaactttattatgtgatcgcatttaaatacgtaggaatataataatttctaataattatttttaaataattttgaccagttttataattttacattagtatacgagtcttaattttgttgtaaggaataaaaatggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacagcagtaatgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatatatagttttagattcaaaacaacaaaaaacgcacttcacttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagatcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgtgctgcaggtaacttgtttgttgcaataaaatgcgagtacgggcaatttccacgagcaaattatcagagccggctaattctgtcgcttcaattaaatagcgatttgcactaaattcgtcgccacgttgttgagcagcttctgctgctttgatgagatttagtacaggttcagcagaatgtttagcatttttgccaattaatttttctgctttagcgtaatccccttcattcatttttaccaagccttcaagggtttgtttttgcgcttttacacgtttgcgattagaaaaccattgataagagctacgacttaaacgaaagaaacgagtgatgccccattcaaaagcataaattattgctaaagaaataatgaaaaaaatcactaaggtagtgatggacatttctataatacgatttgctgtctcaatgcgcacataaccttgctgaccagaaatataaggccctgctacaagtcctacaagcaatgtcagcattaaaaagagcactctaaacatagacttatccttattgttgtgattcagattgtgttggtttaacagcttctactttaggcattgtatcaatcgccttgtctgcttcaatttccactttttgtagatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcacttttttcaatattttgttgccagtcagtaatgttgttggataatttatcattatttttagatgtttcatcaaaatttacattcaaagcctgtaattcatcgactgtgtttgcaagctgtgacagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaatttcagctatttgttgctgaccaaaatagtatccagctccaccaatacctagcgcaacaagtattgctaataaactcaatgctgtacccgtttttttcacaatagtttgcggaacagactgcattgtttcagcttgttcaacagctgttttgggcgtatctgtaaagtgttcagtgaggtcgntagggtgctcttttgcatatcaattccttataagtgatattgagtaagggattttatatactttgcgtgataagaaaatatcaagctatccactattaatagaaaatattagatttttatatcggcagaattaagctatttacgcaataaaatagtgctatcctaccactcttaggtaaaaaagcatttttgattggtgatagggaaaacctataatatattttaaaaaaattgggatttatgccacatttttttgcattattcttccctagtggaaatttgtccccaattttgttgttctggaggggccccccctggaattgatttatcccaaccaaacaatgggttagcgccttggatccccccccgttttggccgccttctcaaggtcagcgaatcttccacccccttaagcgatgcgccttttattttacccttaaacaatcgaaaattccgc

SEQ ID NO: 440 - DNA, 4085 bp, H. influenzae
ctggtatacgaatatcagcctcggtacccgatttttggtttccccgcagcgcgatacgacttgttgcgcttgaattaattctagtgctaacgctggatcacccgtagtcagttgaatttccactttaggataacgctggcgaaattctttaagtacgtgaggaagatggctataagatgcggttacagaacaaaaaagtttaatttcaccgcaaaattcatcggatttatctttcagttgttgtttaaattgttgccagttttgccattctgttttagcaaattgcaaaaatttctcgccatattcagtaagtttgacttggcgattatcacggataaaaagtgtcttccctaactcgtcttccaatcgttgaatttgacgggaaagggtagagggagacatgtggttttgggtggcagttttggcgaagttttttgtatcactgaggtggatgaatatttgtaggtcggtaaattccataatttcttcttttattttatttaatttcgggtttcgccgatggcgacctactttttctttgctcatgcaaagcaaaagtaggcaaaaagaaaacacgccctgctttgccttatttcctgagaaattgaaaacttgcttaacggaaattttctgaactcgctacgctcaaacagacgaaaatttcctacaagtttccaatttctcaggcggcaaagaagggaactaatttgttctttcttcaatttaaagtgcgggtaaaatttagcgtatttaaaaaaataccagaaaactaaccgcactttttaataacgctctgatatattctgagccccatataaatcgcctttgcgactttcaattttcaggcaatttgcgtttgtttgagcgtagcgagttcagcaaattgccgttaagaaaattgaaacaaagcaaagagctgcgatttaattggggcgtgttttctttgcctacttcttttacacgagtaaaataaagtaggtcgctcatcgagcgaaatacgatgcaatccccaaaaaaccaacataattgcacaaatcgcaacattacattcccataatatcactttacgcaacaacaaaaaatcctataatcaaaccacaacaaaaaatatgcaaacacaacatcatacaattatcaaccttacacaattaaggacaacaaaatggctaactatttcaacacattaaatttacgtcaaaaattagaccaattaggtcgttgtcgttttatggatcgcgaagaatttgcagatgaagcaaacttcttaaaaggcaaaaaaatcgttatcgtgggctgtggtgcgcaaggtttaaaccaaggtttgaatatgcgtgattctggcttagatattagctatgccttacgtcctgaagcaattgctgaaaaacgtgcgtcattccaacgtgcaactgaaaatggttttaaagtgggtacttatgaagaattgatcccaactgcagatttagtcgtaaacttaacaccagacaaacaacactctaaagtggttgctgatgtgatgcctttaatgaaaaaagactctgcatttggttattcacacggtttcaacattgttgaagttggcgaagaaatccgtaaagacattacggttgtgatggttgcaccaaaatgcccgggtactgaagtacgtgaagaatacaaacgtggtttcggtgtgccaacattaattgcggttcatcctgaaaatgacccgaaaggcgaaggcttggcgatcgcgaaagcttgggctgctgcaacaggcggtcataaagcaggtgttttagaatcttcattcgtggcagaagtaaaatctgacttaatgggtgagcaaactatcctttgcggtatgttacaagcaggttctatcgtatgttatgacaaattagtggctgacggtaaagatcctgcatacgcaggtaaattaatccaatacggttgggaaaccattaccgaagcgttaaaacaaggtggtatcacattaatgatggatcgcctatcaaacagcgcaaaattacgtgcatttgaacttgctgaacaaattaaagaaagccttggtttcttatattacaaacacatggatgacatcatcagcggtcacttctctgcaaccatgatggcagactgggcaaatggcgataaagatttattcgcatggcgtgaagcaacaggtaaaacagcctttgaaaatgcaccaaaatatgatggcaaaattagcgaacaagaatactttgataacggtgtattaatgattgcaatggttaaagctggtgtagaattagcctttgatgcgatggttgcaagcggtatttatgaagaatcagcttactatgaatcacttcatgaattaccattaattgcgaacaccatcgcacgtaaacgcttatacgaaatgaacgtagtaatttcagataccgcagaatatggtaactacttattctctaacgtagcaaccccaattcttgcaaaagaaattatacccaaccttcaaaaaggtgacttgggcgagcctactccagcagtggaaatcgataacatcaccttacgcgatgtaaacgatgcaattcgtaaccaccctgttgaattaatcggtcaagaattacgtggttatatgacagatatgaaacgtattgctgttgcaggttaatgttaaattgaactgaattaaaaaccgactttatcaatataaagtcggttttttcatagataaaattaatcataaaaatgcacgttaattacaacgtgcatttttcttatttaagcatccatcgacatacaaagtaaagttaatggatgaatacaagttacgttagatgacatatcaatttgccatttacaggtttgacattcagatataacgtaatcaaatccaccctcgttaatattatcgaatagatttttaccaatagattgtgaaatttcatagttttctgatttaaaaccgtaagtccccgcaataccacaacattggcttggtaacataatgatttctaaacccggaatttttttcaatacttccaaagtataaggtgcccaaccagctttatctacgtgacaagcggtgtgataagccactcgaagtttaagtggtttcaacggtaatgttttaccttctttgaaaagctgatataaaaatggggttaccatatggatatgcggacggactttggcgttgtcgatacctaaaatatgatggtattcgtcgcgtaaattaagcgagcaacttgatgcctcactaatcacatctattccattttcatctaccatttttccaatgtaatcggtattgaattgtgcaatattacgagcgcgattaggaaaaccgtttaccattaatggtaagccacagcatttttctttttctaataacattaccccaatattcattgcattgaacactttaagaaattctttgccaagctgtggattattataattaacataacaaccgtggaaatatgctacttttcgctcaaatttttgttggtcttgtaacgcatttttcatataccaactacggaacgtgccaaacgcatatttaggtaaagtacgttctttactgattttaagcgttttttccaacataaatttggtggcttttaggcttgtgatggtgtttacaatcggtgctaatggcgtattaattttacccataacatctgtgttacttaaaatcgcatcacgcaatttattcattaacggttttttagactgcgctaagtgattattacgcgcacgtacaattaaatcgccaattttcacatcagacggacaagccacttcacaacgtttacagttggtgcaatatttaagtgcttcatcataaagttctgctgattttaagcgtaaacgctcgccatcaggccctgattgttttggaccaggataaagcggattgttgcgtgaaaccggacaaacagcagtacaagccgtacatttaatacagctttcaaaactttcgtcgatatatttatggctttcaggcgaattaagggattgttttgcactatcaatgagtcgttgaatattattatccatattattcccctatttcgctaagatttcatctgccactgccaaggcagttacaa

SEQ ID NO: 441 - DNA, 4528 bp, H. influenzae
attccaacattcaactttcagaagatatgttttacggctctacctgtaaccccaaattccgtaatcgctttaaacatttcggggaataatgaaattacccctatccacataaaaagcctactacattacgtttgtgcatacttgagattagaaaccagcgtcccaatccacttcaattgtttttgtggtgagatcgactcttttaactacttgttcatacaaaaacggaattaaccgctcttgttttccaaaagcatctttggtattggctttaaccactaatacatcattagaacccgtttccatcatttctgttactgttcccattgtataaccttctaagtttacgactgtacaaccgattaaatcgtgccagtaataatcgccctcttctagttctgggaaaacagataaatctacaccaatttcaacattcgctaaaattgtgcagtttcacggtcatcaacgccttttaatttaacgatgatttcgtgattatgataacgccagttttctaattcaattgattgccattcacctttgatttttaaaaaccaaggttgataatcaaaaatgctttcagcttgttctgttgatgaataaatacgcaaccacccacgaataccgtaggttgagcctaatttgcccacaacttcaatatgttgttgttccatatttttcacctatcttagtttgagaactaaatcaaaaagcaaaattatgctgctttttgtgcttcttttaccaagctcgcaacacgatcagaaagtgaagcaccttgagcaacccagtgatttacacgctcaagattaatgcgaagacgttctgcattaccttgtgcaattggattgaagaaacctacacgttcaatgaagcgaccgtcacgaggtgaacgactgtcagcgactacgatttgataaaatgggcgttttttagctccgccacgagataaacgaatggttaccataaccttcctctaaatgtttaattactaaaagaatattctcaaattcgaaagtgatttgagaatatagcttacttttttctctgtatatatagacaaaaagcctgcgaattttatacttttcaagcaaaattgcaagttttgtatgcataaagtaggttgtattccttttaattatcattcacaatttattttgttttgcgatataatacgaggcatccagctgttttaggtcaaatttacgcgtatagcggtattttagcttgataaaatatcagttaaatgaggtttattatgaaaattagttttcattctgtgttaattggattagcatcatttattggtgttcaacaaggtgtaatagctagtccatcttctcatcaatcaatatccactgaatcagctgaggctttgaagcaacaattttcaatggctttagctaaacaagacaaacaacaaattacaaatttacaaaaaaaacttaccgcacttttttctttacctccccaatttcttgataatcagatccaaataagcgaaaaaatcctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcgtatttagatcaacctcgagaaaatttacagcacaataatgatgcaattcgttacaaaacctttcaagcaatgctagaaggtttaaattaatcccttaccaataggagtttttatgcttttatccaaaaaatcagctacctttgcactcagtgcatttgcgatgcttttcactagtgtagctcttgccaaagaggcaccacaagctcacaaagctgtggaattaagtattttgcacatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattggtactgcatgcaggcgatgccattactggtacgctttacttcacgctgtttggtggttctgcagatgcagctgtgatgaacgcaggtaattttcattattttactttaggtaatcatgaatttgacgcaggtaatgaagggttattaaaactgcttgaaccattaaaaatccctgtgctttcagctaatgtgattcctgataaaagttcaattttgtataacaaatggaaaccttacgatattttcactgtggatggagaaaaaattgccattatcggtttagataccgtgaataaaacagtgaattcctcttctccgggtaaggatgtgaagttttatgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagagcctgtatttgtaatggaaggctgggcttattctgccgtggtgggggatttaggtgttaaattcagtcctgaaggtatagcgtctattactcgtaaaattcctcacgtgttaatgagttctcataaacttcaagtgaaaaattcggaaggtaaatgggctgaattaactggcgatgaacgtaaaaaagcacttgatactttaaaatcaatgaaaagtatttcacttgatgatcacgatgcaaaaaccgataagcttattgctaaatataaaagtgaaaaagatcgcttagcacaagaaattgtgggcgttatcactggttctgcaatgccaggtggttcagcaaaccgtatcccaaataaagcaggatctaatccagaaggttctattgcaacgcgttttattgcagaaacaatgtataacgaactcaaaacagtggatttaactattcaaaatgctggcggtgtacgcgcagatattttaccgggcaatgtaacctttaacgatgcttatactttcttacctttcgggaatacgttatatacctataaaatggaaggttcgttagtgaaacaagtgcttgaagatgcgatgcaatttgctttggttgatggctctacaggcgcattcccttatggtgcaggtattcgttatgaagcgaatgaaacaccaaatgcggaaggtaaacgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttgcctgatgcagaaagtttcataaaatttatgaaaaaacatccgcactttgaggcttacacttcatcaaatgtgaaatttaatgcttcaactgatgcattacctaaaaaataaaattgaaaaataggctaaaaatagcgcgtatttaacgcgctatttttgttattagtcctaggtttgaagacttcatagatgattaagaattttaactattccatatttagatgctttctcgtggaaaataaattccctataaaggttgaaaaatagggtgatttattgcgataatctaccccattttttgggagatctttctatcttctgcatttttacgcagtttattttcattagaaatgatcgaattttatttcacttttaatttaattagataaaaaacaatggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactgggggggggagcgcgtcttctatggatacccgtccctattattcccccctgggcattgattttctcctacacccaccgccgcaaaatctcctccctgcccgctccgtttttattcccgcccttgtccctgccgcccgc

SEQ ID NO: 442 - DNA, 5389 bp, H. influenzae
  misc_feature (3534)..(3534): n is a, c, g, or t
  misc_feature (3608)..(3608): n is a, c, g, or t
tatgcagggatgaaacgccgatttcagtcatttgattagatgcgtaggattttaagggtactcgacatacccgaaaaatcgccggtagccctgaaggaaattatttcgatattttattacgcggtgcagaagaatctgatgagctaaagtgcggttagatttgtggcaaattttggtttccaaaattttttacggaacaacgttttggcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattagttgggtttgtggcggggttttagcccaattccttacaaggggtttacgctctgcgctggagtaatgcaaatggcatttttcccttttgttatcaccgcattttgtttcacgtttagcacgtttcttgctagtagcaaattagctgatggggggcggggaaaattccagcaaaattggcgaaatctattgagattattggctggtcagtggttgtactggctataatcgcttactttatactgaaaaactagaatagaaaatgaacaaattaagtcttgttttagtagctggatatcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaataaaaatgaaataataacggaacaataaggaataactatgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgcttttacgtggtacggtaatttaatcatcatcaaacataatgatgatttcctaagtgcttatggcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaagatctctttanaaagtgcggtaaaaaatctcaacaaatttttaccgcacttttttattaaaaatattctgtgaggagtatcccanaataaaaaaataatagatgacaatgttaaattttatattattctgataatgcttcgtagttagaagtcagtgttaagttttattaagtatctcttctcttaaaaggagtttaatatgctcaacttgctctctcctaaccaaacttgggttcttgttgatccaagattatctttttattttcccataatttattaatcctttcttattaaccatcaaagtgttttcattttagaaaataattttttatttaaactaagcaaattaatttttggggattttgctatggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggaggtttagaaggtggtgcaatggaacgtttggctgttggcttgcatgatggtatgcgccaagaatggctggcttatcgtattgcgcagattgaatattcggttgcaggcttacaaaaaattggcgtgccttgccaacaaccaggtggacacacgacgctcgtagatgctgttaaattattaccacatattgcaggcgaccaatttccagcacaagcgctttgttgcgaactttatgacggtgcaggtacaagatcgtaagaaactggctcatttttattaggacgagattcgaagacgggtaaacaactaccatggtcagcggagcttctacgcttaactataccacgtgcgactgatacgcaaacgcatatggatttcattatgtgacgcttccattcgtgaaagataatgcacagatattaatggcttaacctttacttatgaaccaaagctctccgccactttacgggacgggtaaaaaagatgtatgactcacttaaaatgcagtccttttgaactgctttttttatcaacagatactgaataattgatttgaaatgatgtgctaggaaaaa

SEQ ID NO: 443 - DNA, 6250 bp, H. influenzae
  misc_feature (5866)..(5866): n is a, c, g, or t
  misc_feature (5940)..(5940): n is a, c, g, or t
  misc_feature (5978)..(5978): n is a, c, g, or t
  misc_feature (6009)..(6009): n is a, c, g, or t
tatataggtaattcgtttcaattgcctaattccttattttcaccttctacctcaatcgcatctgctattgctaacgaatttaatgaagcaggtggattacaaaaatctgcattgatggaattaggattacttctctttgttatcacaactatggtattgattttatcaagattaatgattacaaaaatgcaacaaacaaaagggaaataagatgaaaactaatcaaaacttgcgtttttattggcgtaaaacacacaataaattaatgttagggctttcctatatttcagtcattatcggcttattttggttgtgttggatattattcactctaattaccaaaggcattccagctttatcaattgatttattcacacaatctacccctgcccctaatgaaaaagggggattgttaaatgcactgattggttcgttttttattgtcggtgcgggtacattgataggcacgcctataggggtattggcaggaacgtatttggcagaatatggtcgttatagccgtttcgcacaaattacccgttttcttaatgatattcttctttctgccccttctattattattggtttgtttgtttacagcttatatgtatcaaaaatcgagcatttttcagggtgggctggagcattcgcattagctttattgcttattcctatcgtggtacgcactacggacaatatgttattacttgtaccaaataatttacgtgaagcagcggcagctcttggttgctctcaatggcaagttattatgatgatttgttatcgagcagctaaatcagggattttaactggcgtgctattagcagttgcccgaatttcaggagaaactgcaccgctattatttaccgctctgtctaatcaatttctatcttggaatatgaatgaacctatcgcaaatttacctgtagttatttatcaatatgcagcaagtccttttacagattggaataatctagcttgggcaggtgcagctctaataacattatttgtgctttgcttaaacattttcactcgactcttctttcaacataaaaaataatgaggcaatatgattagtctacaagaaaccaaaatagctgtgcaaaatctaaatttctactatgaggattttcatgcattaaaaaacattaatttacgtatcgctaagaataaagtgaccgcctttattggtccttcaggttgcggtaaatctactttattgcggagttttaatcggatgtttgaactatatccaaatcaaaaagctactggtgaaattaatttagacggtgaaaatttactcacaacaaagatggatatttctctgattcgtgctaaggttggtatggttttccaaaaaccaacgccatttccaatgtcgatttatgataatattgcattcggtgttcgtttgtttgaaaaattatcaaaagaaaagatgaatgaacgagtagaatgggcattgactaaggccgctctttggaatgaagtgaaagataaattacataaaagcggagatagtttatctggcggacaacagcaacgcttgtgcattgctcgagggattgctattaaacctagtgtgttgttgttagatgaaccttgttcggcattagatcctatttcgactatgaaaattgaagaactcattacggagttaaaacaagattatactgtggttatagtaactcataatatgcaacaagctacacgttgctccgactatacggcattcatgtatttgggtgaattagttgaatttggtcaaacacaacaaatttttgatagacccaagatacaacgtacagaagattatattcgcggtaaaatggggtagttattttgagctcactcttattaaaaagtaaaagtttggtgagaatgtattatttctcacttcactttttatgccataaatcaaatgaaggagtattatgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgcttacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaattttaagtagtacagaatttaaattgttacatttttttatgaggcaccctgaaaaagtttattctagagaacaattgttaaatcgtatttggcataatgatctagaagttgaatatcgcactgttgatagctatattcgccgtttacgccgtaatttagctccttttcaatgtgaacattatatccaaacagttcgaggatctggttatcgattttctagttatttacgagataaacaatgaaaaaaatattgaattttattgttgaaataaatttggcaatcattatttccttatttacttctgattttattctttggtttgcaataatacttttattaattttagcttggcatcatattaatgaatatcgtttactcaaatatctcaatttaaagcaagataataaattctctttattacaattaggaacattctctcaaactgaagcctaccatcgtcatcaaatttacaaagaaaaatgtgcaagtttacgtttgttatctcaaataaataaaaatattaagtatttaccagatgcaattattatctgtcagcataatggtaatatttcttggtgtaattcaattgcgcaacagatgtttgatttttgttggaataaaaaagtccagaaaaatatttttgatgttattttttatgaacaatttaaacattattttttcagtcaaaaaaaaagacgaccgttagtactattaacttataatcaacgttatattgaggtgcagtcgcacgcttataattctcatatgattttagttatcgctcgagatattacagatatgattcatttacttaattcacgccaaaaattcttgagtaatattaatcacgagctacgtactccattaaccgtattacaaggttacttagaaattcttgcagataataatattcagaaccctctacaaaaaaaggctatttttgcaatgcaagagcaaagccaacgaatggaacatctattacaacaatttaattttttagcaaaaatagaaacaacttcagataaggattttcgtaaatttgatatgtcagccatgataaattctttaagaaaagatacagatatattaaatacttataatcatcatattgaatttattattcagcctaatatcattatttttggaaatgaatctcaactaagaagtgccgtttcaaatttaatttataatgctattaagcattctggtaaacagtgtcatattcaaattcaatgggaaacttgtgaacagggtattaaatttaacgtgatagataatggtgttggcatatcaccacagcatattccacatttaacagaacgtttttatagagttgatgaatctcgtagccatttaactggtggaagtggtttaggactagctattgtgaagcatactttattacaatatcattctcatttaaatattgaaagtactgaaacgaaggggagtagtttttcgtttatcatacctaaacgctttgtcatatcaaaaaataataaagaaattcaatgataatacgcgttgcaagtattagctgacacggtagtaaataacacatcagaaaatcgaaaatagcgggctagtggagagcttagatacataaaaaacacagcttggtagtttttcacccatctaaacttatattatttagattatgtagcagttgctaaatcacctaaatctttatcaatcaagcataaatctttaaatgctgcagtactttcacacccatgaatcgaacactgtaaataaacatcatagtatggctctaaattaatttactcgttcatcttatttgattaagtataactaattaagagaggagaaataatctctttataacctataattaaagttactttgcatttttacaatttaacataatatacattatgcgaaattagttatcaggttagcggaaactacggattaaataaatcacacagttatgcacaagtcacaggtactagcaaaacaagacaaaataaggctagataacacgttgtaacgcgtcattttatagagttattgaacggatgaattgaaatgtaaaggaaatgtaaagtgaaataagcttaaatctatgtgattacgctacgtaaaatctggagaatttcttggatattttcttccctgaaaaacaacaaaaaaaagcacgtttttattaaaacgtgctcttctaaaaaatgtgacaacgtatcgactaacctagtaattttataccatattcatatacttgttgtagcaaagatagtttttcagaattatctgaatgttcctcggctaaacgttgtaaacctgattgaaactctaccgcacttttttcaagtttattctgtcggtatttttgccatttaatttgttcagcgcgtgtgagggttttataaaagtggcgagcacgataatggaacaataattcaaggatacgtttatcttcaaaagctaaaccatgttcagataatttttctgcaggtaaactacgtaaaatagccatattatttttatcagcattgctaaaaaagccattgtataactcagtttctacattatcattcgatgcaaattgacgttcttcattaaaaatatccgccactttttcacgaatatcaaaagatgctcgtaattttgcaagattatccaagcataattgtcgatcaatacccaatcgatttgctgtttctggtaacaaagttttagctggtgctaaaataggacatttattaatatgcacaagttttaacggaacggatgaaactcctctttcttctaattcagattttttggtatataaatctgtccgtaattcatccgcacttttggctaataaattatcgatatcgccagttaaatcacacacaattaatgcattttgatttgtcggatgccaagataaaggtgcaacccaagtgcaatttccacgataattccctagcattccagaaacatgcactaaaggtgtcattgcgcctgtatcaactaatttttcgatttcttttttaccgcgattttcaaagaaatattggaataatttaggctgtttttctttaattaatttcgccatagcaatagttgcatatacatccgccatggcatcgtgagcattttcatgctcaataccatttgctttagtgagtttttctaagcggaaacttggcattccatcatcgtcataagcccaattaattccttctggacgcaaggcataacaggctcgcactaaatctaacaaatcccagcgtgaattcccatttttccagctgtattcataaggatcaataaaattacgataaaacgtataacgcgtcatttcatcatcatagcgaatattgttataacccatgacacaagtattgggttgggaaaattctgctaagatatttgcggcgaattcaggctctgaaagccccttttcattacattcttgaggcgtaattcctgtgaccattacggcttcaggagccggtaataatcgntggggtttgtttacaataaaacttaattgggttaccaatgatattaaaatcagcatctgtacgaatacccgcanattgcgcaaggcggatctgttgcctgggattacaccanaactttcataatcgtaaataaaaaagctganatcttttgccatgactactctcttttacgcaatagtttatctaaatatataagcagaaatagccgataactaaaatagacctagccatttacttactggattttttcttaaaactaaggcgccggaatcgacctaggcaataacccgatattattccgcgaacagcgggggattcagaaaaatttgatggctttataataaaaaaaattaggaattcatccccaaaacagcgcatacctgg

SEQ ID NO: 444 - DNA, 3273 bp, H. influenzae
  misc_feature (3028)..(3028): n is a, c, g, or t
ccgttattggtgttttagcaggttgtgaaatctggccagatggcaatgcttatcgcccatgcgatattcttaccactatgaatggtttaactgtagaagttcttaatactgatgcagaaggtcgattagtgctttgtgatgcacttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctggggtggcgcaattacagcgggtgcatttttgtctaacttcacgaaaaaatatcgctgggcacatttagacatcgcaggcactgcttggttacaaggcgcaaataaaggtgcaacaggtcgccctgtttcgctattaacccaatttttgattaatcaagttaaataaccacaaaactggcacacgttgcacctttaaatcgattactctgctagttcggtttgctcgtgtgccatcagttcctgacccacatcatcaagcaaacttagataacgttcatattgtttcaacatatcggcaatcaattcatcttgatccatatattgaacatcgtaaccgactcgtccatcaaaaaaataagtgtaaggctcgtaagtaacactatgctgaatgtgcggtaaattttcatcgttaattaattgctctgacacttctcgcccaacagatttaataccatacataaaatctcgcattgattctttatgaattaccaattccaaagctggctcttcttgttcaaataatgtgttgatttctacacttaaattatattttcctgttaattcttgacgtaattctcgcatagcgggtaacgccgtatttttaaggaaacgtaaaatatctttctcttgcgtttggttcatcatttgctctaaatgtgatttccatttatcgccgctccagaaaatactagttggattgactttagtagaaaaatattttttatccgcaattaagcctttccataaactaaaacacattaccaacatcaataaagcaaaaggcaaggcaacaattaatgtcattgtttgcaaattagcaagtccaccagattgcattagcacaattgcaacaactgacatcaaagtgccccacattatggcttgccacgcaggagaagctaaacttttatctcgagatgcaatgttatttaacacataaatacctgaatccgctgaagtgataaaaaacaatgaaatcactaataagctcacaaagcctgttattgttggtaaaggcagataatttaaaaatttaaataataaaatttctggggaagaaataaattcgccaagcccgcccgcagcaatgccatcatttagccatactgctgtattaccaaaaacagtaaaccataaaataccaaataaacttggaataactaatacgccaaaaataaattcacggatagttcgccctttagaaatacgcgcaataaataaacccacaaacggagcccaagaacaccaccaagcccaataaagcacagtccatccgctaaaccagctagtatgttcttgttcataagcataggttttaaaactgagttgcactaaattgctgaaataattaccaatattgtcgctaaatgcagataaaaggtataacgtagggcctgaaattaaaacaaaaagaagtaaacaaaatgctaaagttaagttaatttcacttaatattttcacgccttttccaataccagaaatagcagaaaacaccgctaaacacatcaccacaacaataacgccaacttgtaaggaaaagctgttctgacttatccaacctatttgttcaagccctgcaccaagctgtgatgaaccaaaacctaatgtagtaataatcccaaataatgtggcaagtaatgccataacatcaatcgcatcgccaattttgccattaatacgatctttttataaaggataaaaaccagagcgcaccgttaaaggtaatttataacgaaaccccaaaattagctaatgctaaagcaatggtgccatatactgcccacgcgtgatttccccagtggaacaaagtatgaagtaaagcctcttgttgtttatgttctgcaggaacctactgtaatgtcagaaagataatgggttaatggttctgctacgccaaaaaacatcagcccaacccccattccagcggcaaataacatcgcaagccaagataagaaactaaattcaggttcttcttcatcttgccctagttttatattgccaagactacttactgataaaattaataaaaatcctaaaaacactgaaaaagtgagtacataaaaccaactaaaattagcaaaaataccacttttagcttgattcaataatgcttgagtttgctctggcgcaataaaaatcattgccatcagtaacaatataaaaaataacgtaacgccaattaccaaaggattaaatgacgttcgctttgtcataaattgagataaagacaaacttttccccttaacgattaaatgaatagattaaaaatagatttaataaacattgcctagaggcaaaaatgtgtaatggaaccactacaaaggacagcacatagaagtgcgattttgaaggaaacgttcagtaggaattgaaggattgtttccaaaaacttgtgtatattaacaaaatacagtcattatttcaaattagtgaaagctaaactaaaaaatgcggtaaaatttacaaaataatttaccgcacaaatatcatttattttaaagccatttctacaaggatattattgcttttaagccaattcttctcccctcttttacaacattttctaaccgcactttaaatccgtgtaattccgcaattcgcataacaatagaaagtcccaagccacttcccttttcattntgcccagctggacgataaaaacgctgtccaagttttttcaaatcttcaggttcaacgccaccaccattgtcctcaataataatctgggaggatgaaatttttactggaacgattgtatcttcaggacaatatttaatagcattggcgagtcaatttctaagcttcatgaaacttacattggctgccctctgttttggtttgggtcaaatctttctcaaacccaggtattttatgttttttcgccc

SEQ ID NO: 445 - DNA, 3832 bp, H. influenzae
  misc_feature (3631)..(3631): n is a, c, g, or t
gagacccctttcgtaaggtggaaagagaaatatatgaaaaaaacaatgttattaaatgcacaactttctcgttgtatcgcttctgttggtcacacagaaagtttgacgatttgcgatgcgggacttccaattccgttaagtgtggaacgtatcgatctcgcattaactgcgggtgtaccaagttttctacaaacgttgaatgtagtaacgaatgaaatgtatgttgaacgcgttgttattgcagaagaaattaaagaaaaaaatccagaaatattgaccgcacttttaacacaacttcaacaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattttaatcagggtgaaattatggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtacatgttggcgcgaagaaagaaatttgtcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaataagagtaggtaagtatgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaactcactttaaggagaaactatgaaaaaactaaccgcacttacttctgctgtattattaggtttggctgtttctggctctgcttctgcacaagacacaatcgctttggcagtatctacattagataacccattttttgtaacgttaaaagaaatggcgcacagaaaaaagcggatgaattaggttataagttagtggtgcttgattcacaaaatgaccctgctaaagaattagctaatgtcgaagatttaactgtgcgtggtgcaaaaatattattgatcaatccaactgattctgaagcagttggcaacgcagtggcgattgcaaaccgtaagcatattccagtaattacattagatcgtggcgcatctaaaggaaacgtactgagccatattgcatctgacaatatcgcaggtggtaaaatggcaggcgattttatcgcacagaaattacgcgattaatgccaaggtgattcaacttgcaggtattgcattaacatctgcgtcctcgatcgaggtgatggcttccacaagctattgttctcacaaaactatagtctttttactcttcctatatatttgtcggttcttttggtctgttgtctctttctttctttttcacttattgtttttttgctcttttttctggtttttttttttatctctccttcttcttttttgtcgttttcttctttttttttnattcccttctctcttttttctttttctttttccccctttttttttttctttcctttttttttttttttcttttctctttttcccctctttttttcctctccccttcatctctatcctccccttaattttcttattattctcgttactctccttccctcttcccctcttctcttcacatttaattctctatttctttctgtt

SEQ ID NO: 446 - DNA, 4166 bp, H. influenzae
tggtatacgaatatcggactcggtacccaccctattaaaaaatactccaagtttggaaaaacataaaatattccttataaaaaatcgctaaaaaactaaccgcactttatttcagtgtttgagctaatgctttaacccaaggacgttttgcatcttctttcaataattccacgcgataacgaactaaagtaagccaaatatacaaggtcaaaaaaccgaagatacataaaattaatggaaccaacattggaattgcaatggatggtttttcaaatttggtaatactcgccccttgatgtaatgtgttccaccactccaccgaaaaatgaataatcggtaaaatcacgaccgttgtaatgcataaaatccccgccgcttttgcacctatgttacgatctgaaaaagcagaataaagggctaagataccaagataaagaaagaataaaatcaattctgcagttaagcgagcatcccacacccaccaagtaccccacattggtttcccccaaattgcccccgtaacaagcgataagaaagtaaacaatgcaccaattggcgccattgcaatcattgcgagatgagcttgcttaatttgccacactagggcaaccacagctgcaatcgccattgaaccgtacacacccattgaccaaatcgctgtcggcacatgtacatacataattcggaaactattgccctgttggtaatctgctggggcgaatgctaagccccatacaatgccaataccgagtaagataagcgttaaaaatgcaaataacggactcaatttaccgcagatacgatattgagtttcaggttttgcataaggatgtaaccacttccacataaaaaagatccttaaaaattaaagagaaaaaccaccgcacttttatacaatgaaataaaattaattatctaaactaattcgcaacgctgcagcaatggcaaaaggcgaaagcgttactgcaccaaccatcatggcacctaaaatcgccagttgtcccccataaggcacatttaatcctgctgcttctagtattgatgaagcaaaaattaaaacaggaataaacaacggaacaacaagcaaactcaacaacacgccaccttttcgcaatcccaccgttaaagccacgccaatagcaccgatacagctcaatacaggagtgcccagtaacaatgtcaaaaccaatgcccaccaaatattgacctcaagagaaagcaacaaagcggcaataggtgatagcaaaataagcggcaaaccagtgagcaaccaatgtgcaacgactttagccaaagctgtcattggcaaaggctgtgcagttagcattaattgttcaagagagccatcaataaaatcatcacggaataaacgttcaaaagaaagcaatgctgaaagtaatgctgctacccatgcgatacccggtgcgatacgggaaagtaatttaggctctggcccaataacaagcggaaacaaagtaatcacaagcaaaaagaaccatagcggatttaaaatctccgcatttttgcgcattgcaatttgaagttctcgtttaattatctctaaaaaaatcattaagttattccgctttataagccgctaaattcaatttttgcagatgagaacttggcacttcttggtggctggtcaataacacaatacctccacgttgagcatgctcatcaaaaagtgcggttagaatttccacgccttttttatcaatcgcagtaaagggctcatctaaaatccataagggcgcttgagacagccataagcgacctaacgcgatacgtttttgttgtcctgcagaaagttgtgcggcaggcaaatcttcacgccctaataatcccactttctcaagcaaatcccacaacatatcggtgttttgttcagcttgactaattcgttgataaaactgcaaattttcccacgccgttagctctggtttaacgcctaaaagatgtcctaaataaagcaaattctgatgatactgttcacgttgtttagaaattgcttcagcatcccaccgcacttcgccttctaaaggttgggctaaaccagcaagaatacgtaacaagctcgttttacctatgccgttatgcccttcaatttgtacaaaatcaccgctattaaaatcgcaagtcaaagcacgaaaaagtacgcgctcaccacgttggcaggataaattttgcagagataacttgtgttgctcaaacataattacagagggaaaatagaaagtggtggtattctaatatttgatgaaattttcgcaactcaaacacataactctttagaagtagatcgataggtttattgatttaaaacaaaatttaataaattcactttttaaaaaaggaaaaacatttaatgatctaaatcaatttttttgctattatttgctcaattttggttatagaccaaaacctcaacgaaatctgtttttaacaatagaaggaatacattatgtcttacactctccctgaattaggctatgcctacaatgcgttagaaccacattttgatgcgcaaacaatggaaatccatcatagtaaacaccaccaagcttacgtaaacaatgcaaatgctgcattagaaggtttacctgctgaattagtagaaatgtatccgggtcatttaatttctaaccttgataaaattcctgcagaaaaacgtggagcattacgtaataatgctggaggccacacaaaccacagtttattttggaaaagtttgaaaaaaggcactactttacaaggcgcattaaaagatgcgattgaacgcgatttcggttctgtagatgcatttaaagcagagtttgaaaaagcagcagcaactcgtttcggttcaggttgggcatggttagtattaaccgctgaaggtaaattagccgttgtatcaacagcaaaccaagataacccattaatgggtaaagaagtggcaggttgtgagggtttcccacttttaggtttagacgtttgggaacacgcttactacttaaaattccaaaaccgccgtccagactacattaaagaattctggaatgtggtaaactgggatttcgttgcagaacgttttgaacaaaaaacagcacactgtaactgtgcaaaataataaacataggaaaacctagcaaaagttaggtttttctgctttcctctctataacttttcttttgcaatcttttttatcaaatctgtatcttttacaggcttattatttataggcatttatcaatgtttattttccataaacaaagtattattaaaattcaataaataatgaagaaatgtaaagcttctttagtgaggtcaaaaagaatgttactatggcaaaattttaagttattaaaaatagaatttatcactattttttataactatttttatgaccacattaaagttaagccaaaaaaatgtgttgctataaataacaaaacttaatctttaaattaaacgaatctaactttttaaggtcatataaaactgattgaactttttatttataaacgagattttaatgaatcaaaatctaattgaagttaagaatctcacctttaaacgcggtgatcgcgtgatttacgataacctgaatttgcaagtaaaaaagggaaaaatcactgcgatcatggggccgtcggggattggtaaaaccaccttacttaaattgataggtgggcaactaatgccagagcaaggtgaaattttgtttgatggacaagatatttgtcgtctatctaatcgtgaactgtacgaagtacgcaagcggatggggatgttattccaatcaggtgcgctttttacggatatttctacttttgataatgtcgcctttccaattcgtgaacatacgcatttgcctgaaagtttaattcgtcaaatcgtgttgatgaaattggaggcggttgggttgcgaggtgctgccgcattgatgccttcagaactttccggtggtatggctcgtcgagctgcattagcgcgcgctattgcgcttgaccctgatttaattatgtttgatgagccatttacggggcaagatccgattagtatgggcgtaattttaagcctgattaaacgattaaatgaagcgttaaatttgacttctatcgtagtgtcacacgatgggaggaagtatgagtatggggtaccgagtccgatattcggtacca

SEQ ID NO: 447 - DNA, 4248 bp, H. influenzae
tggaggaatgtgaacgtggggaccctcgaagacaccaaggtggggtacggggacaacggggcggaaaacgagtcgtaagggttaatgcagcgagcgtggggtaaactatgttctgatatacgagctaatcaaagtagagttaaacaagatccaaattatatacgtactattgttcgtaatgatttattgccttacgtaaacttagaatatgcaggttctaaagtattaggttcatactacgaatcaacctctacagagcaacgagaaaaatttttcaagacttttggtgagttgattgagcaaaagtacgcacaaacattaacaaattattctaatcaaaaaattcaaattgaatcagaaaaagaattaggcgataacaattttgtaaatattcgcgtaagtattattcaaactaatggcgttgctccgatcctattagattttaaatggcgtaaaggcaataaaagtggggaatggaaagcctacgatatggcagcagcaggcgtaagtatgctggaagatacgataaaaaattgggttggtattttaaacaaacaaggtattgatacattaatcacaaagatgcagcaatctgcctcacaacctataattttcaatcaataaatgaataactatgctaaattgggatttgcaaaaaaataatgataaaataacgctctttttgtttggggaactatctcgcagcaccttgttaccaatgtggcagcaacgtggcgtttttttgtcagaaagtacacttgataaaactattgttgaatggaatttatctggtcttcagcatattgattcagctggttttacagctctttgtgattttttacgagagtgtcaaaagattaacaaaacagtacgattagtttatccaccaaaacaattattaaccctagcagatcttgttggtttatctgattggatcgcaaattttacatagcttacttaaacggaaatccaatggaacttcaaaaaattgaacaaattttaaaagacacgctaaatatcgtagaagtctatgcacaaggtgaaaatgcacattttggtgtaattgtagtgagtgatgaaattgctgcactatctcgtgtaaaacaacaacaaacgatttatgcccctttaatgccttattttagcactggtgaaattcacgctctaaccatcaaaacttataccgtagaaaaatggaaacgcgatcgtgcattaaaccagtttaattaaggatttaaaaatggataaatttcgtgtttatgggcaatctcgtttaagtggaagtgtgaatatttcaggcgcaaaaaacgccgcacttccaattctttttgcggctattttagctacagaacctgttaaattgacaaatgttcccgaacttaaagatattgaaacaactttaaatattttgcgtcaattaggcgtaattgcaaatcgtgatgaaactggtgcagttttattagatgcctctaatatcaatcatttcactgcaccttatgaattggttaaaactatgcgtgcttcaatttgggcattggcacctttagtcgctcgtttccatcaagctcaagtctcattacctggaggttgttctatcggagctagacctgttgatctccacattagcggtttagaaaaattaggtgcggacatcgttcttgaagaaggatatgtaaaagcacaagtatcagatcgtcttgttggaactcgaattgtaatagaaaaagtaagtgtaggcgcaactttatctattatgatggcagcaacccttgcgaaaggtacgactgttattgaaaacgccgctcgtgaacctgaaattgtagatactgcagatttccttaataaaatgggtgcgaaaataacaggtgcaggttctgatcacattacgactgaaggtgttgaacgtttaactggttgtgagcacagtattgtgccagatcgcattgaaacgggtacattcttaattgctgcagcaatttcgggcggtcgtgttgtttgtcaaaatactaaagcggatactttagatgccgtaattgataaactccgtgaagctggtgcgcaagttgatgtaactgaaaatagcattactttagatatgcttggtaatcgccctaaagcagtgaatattcgtactgcaccacatccagggttcccaactgatatgcaggctcaatttactttattaaatatggtggcagaaggtacaagcattatcactgaaacgatttttgaaaatcgttttatgcatattcctgaattaattcgtatgggtggtaaagctgaaattgaagggaatacagcggtatgtcacggggttgaacaattgtctggcacagaggtaatagcgacagatttacgcgcttcaatcagtttagtgcttgcaggttgtatcgcaacgggtgaaaccattgtagatcgtatttatcatatcgatcgtggttatgaacatatcgaagataaattacgtgctctaggtgcgaaaattgaacgtttttctagaagtgatgaagcgtaattaggtacgcgacttttctataataaattacaagtttatttataatcttaaatttctattaatgcctttctttagaaaggcatttttttactgaaattttataagagtagattgattgcattgtttagaaacgtatttttctacaagaaagtgcggtagattattttcttattttgatagtaatcacttatatcaattttttataactaaaatttataaaccataaataaataatctttttttttcataagtttggtttttataatcacgcttagacaaacacaacacaaggaagaaaaaatgaaaaaattactttttacgaccgcacttttaactggagctattgctttctcaacgttttctcacgcaggcgaaattgccgatcgtgttgaaaaaacgaaaactttattagttggaacagaagggacttatgcaccatttactttccatgataaaagtggaaaattaacaggctttgatgtagaggttattcgtaaagttgctgaaaagctcggtttgaaagtggaatttaaagaaacacaatgggatgcaatgtatgcggggttaaatgcaaaaacgttttgatgtgattgcaaacccaaactaacccaagcccagagcgtttaaaaaaatacagtttcacaacgcccttataattattctggtggggtgattgtaacaaaatcatcggataacagtattaaatcatttgaagatttgaaaggtcgtaaatctgcgcaatctgcaacaagtaactggggtaaagatgcaaaagctgcaggtgcgcagattcttgtagtggatggtttagcacagagcttagagcttattaaacaaggccgtgcagaagcaacaattaatgataaattggctgtattagattattttaaaaaacacccaaattctggtttaaaaattgcttatgatcgtggggataaaactccgactgcctttgcttttttacaaggtgaagatgcattgattacaaaatttaatcaagtacttgaagcacttcgccaagatggtacattaaaacagatttcaattgaatggtttggttatgatattactcaataattggttggcgagtcttccatttatgagtgcagaacgagctgattatgtaatcagctcgttttggcctatgttggaagcagcaattttatacacattgccattggcagtcatttccttcttctgtggtttgcttattgcagtgattgttgcagttattcgtactttgcctagccctaatttacccttaaaattgttacaggctttatgtcgagtgtatatctctataattagaggtacaccgatgttagtacaaatttttattattttttatgggttacctgaagtcggtattactttagagccttttccgacagcgattattgcattttctattaatataggtgcttatgcagcagaaactgttcgtgcttcaattattgctatacctaaagggcagtgggaagcctcttatgcgataggtatgaattatcgacaagcatttattcgtacaattatgccacaggctttacgtatttcagtaccatcgctttctaatacttttattagtacagtgaaagacacttcattagcttctcttgttttagtgacagaattattccgtgtcgcacagaatattacggcagcgaactatgaatttattttaatttatagtgaggcagctttgatttattggattttactgttttgttttaact

SEQ ID NO: 448 - DNA, 2825 bp, H. influenzae
tggtataccaaatcggactcggtacccttcaccgcactttttgtaaacgtctataaaatagtcaaaatcttgttaattccacattgacgcgcataagcagatagcgcattagtttcttccacacttgggatatacgctgataacccagcttcatcacgtacgcctttgctatgcacgcagataatttttaatgccacatcaggataatttcgtagtagttgagcaactttgcccaccaaatgttcagcatcaaaaaaatgctttaaaaaaaccaaccgcacttcttccactttatttaatggcaataaggcagctaaattttgcaaattccgctccagtttatcgttttttatatgcaaacgctctagtatcacttgctgtgatacaatacctgcttgatttttccgatcaaaacaaagtgtttgcaagccaatgccctcgcctttgagatcaaataaaaatttgtcagtgacatcaattaacgaacaaacacgatcaaactcaaaaaagccactactatccaaataacaagtcaatccttgcgaacgtaaagccttaaagagtggcacaagttttttgtgatgaatagtgggttctccaccagaaaccgttacaccgcgaataaatggaactgcctccataacctgttcatacaaatactgcaaactgaccaatttcgcactttccgtataacgaggtatggtttccggattatggcaatacaagcaatttagcttgcaaccttgcagaaaaatactcgaacgattgccttgtccctctacatttgaaaaaggaataatccgatgcaacggcacaaaaatctcagaaagtgcggtcatttttctaattatttttcagcgatcacatctttttcattgcgtaattggcgatcaaacacattggcacattcatccgtacccgagccataccaagttgtatcgcgtaatgcaacttcgcctttacggtatttttcaacttcgcttttcttcactagataacctgtaactcgaattaaatctgtatttttcaaataggtggtaatgtagcgatagcctaaggaaaatgcgccatcaataatatccaccactgcatcgcagtgatctacataggtttgatcaaaggcgaataaatcccctgtaccagatgggaaatatttatggaacggtgcagattgtttcaaatgtgcaagtaacgttggttcttcgcctacacgaatacggtgagccggtgcgttacgcttgtcttcttcgtggttacttgcgcccacttgtgcgtgtaataaataacgattgccagtacgttcggcataaactccttcgtgcgcatcagtaatttctttcaatttatccataatcgcagtggcaatttcatcgccacgaacgctcttaccaaaggtttcatttaagccttcacattgcaataagtggtttgctgcatctgccaagcccacaattgcgaacatccccgtaaaattagtgcgtttgataaatccctctttttcgaggaatgaactgttaaagaaattactttcttccactacaaatttgtggcgtttatccatggttgaaagagcacatttcgccacacgcggtaataattcattcagcatttcatccgcacttttacaggtgcgagcaattgtccctagacgtaaacgcgttaaggtgtaggcgccgccacattcaggcagtgcgttatagcaacttgctacgccgtattcttcgcctagatcggaaatatagtaagcatcgttggcaaaagatggtttagaaaccaacaaacaggcttttgctgcaagttcagcaaaatcacggcttgttttcgatttgtcataacgaatagtcatattcggtgttggcgcttcaagctcaatcacggcgcgtaaaatcaagcgacctgctttcgtatcataaggcccaatattggcatgacagaatgagtcaggcacagttttatcaatatgatttaagaaacgtttaatttttatgtaatctttttcttcatcagtaatgaacggttcgagcaacacatcaagacgcccaacataaacaggataagtcgtaatggatggcacgcgggagtaaagaatcaataatccatcaagtgcctcatcaagatcttttggaggcggcaactctaaaaattcgcagcccttttggatatacacattgtaatcaggcaggatataacgaggacgataaatcgcgtagccttcacataaatcacaaatcatctgattctgtaaaaagccccattcttcatcggtatagccaagtaaatcgcgaggatcaaataaacgctcggcaatattgcctaatgtcattaatttttgatgataagtcagattattggctttaaccgtatcgagaatatcttgaagtgaagctaacataacgtcccctttgaaaatggtttcgtattgtacgcaatggtaacaaaatagacaattttgaaaacgtgaggaagatcacagttttagaaaataaacattatgcaaacggttactcaaaataaatatgtttttgatataaatgaactgacaaaattatttctgtttttgcatctttccttttatgataaaacggaatataaaaggtaataaatatgaagaaaaaagtacgcgttatacctcgcacatcttgggctgccacatcattatggaccgcgcaatataaaaccatttcaatcttactttttgctctttctattttaggtattggagatgggcttattgtattatcaggtttaggatcgacaccttggactgtacttcacaaggtatagcaatacagacaaattttgatattggctggtcttctttttaa

SEQ ID NO: 449 - DNA, 3469 bp, H. influenzae
tggatataaatagtgtttgcaccttttattaaattccatggggagtggggatggccccattatgggtggacgtgcattataacgtctatccaccaaaagttggaatacagcttggcacaacaaattctatctggtgcgttattcctggtaaggttgttaccattgattacgccaacgcagaagttcaagctagacaataggtattaaaaaagtgcggtaaatttaccgcacttttcttatgaacctaaacgctgacgtgcaatttcaaataaacatacccctgttgcgacagatacatttaatgatgaaactgaaccagccattggaatactaatcagttgatcgcaatgttcacgcgttaaacgacgcattccttcgccttcggctcccataacaagtgctagtggtcctgtcagtttgctttgataaatggtttcagtggcttcgccagcagtgccaaccacccaaatattatggttttgctgtaaatcgcgcagtgtgcgagaaagattggttacacgaattaacggcacggtttctgccgcgccacaagcaactttacgtgcgatagatgttaattgtgcggatttatctttcggtacgatcactgccactgcgcccgctgcatccgctgttcgcaggcaggcacccaagttgtgtggatccgtcacgccatccaaaactaataaaagcggattttgtttattcgcaagaatttcatcaagatcattttcattaagttcttttgccgcttgtactcgagcaatgacaccctgatgaacctcaccatcggcttttttatcaagtgtttgtcgattaacaaattgcacaccaattcccagggaataaagctcatttaagagtggctgtaggcgtttatcttcacgtcttttaagtacgaagacttcaattagacgctctggcgaatgggttaaaatactattaaccgcgtgaataccgtagatttgttctgacataaatttctctttttcttatttgaatttttaattcatttttacaataggaagtgaattattttcgttttctagatgctttcttcaaaacatctttcttttttaccgcactttttcgtttctgggatgttttagacggtagttctttaaagactttcttggctttttctttcgccgtttttccagcacgacgaggtttacgttcactccccatcagcgagaaatcgaccattttattttctaaatgtactgcttcaactttgatacgaactttatcgcctaagcgatattgcattccgctattttcgccaattaaacgctgttttgctgcatcgaattggtaataatcgttttctaaggtggaaatatggactaaaccatcgatgaataaatcatctaagcgtacaaataaaccaaatccagtcacagatgaaataacaccgctaaattcaccgccaacatgatcttgcatatattcgcatttcagccaatctgccacttcacgagtggcgtcgtcggcacggcgttccgtcattgaacagtgattgccaagtaaatccatttcatcaaaagagtaatgataaccgcctgtatcggtggttttacgttttgcgccttgttctttagcgagtaaatacttgatacctcgatgaagtgttaagtctggataacggcgaattggcgaagtaaagtgtgcatattcttccaaagccaaaccaaaatgcccaatattatcagcatgatagacggcttgacttaatgaacgtagcaacattgtttgaataagttcatgatcatgtcgttctttaactttttctaagagagcagcatagtcttttgtggttggcttcaatccaccttctaaggttaaaccaaactcacttaagaaagtgcggaacgatgttaatttttcttcgctcggggtggcatgaatgcgatataatgcaggttctttatgtttttccataaaattagctgctgcgatattcgcaagaatcatacattcctcaatgattttgtgggcatcattgcgaacaacgggttcaatacgctcaattctccccattgcattaaaaataaacttagtttcaatggtttcaaaatcgatcgcaccacgttgatgacgtgcaccaagcaacgcttgatagagtttataaagatcttctaaatgaggcacaagcgtagaataacgagcgcgtaattcttcatcgccttcaagcatttttgctacttttgtataagtgaggcgggcgtgagaattcatcactgcttcataaaagcgataatctatgagcttacctttggcagaaatttgcatctcacacaccatacacaaacgatccacttgtgggtttagagagcataagccgttcgataaaatttcgggtagcataggtacaactcggttcggaaaatagaccgagttaccacgattatgcgcttccacatccaaagcggaacgtaaacgtacgtaataactaacatccgcaatcgccacccaaagtttccagcctttgccgtgtttttcacaataaacggcatcgtcaaaatcccgcgcatcttcaccatcaatggtcacaagcggtaaatttcgtaaatccacacggcctttttttgcttcttcaggcacttcttcagtgaatttttttacgtatttttccaccgcacttggaaacttatggggaatatcgtggttacgcaaggcgatttccacttccatttctttcgccatattatcgcctaggatctctgtgattacgccaattggctggttaaaactggcagaacgttcttgcaactcgacaaccacaacttgtcccatgcgagcaccattacgatgttcatttggcacgagaatatctcgaccaattctgctgtcatcaggcaccacatagctaaaaccgttttctaagaaaaaacgacccacaatttgttttttacggctttctaatacgcgcacaattcgcacttcacggcgaccacgacgatctaatccagcaagttgcgctaagacaaaatctccatgcatgactctttgcatttgatggtttggaatgaataaatcatcctttttgccatcgacctgtaaaaaaccaaaaccttcgcgatgaccaattaccgtgcctttaaataaatctaatttttctggtaaggcatagcgtttacgtttggtgaacactaattggccatcattttccatcgcgcgtaatcggcgacgcatcgcttctatttgctcttcatttcgaatggaaagtgcggtcaaaatttcatcccgattcatcggtgcattattgtctcgaataacgcttaaaataaattcacggctcgggattggattgccgtatttttccaattctcgtttgtaatgaggatcttggctgattaagtttttacgtttttttgtcatattttttacagttttaaaaagtgcggagagtttgacacgtaaggaggataatgcaagccggggggtaccgagtccgaattcggaacca

SEQ ID NO: 450 - DNA, 3957 bp, H. influenzae
atttttatcggaagtttgaatattcaaacaaattatcaggtgtcattctatcgaaaaacagtatcgggttgaaagggatttttgcgtgctaaattcaatgatttccagtagaatgaggtgcttttataaataaggaataactatggcaagagaatttaaacgtagcgatcgcgtcgctcaagaaatacaaaaagaaatagcagtcattttacaacgcgaagtgaaagatccccgtattgggatggtgacggtttctgatgtggaagtgtcgagcgatttatcttacgcaaaaatctttgtgacttttttattcgatcacgatgaaacggcaattgagcaaggcatgaaaggcttagaaaaagcatcgccttatattcgttcattactaggcaaagcgatgcgtttacgtatcgtgccagagattcgctttatttatgatcaatccttagtggaagggatgcgtatgtcaaatcttgtgacaaatgttgtgcgtgaagatgagaaaaaacacgttgaggaaagcaactaatgtctagacctcgtaaacgctggcgtgatgttgatggtgtgtttttgttggataaaccacaaggtatgtcatcaaatgacattatgcaaaaggtgaagcgtttatttcaagcgaataaagcagggcatacaggtgcgctcgatccgttggctacgggaatgttgccaatttgcttgggtgaagcaactaagttttcacaatttttgcttgatgccgataagcgttatcttgttacggcaaaattaggcgaacgtaccgatacttccgatgcggaagggcaagtcgtggaaactcgtgaagttcatgttgaaactccgcaaattttgaccgcacttgaacaatttcgtggcgatattttgcaagtgccgaccatgttttccgcactaaaacataacggtaaaccgctttatgaatatgcgcgtcaaggtattacggttgagcgtgaggcacgtccaattacgatttttgaacttaattttattgaatatcacgcaccttttttaaccttagaagtacattgttcaaaaggcacttatattcgcaccttagtcgatgatttgggtgaagtgctaggttgtggcgcacatgtgacaatgttacgccgtacagccgtagcggattaccccgtagcagaaatgataccaatcaatgagttacaactgctcgctgaaagttttccattaagtgaattagatcgtctattactgccaaccgataccgcagtaagtaaattgcccgctttgcatttggatgtagagcagagtaaagccattggttttggtcagcgagtgaaatttgctaatgaacagcaattaggtggccaagtgcggttattttcagcggagaatttattcttaggcgtggcattaatcgacgggaatattattcgcccacaacggttaattacacaatctgcataacttcattgcctttcttataaaattctagtaatctcatctgtaattaattttttacaatatatgtaaactaaattttgcaggtgggttttatggaagtccttaaagatttacgttctgaaattgattcgcttgatcgcgaacttatccaactttttgctaaacgtcttgagttggtttctcaagtcggtaaagtgaaacatcaacatggattacctatttatgcgccagagcgtgaaatagcaatgctccaagcacgtcgtttagaggctgaaaaagcaggcatttcagccgatttaattgaagatgttctacgccgttttatgcgtgaatcctatgccaatgaaaaccaatttggttttaaaactatcaattctgatattcacaaaattgttatcgtgggcggttatggtaaattaggtggcttatttgcccgttatttacgtgcatctggctatccaatttctattttagatcgcgaagattgggcggtggctgaaagtattttagcgaatgctgatgtcgtgatcgtttccgtccccatcaatattactttggaaacgattgagcgactaaaaccttatttaacagaaaatatgttgcttgcagatttaacttctgttaagcgtgaaccgctagcgaaaatgcttgaagttcattctggtgcagttttaggtttacatccaatgtttggtgcagacattgcaagtatggcaaaacaagtggttgtacgttgtgatggacgttttcctgaacgttatgaatggttacttgagcaaattcaaatttggggcgcaaaaatttatcaaaccaatgccacagaacacgatcacaatatgacttatatacaagccttgcgccatttttcgacttttgcgaatggtttacacctttccaaacagcccattaatctcgctaatttattggcgctttcttctcctatttatcgcttagaacttgcgatgatcggtcgcttatttgcgcaagatgcagagctttacgcagatattattatggataagccagaaaatttagcggtaattgaaacgctaaaacaaacttacgacgaagccttaactttctttgaaaagaatgatcgtcaaggttttattgatgctttccacaaggtgcgtgactggtttggcgattattctgaacaattcttaaaagaaagccgtcagctattacagcaggcaaatgatttgaaacaagggtagagaaaagtgcggtgaaatttcaccgcagttttttactgtctcgccaatcttaaattttcaggtaaattctcaaaattagagcggaatggattaatgtctaatccgccacgacgagtatagcgtgcgtaaacggtgagtttttctggttttgcgtagtgcattaaatcgcaaaaaatacgttcgacacattgttcgtggaattcattatgctgacggaacgatataacgtaacgcaataatttttcgtgattgatttttttaccaacatagtgaatatgcaaggtgccccagtctggctgattggtaatgaggcagttagatttcaataaatggctgactaatttttcttcgacaatttcatccgatacgcaatctttcagccaattagcgttaaattcgtagctagtaatttcaatatcttgttcatcaatgcaatcgccttgtaaatgctcaattttttgagcatcataaactgccactggatttaaccgcacttttacatcgccttgcgcacattcgattaaatcgcgttgcatagtttgttgaacggcgttgaagtcggtaaatttgctttggttaaagctatttaaataaagtttaaaactttttgattcaatcaaattttggctttgataatccagataaatatctgcgatagccacttgcggtaagcctttttcgttgagccacgagatttcataagccgtccaaatatcggcgccgatagtaaatggttggttttgagtaatgcctaatccatcacgatttaacgcacgtggcacaggctgtaataaagtgcggtcatattgagaggcgtattccgttttttgaccgagttttaaggattttaagctgttgtcttggtaattcatcttttctccgattaggtgttcgacttttgcaaatttcgacactttataaattaattacaaaaaaattccacgatagattcgaaacgaatcgacaggtatcgcatttaaaatgaaaggtatcaaaaatcgcgttttttaacgcccaatttgcaccacaagaagggcagcaacgggatttttcagattttaaagattgcccacctacacgatataaataatagtaagtcggtatgccagtttctttttctatttcttgagctaaatatcgtccgtgttttgaaagtgtgctttggtgctccgaaatttctgccaaagattgttgttctaataccgcaccattcatttgtagttgatcgcaggcttgccaattttcttgccatttaatcagatcttggcttaagtgcgggtgatttttcaactgt

SEQ ID NO: 451 - DNA, 3057 bp, H. influenzae
  misc_feature (3042)..(3042): n is a, c, g, or t
tgttcgattcggctcgtacccatcttatggcgagccagtagaagttgtgacaaaaggtcgtcacgatccttgtgtgggtattcgtgctgtacccatcgcagaagccatgatggcgattgtcttattagatcatctattacgttttaaggcgcagtgtaaataatcttagtataagatgggagtctgtgcctagggtaggtataccctaggttagtttgatgttacccctttgggataagtggaaagttccccaaaggggaactattttttctaaccgtgggtatacttacccacggcaaaacctaagatatgcttacccatagcaaaactttagaatgaataaaattttattaaaaacaaccataatttttaccgcacttttctctctgaacgttgttgcgtctcctctagattggcaaaaagtgaaacgtcctattccaagtgacgatgggaaagcaaaacctattggtagctataccaatgggtgtattattggggcgcaagcactaccgccgaaaggagacggttaccaagttattcgtatgaatcgcaatcgttattatggtcatccaaatatgattcagtatattgaacgtttggggcagcgagctaaagctgctgggttaccaactatgttagtgggtgatattgccatgccgggtggcgggcggtttttaacgggtcatgctagccatcagatgggattagatgcggatatttggttaagaatgggcgaaatgtcagacgccgatgcgctgaattctgatggtaaaggtttattagttgtagatagaaaggcgcaacgagtggatgaacgagtatggaatagcaatcatgcgacgttaatcaagttagccgcacaagatccaaatgtgacgcgtatttttgttaatcctgcgattaaggtaaaattatgtcaaaccgctggcaatgatcgcggttggctacacaaagttcgtccttggtatggacacaactctcattttcatgttcgtttaacttgccccgcagatgcatcttattgtgaaaatcaagcgcctgtgcctgctggtgatggttgtggagacgaattatattcttggtttgaaccgccaaaaccaggtgcttcagtgagcaaacctaaagttacaccgcctgagccgtttttgtgccaacaaattttaaattccccgaatcggagtgaatggttagaatagcattaaggtaaatcaatatggatatcggcattgatcttttagcaatattgttttgtgttggttttgtcgcatcatttatcgatgcaattgctggcggtggtggattaattactattccagcgttgcttatgactggcatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttcagccctaggtacattattaattcaatcaattgacgtggcgattttcaaaaaaatgctgccttttttgattttagctattggtctatattttttatttacccctaaattaggtgatgaagatcgaaaacagcgtttaagttacatgttatttggtcttttagttagcccatttttaggtttttatgatggcttctttggaccagggactggctcaatcatgagtttagcctgtgttactttgctaggatttaatctcccgaaagcgacggcacatgcaaaagtgatgaacttcacttcgaaccttgcttcttttgcgcttttcttattgggtggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatgatttacgatcagggttggtttcatttttaattcggaaagcgcgcaaaagtgcggttaaaattaattacattttattatgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgattaaaaatagggtttgaaagtcatattccgaaaacggatatcaataagggggtaccgagtcngatattcgtataaca

SEQ ID NO: 452 - DNA, 4821 bp, H. influenzae
  misc_feature (4675)..(4675): n is a, c, g, or t
  misc_feature (4694)..(4694): n is a, c, g, or t
  misc_feature (4734)..(4734): n is a, c, g, or t
  misc_feature (4779)..(4779): n is a, c, g, or t
  misc_feature (4809)..(4809): n is a, c, g, or t
ggggagggggtgtgtgcaagagcgggcgtaggagtcaaacgggaccggtttatgcaagatagcttgggcttttggggactcagaaagcccaaatatttttaagggggcttccgtttgaaaaagtgtttgccaagatgtcacaaaattctaatgcagtgataggctcgccatttgaccattaagcttttcccgcaaagtgaaaatccaagttttattgtcttcggtttgccaattttgggctacagctggaacaagattcctttgcacatcataagccgttaatccttcaaaaagatctcgtaataattgagtttgttcttcgctttgtgcttgccaaggttgcaaagtcaaatcgctataaacgccacgttttaattcaactcggttagattctaattgagtatttttttgtgtctcaatttgtggcgaaataggcttaggactatccaatttatcgcaagcctcccccgtaaaaataatagaaaaaatagccgcacttcgttggcacaaggcgaacaaattattcattttcggttttaatccaaaataagaagaaccaaaacttaatacaaatcaacgcaacaataacactacgccctattacacttggcgtgaaataaaaaccaattagtagcattgtggtagcaaaagtcaaaataaaaattttggtatttttctttaatgatcgattttcatgaaaggacttgagatgtttttgataaatacttgtgcctaaaaaccattgttctaagcgttttgaaccttttgtgaagaaaaataaagtaagtaataaaaaaggcgtggtaggcaaaagaggaagaaaaatcccaatgatgccaattgcaagtgaaagaaaacctaaaataatgtaaataattttcataatgttcctaataaaaaagaaaatgcaaactattattactgattttttagatttttcaaccttgatattatagaatttgccgtcacataaaaaaacagttttcaaaaaaggaacatttatgtctatgtcaaatccattacttcacattcaaggcctaccgccattttcacaaatcaagccagaacacattcaaccagctgttgaaaaattaattcaagattgtcgcaatacgatagaacaagtgttaaaacaaccgcactttacttgggaaaatttcattttgcctttaacggaaactaatgatcggttaaatcgtgcttggtcgcccgtttctcatctcaattcagtaaaaaatagcactgaattacgtgaagcctatcaaacgtgcttaccgttactttctgaatacagcacttggattggtcagcataaagggctttataatgcttatttagcgttaaaaaatagtgctgaatttgccgattattcgattgcacaaaagaaagccattgaaaattcactgcgtgattttgaactttcaggtatcgggctttccgaagagaaacaacaacgttatggcgaaattgtggcacgcttatcggaattaaattcacaattcagcaataatgtattagatgccacaatgggttgggaaaaactcattgaaaacgaagctgaacttgctggcttacccgaatccgcactgcaagcagcacaacaatctgccgaaagtaaaggattaaaaggttatcgttttacgttagaaatcccaagttatttgcctgtgatgacttactgcgaaaatcgtgcattgcgtgaagaaatgtaccgtgcttatgcaacacgcgcctctgaacaaggccctaatgcgggcaaatgggacaacagtaaagttatggaaagaaattcttacattacgcgtggaattggcgaaataccctcgggtttaatacttacaccgaactctcacttgccacaaaaatgggcagaaaacccacaacaagtgcttgatttcttagatcatcttgccgaacgtgccaaaccacaaggcgaaaaagaactgcaagaattgaaaaattactgcgaaaaagaatttggtgtcacggaacttgcaccttgggatattggtttttacagcgaaaaacaaaaacaacatttatacgccattaatgatgaagaacttcgcccatattttctagaaaatcgcgtgatttcaggattgtttaaattaattaaacgcattttcaatattcgtgcagtggaacgcaaaggcgtggatacttggcataaagatgtgcgtttctttgatttaatcgatgaaaatgatcaactccgaggcagtttctatcttgatttatatgcgcgcgaacataaacgtggcggtgcgtggatggatgattgtatcggacgtaagcgtaaactggatggcagcattgaaacgcctgtggcttatttaacttgcaacttcaacgcccctatagggaataaaccagcgttatttactcacaatgaagtcaccacgctattccacgaatttgggcacggaatccatcatatgctcacgcaaattgatgtatccgatgtggcgggtataaatggcgtgccttgggatgctgtggaattaccaagtcaatttatggaaaactggtgctgggaagaagaggctttggcgtttatttcagggcattacgaaacaggcgagccgttgccaaaagaaaaactcacgcaattattaaaagcgaaaaatttccaagctgcaatgtttatcttacgtcagcttgaatttgggatttttgatttccgcttgcatcacacctttgatgcggaaaaaaccaatcaaattttggatacacttaaatcagtgaaatcacaagttgccgtcataaaaggcgtagattgggcaagaacgccacacagcttcagccatatttttgcagggggctacgccgcaggttattacagctatttatgggctgaagtattatcagcagacgcttattcacgctttgaagaagaaggtattttcaacccaatcaccggcaaatcattcttagatgaaattctcacgcgtggtggctcagaagaaccaatggaactcttcaaacgcttccgtggccgtgaaccgcaattagatgcgttgttaagacataaaggaattatgaactaatacgtcaaactatagggcatgcacaacatgccctttctcaaatatttttctcgacataaaaacatagtaaattttaaccgcactttatccaaacaaaacctacaaacgagacattatttttacaaatagctgtaagataaacgcatagaaattcacgcagaatagactaatttcctgtataatttttcacatatctattcaactcattacacaaaatattctgaggattttatggctgctgcaattcaacaacgtgccgaacttcaacgtcgtatttggcaaattgctaatgatgtgcgaggctcagtcgatggctgggatttcaaacaatatgtacttggcacacttttttaccgttttattagcgaaaattttgccaattacattgaagcaggcgatgaaagcgtaaattatgcccaattacctgatgaaatcattaccccagacattaaaacagatgccattaaaacgaaaggctactttatttacccaagccaattatttaagaatgttgcggctaatgctggcaacaatcctaatttgaatactgatttaaaacagatttttactgatattgaaaactcagcgacgggctttccgtctgaacaagatattaaaggcttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgctgccaatgcaggcaaatctggtggtgaattttttaccccacaaagtgtttccaaactcattgctcaaattgcaatgcacgggcaaacctcggtcaataaaatttatgatcccgcagcaggttctggctcacttttgcttcaagccaaaaaacaatttgatgaacatattattgaagaaggctttttcgggcaggaaattaaccataccacatataaccttgcccgtatgaatatgtttttgcataacatcaactacgacaaatttgatattgctttaggcaacaccttaatggaaccacaatttggcgatggataaacctttcgatgccatcgtttctaacccaccttactccgtgaaatgggctggctccgacaatccaacactgattaacgatgaacgatttgcccccgcaggcgtgcttgcaccaaaatccaaagcggattttgcctttattttacacgcattaagctatctttcaggcaaaggcagggcggcgattgtctccttcccaggcattttttatcgtggcggtgcggagcaaaaaattcgtcaatatttggtggataataattttgtggaaaccgtgattgcccttgcacctaatctattctacggcaccagtattgccgtaaatattttggttttgtccaagcacaaaccaaatacccaaactcaatttatcgatgccagcggtttatttaaatctgccaccaataacaacattttagaagaagaacatattgagcaaattctcaaactgtttgccaataaagaagatgtgccgcatttggcaaaatccgtatcctttgaagaaatcgcccaaaatgacncacaaccttgcagtaagtncgtatgtggaacaaaaagatacccgagaagaattaatatntgatgaactcaatgctcaaattcgtgaaactgttaccaatattgnaccgcttgcgtgccgagattataagattgntgcaaatagaga

SEQ ID NO: 453 - DNA, 2984 bp, H. influenzar
ccagtcatcgcacctgtattgcggcaatgaattgtcatcacatccccagtgggtagttcaatatccgcaaaaaagcgtttgtaacgacgaatttaattttgccgattgtaaagctggaagttgcataaagttccttatttaagtttttctaaacgttgtaaaatggcgttatcgctcatggcctgcatttttttcattctcaaagaaagtaagaacgccgcaaaagtgagtgagaccacaaaagcaatccagaaacctttcgcatcaatatgtggaataagccaatctgtacgaccgagtgtgtaaccaagtggcacaccaattacccaataagaaaaaagggtaatgtataaaatcattttggtatctttatagccacgtaaaatgccaccaaccaccatttgaatggtatctgaaaattgataaagtgcggcaaataataataaatttgccgccattgcgatgacaatttcatcggttacgaaaatagaggcaatttcataacggaagaaaatcgtaattaatgcagtaataatcgtcaccgttagccctaataataatgcggcatagccaattttcttcgcattttgtggagaacctgtacccaacgcttgtccaactagaatcgtcgctgccataccaatcgacatagggaacataaaaataaaagaactggtattcaatgtgatttgatggcttgcgacaatagttgcacccagcggagaaagcattaaagacgtaagtgcaaataacgccacttcacaacaaattgcaatggcaatgggtaatcctaaacgcagtaattttttaagtgttttcagatttggcatttcgattaattggctaaatacttttagtgaacgttcttgagcattcgtataggaataaaaaatcatcattaagcacattgcccagttcacaatagctgttgcaataccacagcccaccgcaccaaaagcaggtatgccaaattttccataaataaaaatgtaattaagtggaatattaattagcaaacctaaaaaggtaatgaccatcgcaggcttagttttagcaataccatcatttaaacagcgaaaattaatcagcatcaaataggctggcaatccccacaacatcgcatgtaaataatcccgtgctaaatctgacattttgctttccatttgcatatattgcagcggaatttcacagaaataaatcagcaaccctaaaggaatactcacgcctaacacaagccaaatgccttggcgaacttgatgggcaatgcgatggcgttggcctgaaccattcaaataagaaattgtaggcggcaatgccaacaataaaccttgtccaaaaagcatcaatggcatccaaattgaagcaccaatagaaatggctgccatatcagtggaactcacacgacccgccataatggtatccgctaatcccattgagttttgtgcgatttgtgctaataaaataggcaaggaaattttaatcaactttttaatatcagcgtggtattgagataaaagacgaaaattcataaatttgatatactgctaaaaatttttagaaaaggaaaaaattatgtttactggaattgtacaaggcaccgcccccatccactccattaaagaaacggctaattttagaacacaagtggtaaaattactacctgaaatgcgtaaagatctggaaattggcgcatcaatagcaaataacggtgtatgtttaactgtaactgaaatcaatggcgatctggttagctttgatctgatgcaagaaactttaaaaattacaaatctcggcacaataaaagtgggcgattatgtgaatatcgaacgtgctatgcaaatgggaacggaaattggcggacatttattatctggtcatatttattgcaccgcaaaaatttcagatattatcgctagtgaaaataaccgacaaatttggttcgagctcccaaacgcagatgtaatgaaatacattttaacgaaaggatttgttgcggtagatggtattagcctcactattggtgaagtaaaaggcacgcaattctgtgtgaatttaatccctgaaaccttgcaaagaacgttaatggggcaacgtaaagtgggcgatattgtgaatattgaaatcgatcctcaaacgcaagctattgtagatactgtagaaaattatttgcagtcaaaaaatttttagttcatttaaaaatattaagcaattgaataaagtgagaatagtcataaaacctattctcacatcatcaagtgttactgcaacgctttctcaattttttcaaataaatcttttgaaagattttctacaacgcttaggcgttctaaagcacgtttcatcagcgtttggcgttgagcatcaaagcgagaaaatcgaattaatggctcgattaaacgcgcagccacttgtggattactttcatttaaacggattaacacatccgttaagaaacgatagccagaaccgcttacgttgtgaaatgcttttaaattgtgatttgcaaaactacccactaatgaacgtaaacggtttggattattaaaattaaaacttgggtgatccattaataactgaataatttccaacacattttcatctgggcgagtggcttgtaatgcaaaccatttatccatcactaatccatcctgttgccatttttgttcaaaatcagctaataacgcatctctgcaaggtaatgcagctttagttgcaacacttaatgctgccaatgtatctgtcatattattcgcattattatagtgtttttgcactaagttgttacccaaattcgtataagccaaataagttaagcaaagattacgcattgcacgcaaggcgatgtcttgttgcgtaacttgataatcatcaagacgaatatgggtataaacacgcaagaaatctcttttaacgattctgcaatttgcgcttgcataaatgctcttgcgactgaaataccatcaggatcgatagttttgaaacct

SEQ ID NO: 454 - DNA, 3324 bp, H. influenzae
ctggtatacgaatatcggcctcggtacccacaaacatataaacgcttagtattaggcaaagaatgcgtttgcgtaatgcttatgtgattaaagctgaacgtgtagaaaaagatgcaaatggtgaaatcaccacgatcttctgtacttacgatcctgaaactttaggtaaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttctaattttaatcaaccaagtgcggtcaaaacaaacgtgattttgaccgcactttttatttgtatcaactatgcaatccaatatgcaacttgaacccaatttctggcaaacaaaatccctgcttgaaatgactgaatctgaatgggaagccttatgtgatggctgcggcaaatgctgttatcgcaaatatattcaagggcgaagtaaacgccaaaaactctattacacccgaattgcttgtaatcttttagatgtggaaacaggaaagtgcggtaattattcagagcgttttaacattgaaaccgattgcaccaaactcaccaaaaagaatttacctgattttcattggctgcctgatacttgcgcctatcgtttgctttatgaaggaaaaacactacctgaatggcatccgcttatttctggctctccccattctgtaaaaaatgcggatattttgattaaaaatggtatccacgaacgcgatgtgattgattggtttgaatttattattgacgaagatcacacttttaaataaagccagttgtcatcaatttcagcttagctataatccctaacaatagttatacagttgtcatgtggtgtctatgcaaatctcggattctctcaaacaaaaagcagaaaaatgcggtatcgcgctttctcactatgatattgatgggcatcttatttttgcggatgaaaagacggttttaacttttgttgagcttttgcagcctccgccaaaagcgaaaggacagtttgacgatgtactggctgcatttgaaaatgaaccgattgattatcgactcaatcgtctagatctcccaccatctgcggaatatcgttatcagctgattgatgaatctaatgctattctgttagaaaaaatactttcaaatttatccgcactttctttgcctccacttccttttggctattatcaattatctattttttctgacactgaacagtatcgcgttcgtttacttatttctcctaaaacagcttttcaaccatccgtattaaaaaataaaaaagtgtggggcgtgaatgtgcaactttacagtttacgctcagaacaaaactgggggattggcgattttggcgatttggctgctttgattgaacaaagtgcaaaacaaggggcggattatgtgggaattaatccattacatttgccatatcctgctgtgccaaattgggctagtccttatagttcatcctctcgtcgttggttgaatttcttatatttggacattcctgatttacccgaatttaagcgttgccgttcagtacaaaattggtttaagcgtgaggatattaaagcaaaaattgctgctttacgtgaaagtgattgcgtcgattattcttcaattttggctttaaaattaaccgcacttgagtccctgttttatttctttcagcgtagtcaatccgttgaaattgtgacacgtcgaaaaatctttgctgattatttaaaaagcaaaggggaacctttgttgttacagggcttatttaatgtcttggatttacaagaacacgctgaccatcaagcagaagaaaataccattggttggcttggctggcgtaaggaatggcagcatttaagtgcggcaaaaagaaaagccctattaaaaatacaccatgagcaaatccaattttttgcttggttgcaatggcttacagaagaacaactttccgcattacaaaatctttgtaaacagtctggcatgaagttgggtatttatggcgatttagccgtaaatagttctcgtggcagtgctgatgtatggagcgatcctgatttatattgtgtaaatgcctctattggtgcgccacctgatccgttaggcccagtcgggcaaaattggaatttgccaccttataatccaacagtgctaaaagcacgtggctttacaccatttatcgatatgctacgtgccaatatgcaatatttcggtgtgctacgcatcgatcatgttatgggcttattccgtttgtggtggattccaaaaggaaaaaccgcggctgacggtgcttatgtgcattatccttttgatgaattaatggcgattcttgccattgaaagtgtacgcaatgaatgtttgattattggtgaagatctcggcactgtgcctgatgaagtgcggtggaaattaaacgagtttcaaattttctcttattttgtattgtattttgcccaacgaaatggcgaatttcctcgtatatctgattatcctcgaaatgcttatgccactattggtacacatgatgttccctcattacaaagtttttggcattgccgtgatttagaattatttaatcaactcggtattctgaatggggaagtgctcaagcaaaaatatgatcaacgtgttatggataaacaagccttattaaatagtttacatcgtgataattatttaccgccgcattatgaaggtgatgcactttctatggcgatgcacgattatttaaatcgaatgatccattattatttagcggaaagtaacagccgattgattggtgtgcaattagaaaatttacttagccaagaaatcagttctaatttaccgggcacctcaaatgaatacccaaactggtgcaagaaacttgctcaaccgttagcggttatttttagcaatgaagctttaaaaacgttctttgtgcaaattaaccaagggcgaaatgtttaaggagtaaatatgacaaccggcatacacaagcactattgttggtttttttttgagcgagcaagggggatctttttgcacccttggatgccccaacccgacagggaattgaattcttccttattgcccatcccctcttatgcggccccct

SEQ ID NO: 455 - DNA, 3490 bp, H. influenzae
tgtatcgattcggctcgtaccctgtgcttgattccgtagaagtgcggtggatttttttgtttttttgctcattgggttatcctattcaaaggtaaatattgttgatttgttgcttgatacatcgccgcctaaaccataaggcacatttaaaatgcagttcataattgcccatgataaatcgccgtggcttgcatcttccgaacggtccgaaacataagtaattttccctgtgccagtaatgcgttttttcacggtcataaaactactcacgatgtcattgtcaccactatcaaatttaaggcgacgtttctgaattaagttttgtgtttttaacaccatttcatttttaagatcggcgttatactctaggccctgcgccattggataaaactttctcacttcctgataaacgcccgaccccatacccgttttatcaatcacgatgcgagtcacattgtaatcatcacaaaactgcttaatgcggcttgcttgtgtttcgtaatccataccgtgaaaagtttgtttatgtaaaacgcgataatcgcccccttctactttcggcggtgcaacaatcactaatgctgcacggtcgccagtaaaagcagggtcataacctaaccacacttcacgattgccgaatggacgttgataaaatggcttataatcgtgccattcttccaaactatccacttggcaaagttgtaagtccgaaaacttgaaagcagaactgttatcatcggcaaattgacacaaaaacaattgttcaaattcttctttgctgttttctgcgattaggtcgtcaatattgaatagattgcacccactttccattgcatcataaatactcacaatctgcttccattgacggtcggcacaaagttttccgctctttaagttttcgtgagaaatatcgatttcgattttttctgatttcgcacgattgcgattaaacgccttgcctgaaaagaacgcataagcagggtgtgcaattgtggtcggcgtggaaaaataagtttggcgatacattttttgtgctgccatacctgatgccacttttcgcatcacatcaaatttaggcacccaaaacacttcatcgaaatacaaattgccgtggtaggattgagccgtagcggagttcgtgccaaggaaaatcaattctgccccatttggcaatttgatggtttcgccttttaaatctacatctgccgtttgcttggcgtaattcacaatgtacgagcgaaactgtaaggcttgttttttactggctgataagaaaatctgattgtgccccgtcgtcaaagcatcaataaaggcttcatgggcaaaatagtaagtcgccccgatttgtcggcttttcaaaatatttctgatgcggtgttctttcgccttgtgccaaatacgttgataattaaacatcccatcaagaaagccatttatcagcaattcctcttgttcctgatcaatggcattgggttcggctttcttccgttcgcccttgttgcggttcgccagtttcgggtttaaatctacttcattaccgtcaccaaaagaatactttttcactctcgccattctttccatttggcgaccgagcaaatcaatttctttgtaatctgaaccgctcttttcttctttcgcaatcagcaaattcaatcttgtctctaatgccaattcaacccgaccaacaggcgcaatatcgtcccatttttctctgtctttccaactggcaattgttgaggcaggagtatttaactggcgtgaaatttcagcgattttataaccactgaaatacatctgctgtgctttacgtttgatttccactgtcacttcgggggaaggttgattaataacttgttcgtccattcctaatcctttctatttacaaccgcataatagaaagggggcgaatgttagtctttccgcttgctctgtgaatcggcatacaacaaaagcaactcatagaccaccaaaattaaacctttcagaatagcgacaatcattgaatcaaaccaaccaaaggataagcaatggcaaaaaaatctaaatgggtggttgtggcgacagaaggcgcaaccacagacggacgcactattcagcgcaactggatttcagaaatggcggcaaattatgacccgaaaaaatacggtgcacgcgttaatcttgaacacattaaatggcgttatatgtggaacgatgatccgcactcaaaatgctatggtgatgtgattggtttaaaaacggaagaaaatgctgaaggtaaattgcaattactggctcaaatcgacccaacggacgatttaatcaaactcaataaagaccgtcagaaaatctacacctctattgagtgcgatccaaattttgctgacacaggtgaagcctatttagtcggtttggctgtaacggacaatcctgcaagtcttggcacagaaatgttggtattttctgccggtgcaagcgcaaatcctctcaacaaccgcaaagaaaaagccgataacattttcactgcagccgttgaaactgaattggaatttgtggaagaaacacaaagcatctttgaaaaaatcaaaggcttgtttgcgaaaaaagaaaaatcagacgatgaacgcttttctgatcaaacacaagccattgagcttttagccgagcaaaccaaagaaaccttggaaaaattaaccgcactttctgacgatttagccaaacaaaaagccgaaatcgaagaaatgaaagcaagtaatgcagaaatccaagcaacgttcgcagaactccaaaagcctgttgaacccgaaaatcctcgccctttagtttacggtgaacaacctgaaactgacggccgcttcttttaatttatcttaggaaaaaaccaatgaataaatttaccaaacaaaaatttaatacttaccttgctggtgttgcacaagataacggcgaagatgttgcttttatcgcaaatggtggtcagtttaccgttgagccaactattcaacaaaaattagaaaatgctgtgcttgaaagttctgatttcttgaaacgcatcaatgtagtgatggtgcaagaaatgaaaggttctgcattgcgtttaggtgtgctttcaccagtggcaagtcgcaccgacaccaacaccaaagcacgtgaaaccactgatattcacagcttgcaagaaaacacctattcttgcgaacaaaccaactttgacacacatttaaattatccaaccttagacagttgggcgaaattccctgattttgccgcacgtgtgggcaaactcaaagcagaacgcattgcattagaccgtatcatgatcggttggaatggcacaagtgcagcaacaaccacaaaccgtacctcaaatccattattgcaagatgtgaataagggttggttagtccaaatcgaagataaagccaaagcccgtgtgttaaaagaaattgaagaaagcagtggcaaaatcgaaatcggcgcaggtaaaacctataaaaatcttgatgccctt

SEQ ID NO: 456 - DNA, 4088 bp, H. influenzae
  misc_feature (2541)..(2542): n is a, c, g, or t
agtaggcttcgggctacctggttaaggggcgcaataacccttggccatccccccaaaaagatgcaaaacaacatggcgagagacggaattaacaaccaaaaatcaaagcctaaggcaaaacaacaaaggaggccaagcactgcacccaagataaatcccattgctgcagccaacataaattcacttacagataacccgccatacacactcgattcacgatttaatcgagtaggaagaaaggggattgtttgttctttatcgcttgacatcttgacctcacagagataattaaaacagaccgatagccaatttcaccaaccagaggctgaagaaaattaaaatgaaaccaagaataagagcgataataaatgggccccatccttttttgtcattttcgtcagtcgctgcgttataggttttaattaatgccttaaccactgtcatgattgaccatgctgcaaataaaattgcacacaaggttgccaatgatttagcaacaagatagatgatttccatcgggtctttggtattgctatctacgcctgggattttaaaatcagggattttagaggcattgataccattaccaccgcctgtagcaaacgcattttcaacggataaccaaagtaaagttactaccgcaagaaaacgacttgaaacattctgaaagaaggatttaatcaacttcatgagatgtccttatggtttgttaaataaaaaagctgacaacacatataattaatgctgcgccccatagaatcagtttaaagaatgaccaaatatcaccgtcgttcaccatgcctttgtagccatgattagttgcccacatatacgcaagcagtaatacgacaaccaaaataatggccagcatgattttcagttttagcgggtctaaaccacttacagtataaaaactgtctaatggtgaaacagaagggaaattagcgttactcatctgctattgactccgaagattgagataatcttcttttaagttacgaatagctttaggatttctagggattgcccgggaagggttaatatattgcttaatccctgcctgtaccgtagcaatatcttgatgtgctgaagcgtaatcaaaatattcacgacttttcgcagaaacctttgcacttgcagctgctcgctgtaatgagagttttgctgcatccaactgtttaattgcttgcgctaaatgctcttgctctgttgcttgagcacttatagcgccaaacaataaccctattgctagagataaactgaaaatatttttagtcaccggagactccttacttgaaacagattccaagcaaagagtgccaaagaagagagggaaatttaatgagaaactctttttaaattcaaaacagtttttagtgataaaaaagggcgcttattcttggaaaaataagcacccataatgacaacatagaggaatattaaaggtattttttaaagctcgctgccgttacacagatggatagtccaaatagaaatgcagctggcaccaaaattatattcgggtaaatagaaattgggatagaaagatacaatacccatgccgacaacataatcgggccaattaatcgacgtgcatgatgataaagaaaactagactctctgcccgcaccaaatttacgacggtcacgcatcattaacccttcagtaaagcccgcaaatgcggctaacaaaaagagtggggaagtaaaaacaatcactacaagtcgaataacaaaggtgataaaaacataaatcactgactcaatatacgctcgcccataatgatacacccacaaacctacgccactatgctcacgagggttggctaaccaatcttttacacctgttttcacaaaaagccattcatgtaatgacaaaataagaccttcagccagctcttttggagaatgatagaaaagacctctcgttagactatcagaaagccatccaagctcagttagcatcattttttgactgtgtaaatgaccttcttcaggccataaaaatgcaatacctaaccattcaagaataatgctcaaaatcagggaacccaataaggcggctaataccgcattaatgtagtaaaaaagaccctttttcttttttttgacttgttgttctgccattactgtaatgttcccgctggagataatttacagtgaaagaaaagataaccttttacttcaccgtctaaaaaaatttgaattgcctggatgccattttcagatttttttacatcattagccgtccaaagtgagatgcctttatttgcatactttttcgcaaattcatgtgtggtataacgctgattattccaatcttccaaataaggtaaaaagtaattaagtaattcatcagcgttttccagcccacaagaacagctagtgactgaattgaaatctacgctcatatccggaatatcaagcaagttcatatccggctgattaattatctgtgtcatcaaaatcatcctcatctgtatcatcattctgatcaatatcttcatcttccatatcttcagcaactggagcttcaacatcnnccgaaaagcatttcttctcctgcgtgtgaaggcgctcgatttaatgacattgactgaaaagcggttgctatatcttgacttggcgcataatcagaaaatgcagattgccaccaatttggagaaatatggtagtttttgcgcatataagccgtcaattcttgaagtgattccggcatcacatcatctttatcaaccgcaggtaaaggcattcttaatttataaagcgtactcccttcaagaagagcaaatgcctgtccttttggtaaatttgtaatatgtgctggcgatagcattggcaccattttttcagaaatacgttcaccagtattagaagtaaacgccttgccatcatccggattgctgttatctgtcgtacttgatgtcaccatgctttgataaattgtgacatcgttgagctgacgcgttaaaaactctgcagtggccggctcttttacccggaacattaaaagtgtattgaagttacctgttgtttgtcccgtttttgccttacttccaatacgagcttcaatatctgaaagtgtttgagtataggctgttacctgcattcccgcaccacgacctttattgatcagcgggataaattcatcccccatcaattcattgaactcatcgcaatgaaggttgattttaggcggtttgcttttagttttaaatgcatctggcaacccctcatctacgccaaatttataaatatgaccagccattgataccaaatcagcaaacatactattacccacagctgcagctacggtcgcatcggataatgcatctaatccaacgtaaacaatccctcttttacgaataatagattcccaatcaaagatagggcgctcatcatgaatatcagtgtaatcaggcgagagaagctctgcagttttacctgtagtgagtttttcaagtaacggtaaaagcgatgccacaattttatcaaaataggttttatcgtaacgtaccgcacttgataacccttcaagtaccgggtcaaaaatcttattctctaaaatatattggttaataacagcaatcagcggtctatctttcatcgagaacggtaaattttttacatctaagttagccgcaaccgaagccaacgttggccatattttcttatctacggcatcaaaatgaagtttggcgtaatctaagaaaagtgcatcaatattttgcacaaaacgcgagatttgcacatagtccgggcgttttcccatttcaaccaatgcacgggagacaatattcacaaaacgccacgcaaactctttaaatgctgcactatttcccgcaccacttaattgcccagaaatacgtcctgccacttcagaaattcgaccgaagcgaccaactgggttatatcgagcagaaatttccggatgccctaaatggaatacataaaattcattttcacgccccgcacgttttgcttctgcatacattcgttttaacatatccgggtcgccttcggatcaaaaaagacaaccacttcacgttctccaggtgttttacctggggtaccgaaggcccgaattcc

SEQ ID NO: 457 - DNA, 4277 bp, H. influenzae
  misc_feature (2280)..(2280): n is a, c, g, or t
  misc_feature (2283)..(2283): n is a, c, g, or t
  misc_feature (2288)..(2288): n is a, c, g, or t
acgaatatcggactcggtacccttttattcttaggtaaacgtaatatatcccagatcaaccgaaaaacagattttggtaaattcttggtttggaatatataccaatttttttatatacaaacttcggcggaattaaaatatcttgtgtgtaatttttcttttcttcgagaataaaagtaattgggttattcagtggtgataaagggaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctgtttgatgatgaaatgcgtaaggattccctttttcttgataaaaatcaatgcctgtcaaataaagatctttataacccattgcagttgccactgcacacatatagacgcctgatgtaatcctcttattctcatatagttcgtgatattgtaaatgagcatcaaaagctcgtagtttttttaaatagctatgaccaagatcgatttgtggtagtaatttttctaaacgctggattttctttaattctgaatcccctaaatttagaaaagatgataaaataatatcagcatattcatattcattatttttaattaattgcataaacgtatagtattgttcaaaaattacagaacaattaaaaaataccttttttattttcttaccaagaaaataatgatcctcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattggacatattgtaccgttcattgaataaaatataacttatctttaatactaaaaaatagtagctattatacaggctttctgtgctttttactataacgccacaacaaatctaatgaaagtcagatttgattagactataatacttccttaattttttatatagaaagaggatctactatgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggtttcgggtatgcactgtaatatgtcgttaagtaaagacgggaggaatattttcccaggcgaataaaaagcagggcctttctgaaaccgccctttactacatcggcggtatcattaagcccgctaaagccttaaatgcgttcactaatccaaagtactatttcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaancanaaatnccacccaggcgatgcgatggataaaaatctttacgatcttcctccagaagaattaaaagatattccagctgttgcaagctctttagaagaagcattgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcgtaatgtcattgacgtaatcatttttaaaagtgcggtagaatttaccgcacttttcgtttgaaattgtttataacgagactcgggtaaaaatgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaataaggtcaaataattaactattagaaataaagctggtatagtttctaaatttattttgtttatacatgggggaataaatatgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcgggctgaatttatcttaaaccaagctgatatttataatgaaaaaagtgcggtaagtttttaagaatatttctggttgaggaacttgagcacaaggttatcacgggatttggactgtgggtaaaggctctgctaacttgccgctatgtgcaccc

SEQ ID NO: 458 - DNA, 3641 bp, H. influenzae
tggtggcattgcgacgtaaacgtgaccgtcttgtaccaatttcggaaaatgacgtaagaacagggcgcagagtagggtggcaatatgcagaccatcggagtcagcatccgcgagaatacagactttaccatagcgaagttgtgataaatcattgctgtcaggatcgatccctagagccacggcgatatcgtgaatttcggttgaacctaatacttgatcaggggaaacttcccatgtgtttaagattttcccacgtaacggcaaaatcgcttgatattcgcgatcacgtgcttgttttgctgagccgccagcagagtcgccctccactaaaaataattccgttttttctaaatcctgtgagccacaatcagctaattttcctggtaatgctgggccactaacgagtttttttcgcacgacttttttggcggcgcgtaatcggcgttgtgcagaactaatggcaatttctgctaatttttcagcatcttgtacattttgatttagccataggctgaacgcatcttttaaaacaccgctgacaaacaccgcactttggcgtgatgataagcgttcctttgtttgccctgcgaattgcgcatcctgcattttaagggaaagaatgtaagaacaacgatcccaaatatcatcggcggtaagttttaccccgcgtggtaatagatttctaaattcgcaaaattctcgaatggcatctaataaaccttgacgtagaccattaacatgcgttccgccttgaattgttggaattaagtttacgtagctttcgccaatcagttcaccaccttctggcaaccaaagtaatgcccagctaaccgcttcatttgttcctttaaattcgccaacaaatggtttttccggaagggtttcaaagccatttactgcttcgataaggtaatcggaaagcccatcttcatataaccaaatgtcttgagtattgtttactttatcaatgaatttgatttcaagccctgagcagagtaccgctttcgctcttaataaatggcgtaggcggctaacggaaaattttgcgctgtcaaaatattttggattcggtttgaagtgaacggttgttcccgttgtgcgtctaccacaagtcccgataatttccaattcttctactttactgccgttttcaaaggcaattttatagatttcgccattgcgtttgacttgaatatccacgcgttcagaaagcgcatttaccacagaaatccccacaccgtgtaaacctcccgcaaattcataatttttattggagaatttaccaccagcatgcagtttagtcaggattacttctacgccagaaacgccttccgtaggatgagtatccacaggcataccgcgaccattgtccgttacttcaatggattgatcagggtgtaaaattacttcaatttttgaggcaaaaccggcaagggcttcatctacgctgttatcaataacttcttgtgctaaatgattagggcgagtagtgtcagtgtacattcccgggcgaatttgcactggttcgagatctttaagaacggtaatttcttgagctgaataattggttgtcatggtgaggttattcgttaattttttaaatttgagaaaattctatcaaaaagtgcggtgatattcgaccgcacttttaatcgtataaactaggcgtcttttcatcggggcgcgttttaaaacggcgatgtagccacatatattgtgatatccccttcatgatttccttttctacgatttgattcattcgcgcagcaatcgccgtttcatcttgtaaatccgtaaaatcaacaggcgctgaaatactcacggtatagcctgaaccatctttattgcgtaatggcgcaaatggaatcactttgctgttttgtgaagatttcaataaataataactaccagtggttgtgcaagcatcgggtaccgcaaaaaagggaacaaaaacggcattttttctgccgtaatcgtgatcaggcgcataccaaatggtttcttcgtggcgtaaagctttgatcattccgcgtaaatctttacgatcaagcatatctttattagagcgtaaacgaccttgcgtttgtagccaatcaagcaaaggattatcatttggacgataaacgccaatgccgggatgatgcaaaccaagaatgcgcgcgccaagttctagcgttaagaaatgaacaccaacgagaacaattccatctttttgattttcttttagataatgtaagccttcaacttttgaccattttttgatacgtgaatccgaccaaaaccaagccatgccagtttcgataattgccatgcctacagagcggagattttcttgcaaaatcgcctcacggtcgttttcagacatatcaggaaaacaaagttcaagattacgacgtgcaatggctgctcgacgtttacccacttttaaatgtgaaaacagccaaccgagaccatgaccaatatggcgcaaaataggatagggaagacataaaatacttcgccaaattgccacgcctaaccaaaaaagccagtattttggggctaaaaagtgcggttgaaattgagggagtttttcgtttttcattgttctttccacgtaagttaggggcgtagtttatcgtaaatttgagttgtggtaaaattgccacaattttggttattcaaatagagagattttaaaatggctcaatattcagcagaatttaagcaagcaaaagtacttgtattaggcgacgtgatgcttgatcgttattggttcggcgcaaccaaccgtatttcaccagaagcaccagtgccagtagttcgtgtacaagaaaatgaagaacgcgcgggtggtgcagcaaatgtggcgatgaatattgcttcactcaatgtatccgttcagttaatgggattgattggacaagatgaaactggttctgcactttccctcttattagaaaaacaaaaaattgattgtaattttgttgcattagaaacccatccaactattactaaattacgtattttatctcgtcaccaacagttactccgccttgattttgaagaagatttcaataatgtagattgcaaggatttattagcgaagttagaaagtgcggtgaaaaattacggtgctttgattctttctgattacggcaaaggcacgcttaaagatgttcagaaaatgattcaaattgcacgcaaagcgaatgtgcctgtgttgatcgatccaaagggaactgattttgaacgctatcgtggtgcgacattattgacacccaatatgtctgaatttgaagccgttgtgggtaaatgtaatacagaagaagaaattattaagaagggtttaaaattaatttctgatattgaattaaccgcacttttggtaacgcgttctgaaaaaggcatgacattattacgcccaaatcaagagccttatcatttgccaaccgttgcaaaagaagtgtttgatgtgacgggagccggtgacactgtcattagcgtattagcaaccgcattagcagatggacgttcttttgaggaatcttgttacctagccaatgtagccgctggaattgtggtgggtaaattggggacttcaacggtttcgaccagtggaacttgaaaatgcggggtaccgagtctgatattcggtaaca

SEQ ID NO: 459 - DNA, 4226 bp, H. influenzae
  misc_feature (4141)..(4141): n is a, c, g, or t
cgtattgtaaccgcatcttattgcgaaggtcaggcgatcctattacgcccactcgtttgagcggggtttaacgcagacttggatggagaccaaatggcggatcatgttccattaacctttgtagcgcacttacaagcttgagcgttggatgatgtcctccaatagctagctttctccactaaacggtgatcctattattgatccatcccaagacgagatagtaggtctttactatatgacccgcgaaaaagtggacggacgaggcgacagtatgttattgtacgatcctcgcgaagctgaaaaagcatatcgtacaggcgaagcagaattacattctcgtgtgaaagtacgtattactgaatatgtgaaaaatgaagcgggcgaatttgatgcgaaaaccacgctgactgatacaactatcggtcgtgcaatcttatggatgatcgcgccgaaggcatgccttattcattgttcaaccaaacattaggtaaaaaagccatttctaaactgattaacgaagcatatcgtcgtttaggtttaaaagaagcggtaatgtttgctgaccaaattatgtataccggttttgcgtatgcggcacgttctgggtcatcagttggtattgatgatatggaaattccagcgaagaaatacgaaattatttctgcagcggaagaagaagtagctgagatccaagaacaattccaatcaggtcttgtgacggcaggcgaacgctataataaagtaatcgatatttgggctgccgcgaatgagcgcgtagcgaaagcgatgatggaaaacttatctcaagaagaagtcatcaatcgtgaaggtaatcctgaaaaacaagcgtcctttaacagtatctttatgatggctgattctggtgcgcgtggttctgcagcgcagattcgtcagttagcaggtatgcgtggtttgatggctcgtccagatggctcgatcattgaaaccccaattacagcaaacttccgtgaaggtttgaacgtattacagtactttatttcaacccacggtgctcgtaaaggtttggcggataccgcattaaaaacagcgaactcaggttacttaactcgtcgtttagttgatgtggcacaagacttagtgattgtagaagatgactgtggtacgcacgaaggcttagtcatgaccccattaattgaaggtggagatgaaaaagtgccacttcgtgaattagtattaggtcgtgttgctgcagaagatattttaaaaccgggtgcagaagaagtattaattccgcgtaacaccttattagatgaaaaactctgtgatgtgttggatgcaaactctgtagatagcgtaaaagtacgttctgttgtaacttgtgatactgactttggcgtgtgtgcgaaatgttatggtcgtgatcttgcgcgtggtcatttaatcaaccaaggcgaagcggtgggggttattgccgctcaatctatcggtgagccgggtacacagctaacaatgcgtacgttccatattggtggtgcggcatctgcggcagcgaaagaatctagtgtgcaagttaaaaacactggtacagtgcatttaatgaatgcaaaattcgtgactaacgatgaaagcaaactagtattaacttctcgtaacacggaattaactattactgatgcatttggtcgtactaaagaacattataaagtgccttatggtgcggtattaagcaaaggtgacggtcaagaagtcactgcaggcgaaactatcgcaaattgggatccacatacaatgccagttgtctctgaagtatctggttttgtgaaatttgtagacattattgatggtttaactgtgacgcgtcaaacagatgaattaacaggtttatcatcaatcgtggttcaagatgtgggtgaacgtgcaactgcgggtaaagatttacgtccaactattaaattagttgatgcaaatggcaacgatattttcttacctgaaactgatgttcttgcacaatacttcttacctggtaaagcaattgtaagtttagacgatggcgcagcagtgaaagtaggggaaccattagcacgtattccacaagaatctgtgggtactaaagatattactggtggtctaccgcgcgttgcagatttatttgaagcacgtaaaccaaaagaaccagctatcttggctgaaatttctggtatcgtgtctttcggtaaagaaaccaaaggtaaacgccgtttattaattactcctgcggaaggcgaaacttacgaagaaatgattccaaaatggcgtcagctcaacgtatttgaaggcgaaatggtacaacgtggcgatgtaatttctgatggtgctgaaacaccacacgacattttacgtttacgtggcgtgcgtgcagtaactgaatacatcgtgaacgaagtgcaagatgtttaccgcttacaaggggtaaaaatcaacgataaacatatcgaagttatcgttcgtcaaatgttacgtaaagcggtaattactaaagcttacgactcagaattccttgagggagaacaagtcgaagtggctcgcgtgaaaattgttaatcgccaacgtgaagcagaaggtaaaccaccagttgaatttgaacgtgaattattgggtatcaccaaagcgtctcttgcgactgaatccttcatctctgccgcatcgttccaagaaactactcgtgttcttaccgaagcagcagtggcaggtaaacgtgatgaattacgtggcttgaaagagaacgtaatagtaggtcgattaattcctgcgggtacaggttttgcgtatcatcaaaatcgtcacaaacatcgtttagttgatgatgtcgtagcgaaattatctgaagaagatgaagctgctatcgctgatgaatttgttatgactgcagatgatgcaagtgcgaacttagctgaaatgcttaacatggcagatgatgcggaataattaattccctgtatgagaaaacccgaatgaaagttcgggttttttatttttatgaaaatgggtagaggttttatgccagaacaacaagtatgtttcttcatagaaattcacaaaaatttgagacttttagaaaagtctgttgttgatagttatgttacactttgctcatatttttcaaaataaggatcatactatgaatataacaaagccttttcctcttccaacaggatatttcggtattcctcttggtttagcagccttatctttagcttggtttcatttagaaaacttatttcctgctgcgcgaatggtaagtgatgttcttggcattgtagcaagtgtggtctggattttatttattttaatgtatgcgtataaacttcgttattactttgaggaagttcgtgcagagtatcatagcccagttcgtttttcctttattgcattgattcctattacaactatgttggtaggcgatattctttatcgttggaatcctttaattgctgaagttttaatttggattggaacgattggtcaattacttttctcaacattacgtgtcagtgaattatggcaaggtggtgtatttgagcaaaaatctactcatcctccgttttatttgcctgcggtagctgctaattttaccagcgcaagttcattagcattacttggctaccatgatttagcctacttattctttggcgcaggaatgattgcttggattatttttgaacctgtattattacaacatttacgtatttcatctcttgagccacaatttagagccacaatagggattgttttagcacctgcgtttgtgtgtgtatctgcttatttatcgatcaatcactgcgaggtggatacgttagctaaaatcctttggggatatggatttttgcaattatttttcttattgcgattattcccttggattgtggaaaaaggacttaacattggcttatggacattctcattcggattagcgtctatggcaaacagtgctaccgctttctatcatggcaatgttttacaaggcgtgtctatttttgcctttgttttctcaaatgtaatgattggcttattggttttaatgacaatatataaattaactaaagggcagtttttcctaaaataggcatttaaataactaaggcagggattccctgccttattacatattacatctatttgnctttttctatttcatcacttttacacatttaccgtacccgctttaatcgccattcacattaaattctacaacttgttcctaatac

SEQ ID NO: 460 - DNA, 3919 bp, H. influenzae
  misc_feature (3853)..(3853): n is a, c, g, or t
  misc_feature (3882)..(3882): n is a, c, g, or t
caccctacaaggaacaaagatatgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttggtggtaaccaaatcatttatggtttccataatcaaattgatggcaaattataaggtagggcagaatggcattaacaatttcaagagcacaatatgtagcaacttatggcccaaccgttggcgataaagtccgtttaggcgataccaatttatgggcaaccattgaacaagatttattgaccaaaggtgatgagtgtaaatttggtggcggtaaaagcgtgcgtgatggtatggctcaaagcggtacggcaactcgcgacaatccgaatgtattggattttgtgattaccaacgtgatgatcattgatgctaaattaggcattatcaaagcagatattggtattcgtgatgggcgtattgtgggcattggacaagcaggtaaccctgacaccatggataacgtcacgccaaacatgattatcggtgctagcacagaagttcataacggtgcacatttaattgcaaccgctggcggtattgatacccacattcactttatttgtccgcaacaagcacaacatgcgattgaaagtggcgttaccacgttaattggcggtgggactggccctgctgatggtacgcacgcaaccacttgtacccctggcgcatggtatatggaacgtatgtttcaagcggcagaagccttgcctgtaaacgtcggattttttggtaaaggcaactgttcaaccctagatcctctgcgtgagcaaattgaagcgggtgcattaggtttaaaaatccacgaagactggggtgcaacgcctgccgtgattgattctgccttaaaagtagcagatgaaatggatattcaagtggccattcacacagacacgctaaatgaaagtggctttttggaagacacgatgaaagcgattgatggacgtgtcattcatactttccatacggagggcgcaggtggtggtcatgcacctgacatcattaaagcagcgatgtattcaaacgtattacctgcttcaaccaacccgactcgtccgtttaccaaaaacaccattgatgaacatttggatatgttgatggtttgccatcacttagataaacgcgtgccggaagacgtagcttttgccgatagccgtatccgccctgaaaccattgcagcagaagatattttgcatgatatgggcgtcttctccattatgagttcagactctcaagcaatgggacgtattggagaagtcgttattcgtacatggcaaactgcagataagatgaaaatgcaacgtggtgagctaggtaatgaaggaaacgataacttccgtattaaacgctacattgcgaaatatactatcaacccagcaattgcacatggtattgcggagcatattggctcgttagaagtgggtaaaatcgcagatatcgtgttatggaaaccgatgttctttggggtaaaacctgaagtcgtcattaaaaaaggttttattagctacgccaaaatgggcgacccaaatgcctcaattccaacgccacaacctgtattctaccgtccaatgtacggtgcacaaggcttagcaacggcacaaacagcggtattttttgtttcacaagccgctgaaaaagccgatattcgtgaaaaattcggtttacacaaagaaaccattgctgtgaaaggctgccgcaacgtaggtaaaaaagatctggttcataatgatgtaacaccaaacattactgttgatgctgaacgttatgaagttcgagtggatggagagttaattacctgtgaaccagtggatagcgtaccattgggtcagcgatatttcctattctaaaggactgttttcatagacgaattagtgtaaaaaggcgtgtacgatacgcctcttacttgataaataagaaatcattgtagctgtagtttttctttcgaagagaagaaagtggatttatagaggaaagatgaaaataattaacccaattctccctattatagaaaatatcttgggaaatttaaccgcacttcaagcagagggcaaaattaccacacagcccattgaacgcgtggcattgcagtggtatgaaagcgaacgcaatattttgcgtaaaactacaaatacggggcgtgaagtagcatttcgcttgctaaaagaggggcaacgcttgaaacacgatgatgtagtgtttatcagcgatgaattagtgattgcgattgaaattttaccgagtgacgtgattgtgctgtcgccgaaaaccttgcctgaaatggctcgagcttgttatgaaatcggcaacaaacattcgccgctttttttagatggcgatgaagtaacattaccttacgataagccgatgtttgaatggctgcaagctgcgggatttcatccgcaaaaagcagaacgccgtttaagccaagcgttaagagcaaattctgcacaagggcatggacattctcatagccattcgcatgatcatcatggctatcatcatcacggagatggacattggcacaaacattaaaccgctctttaacggatttaggtgcgttgttgcacttggtcgatcccaccttgccgattggtggatttaaccattccaatggcttggaaaccttcgtcagcaacgtgtggtagaaagcaaagcgaccctagaagaatatgtgcaaacccagcttttacaaaactggatttacaacgacggggcgtatctttctcttgccttcgatgcaatgtgtgaggggaattttgaccgcttgtgcgaactggattggcaactttccgccaccaaagtggcacgcgaaagtcgtgaagggagtttcaaactcggcgtacgattgttgaaaatttttattcgctatgaaacacatacgttgctcacagcttaccagcaagcgattgcagaaaaacgcgtgcagggctatttcccgatagtgtttgcaatggttgctcaagccatgggtttaagcaaagccgatacgctctatgcgttctactacaacgcagcagtcggtgcgatcactaacggcgtgaagctaattcctctcagccaaatggatgggcaagatattctgtttgacttgcgtggctcgctcgtacaagcggtggaattaagctttgaccctgacgaagaatggcttggtgcggcaacgctggcgaatgatattcgggctatgcaacacgaagtgctttatacgcgactttatatgtcgtaagtgcggttattttttattgagattttacttgtaggggcaaatcacatttgcccttgaacattcgttgatatataggggcaaatgtaacttgcccctacacccatgagcaacacagttgctacgatgataaacaaaaggaacattatgcgtaactacattaaaattggcgtagcaggtcctgttggcgcaggcaaaaccgcgttaattgaaaaactcactcgtgaaatagcgtcaaaatatagcgtagcagtcattactaacgatatttacacccaagaagatgcggaatttttaacgaaaaatagtttgcttccaccagagcgaattatgggcgtggaaacgggcggttgcccgcacacagcaattcgtgaagatgcctcgatgaatttagaagccgtggacgaaatggtgactcgtttnccctgatgtggaaatcgtgttcatgaatncaggtggcgggtaccgaggccgatattcgtataccag

SEQ ID NO: 461 - DNA, 4867 bp, H. influenzae
  misc_feature (4853)..(4856): n is a, c, g, or t
  misc_feature (4858)..(4859): n is a, c, g, or t
cttcataatgcaactgttccagccaaaaaaagcatttttacatcattcttcccatcacaaaaagcaatacagtcttttaactgatactcgcgtgattcgagtaaatgttttaatgcatccccttttgaaacattcttattcattacttccaaacaagctaatgctgaataaacaattgtcgttacgtcaccaaacttatctcgtaaataagtttctactgcaactaaatcctctggagttttaccaataaaaaagactttttctgtccccacgtccatgatgtttagaaaaatcgacaacgttataatcgaatccagattctttatggaactgacgcattgcaggaatatctttattagtaaaccaaccttcatcttgatagctattcatgcatactttggaagtatcaaatggcgttttgtaaagctcaagaactaattcttcaggcaaactattgctataaagcaaattaccctgtaaatcccgtacacgagcaccgtttgatgtaatcataaccgcacgttccgcaccaatttttccaagaatggatgacacatcggtatgattgcgtcctgttgccaaaataatatctacgcctttttgctctaatgctctcagcgtatcaatggtaagatcacccactaaatgttcaggtgttaaaagcgtgccatctaaatcagacaccattgctcgaaaaggtaaattcataaaaacctcaaaaaataaactatgtttatcatatcactaaatatacaaatggtacttgctgaagatcaatatattaaaaactgcaataaaaataaccgcacttttattaagtatagatagacacattcctcttcatcaaaaataaactaaaacatattttcgtttaaattcatctactattagaaatcaaacaaataacaataaagagttagattatttttattaaattctaataatactaaaaatctcgcaataaaattctacatactggcattaccagttgaaaaacgacaacaaatttcattttacctctcttataatgcaactgttcgaacaacaagcagtatctcgaatgatgtatgtttattccccaatgtatagtcaaaacacaaggagattattatggctttcaatatgaaaaatagacatttacttagtcttgttcatcacacagaacgtgaaattaaatatctcttagatctctcccgagatttgaaacgagccaaatatgccggcacagaacaacaaaaattaaaaggcaaaaatatcgcgctcatctttgaaaaaacctccacccgcacacgctgtgcatttgaagtcgccgcttatgatcaaggcgcacaagtcacctacatcgaccctaattcctctcaaattggccacaaagaaagtatgaaagataccgcccgcgtattaggcagaatgtatgatggtattgaatatcgtggctttaaacaaagtatcgttcaagaactggctgattatgctggagtgccagtattcaatggtttaaccgatgaattccacccaacacaaatgcttgccgacgtacttaccatgattgaacattgcgacaaaccattaagtgaaattagctatgtatatattggggatgctcgcaataacatgggtaattcacttttattaattggtgcaaaattaggtatggatgttcgtatttgtggacctaaagcattattaccagaagcaaatcttgtggaaatgtgcgaaaaatttgcgaaagaaagtggagctcgtattactgtaactgaagatatcgacaaagcggtgaaaggcgtagattttatccatactgatgtgtgggtttcaatgggtgaaccattagaaacctggggcgaacgcattaaattattacttccttatcaagtcacacctgaattaatgaaacgcactggtaatccaaaagtgaaatttatgcactgcctacctgccttccataacagcgaaaccaaagttggtcgtcaaattgctgaaaaatatcctgaattagctaatggtattgaagtaactgaagaggtatttgaatcgccaatgaacattgcatttgaacaagcagaaaaccgtatgcacacaattaaagcggtaatggtagcaagtttggcataaggagaacgtatgagaatagtgattgcattaggcggtaatgcattattacgacgcggagaaccaatgacagccgaaaatcaacgacaaaatgttcgcattgcttgtgagcaaattgctaagatttggccaaataatgaattagtgatagcacacggtaatggcccacaagtgggtttgctcgccttacaaggtgctgcctatactgatgtgccaacctatcctttagatgtattgggagcagaaacagctggaatgattggttatatgattcaacaagaactcggtaatttagttccatttgaagtgccatttgcaacgttattatctcaagtagaagttgatatcaacgacccagctttcaaaaatccaactaagccaataggtcctgtttatacaaaagaagaagctgaacgtttggcaaaagaaaaaaattggtctatcgcacaagatggtgataaatatcgtcgcgttgtgccaagcccattaccaaaacgtatttttgaaattcgtccggtcaaatggttgcttgaaaaaggcagtatcgtaatttgtgcggggggcggtggcattccaacctattatgatgaacaccataatttacaaggtgttgaagccgttatcgacaaagatttatgttcagctttacttgcagaaaatcttgacgctgatttattcatcatcgcaactgatgtttccgcaactttcgtagattggggtaaacctaatcaaaaagcaatttcagttgcctcacctgaagccatttcagaacttggtttcgcttcaggttccatggggccgaaagtacaagccgcgatcaactttgcgaaacaaacaggaaaagatgcagtaataggatctttatctgatattgtggacattgtgaaaggcaaagctggtactcgtattacgaaaaaagctgaaggcatatcctattatgcttaaataataaaggaactttgggaagccattctcaaggtaaaaagtgcggttggtttaaccaatgttttaccaaccgcactttaaacgttaaacataaggaactcgctatggatgcgtccaaaaagaagaaaacgtttaatttcccatcagcgtttacaattttatttgcaatcttaattctcgctgttggattaactggggttattccatccggttcatattcaaaattaacatataactctactgataatgtttttgtcgtcaaagcttatggcgttgatgataaaacttatcccgccacaacagacactcttgataatctcaatatcaaaattaaactctccaacttcaccgaaggcgtgatcaaaaaaccaatcgctattcctggcacttatcaacgtgtagaacaacaccataaaggcattgaagatatcaccaaaagtatggtagaaggtaccattgaagccgttgatgttatggtctttatctttgtattaggtggtatgattggtgtcattaaccgtactggttcttttaatgctggtttgatggctctcgtgaagaaaaccaaaggcaatgagttttttattgtattctgcgtatccgtcttaatggtgttaggcggcacaacctgtggtatcgaagaagaagcagtggcattttacccgattctggtgccagtattcttggctctgggatatgatgcgatagtctgcgtaggggctatattccttgctgcatctatgggaactgcattctctacaattaacccattctccgttgttatcgcatcaaatgcggctggtattcaatttactgaaggtattggtttccgtgctctaggtttagttttaggggcaacttgcgtaatcgcatatctttattggtactgtaaaaaaatcaaagctgacccaagcttttcttatacttacgacgatcgcgaagaattccgtcaacgttatatgaaaaactttgatccaaacacaactatcccattctcagctcgtcgcaaattaatcttaacgcttttctgcatctcattccctattatgatttggggtgtaatggttggcggatggtggttccctcaaaggctgcatctttccttgccattactatcatcattatgtttattagtggcttgtctgaaaaagatgttgtggaatctttcactgaaggtgcatcagaattagtaggcgtatccttaatcatcggtcttgctcgtggcgtgaacttagtgctcgaacaaggtatgatttctgacactatccttgattatatgtctaatgtggttagtggtatgccgggtagcgtatttatcttaggccaattagtcgtatttattttcctaggtttaatagtgccgtcttcttctggcttagccgtactttcaatgccaattatggcgccacttgctgactcagtgggtattccacgcgatatcgtggtttcagcttacaactggggacaatatgcaatgctattcttggcaccgacaggattagttttggtgacactccaaatgttgcatattccatttgatagatgggttaaattcgtcatgccaatgattggatgcttattgctaattggttccattttattggtagtacaagtatctttatatagtgtttaattagtcaaaaatacctatcttaattctaggcttggcattaaaaccttaaaatcagaagttactctaaaaacggtcaaatcaacaactgaattgcctttataaaatcatcataatgattgctcctaaaataaaaagaagcacgcatagaatgatgcgacttgtnnnngnngggggggg

SEQ ID NO: 462 - DNA, 5085 bp, H. influenzae
  misc_feature (3500)..(3500): n is a, c, g, or t
  misc_feature (3544)..(3544): n is a, c, g, or t
  misc_feature (4866)..(4866): n is a, c, g, or t
  misc_feature (4873)..(4873): n is a, c, g, or t
  misc_feature (4890)..(4890): n is a, c, g, or t
tggtaccgtatatcggactcggtaccctgcaggtatgcgtgcagtaatcgcaatcttcggtattgcttggttaggtgacactttaatgcaggcacacattactgaagtaaaagaaatggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctttaaaatgtgattcgataacaaagaacggtgctgaaatagcaccgtttttgttattctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaggggtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttcccgcgttcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaatcgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagctaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcagggaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagtaaacgacctgtacgagaacgaccgccctcaataaaatttcgacggaatagcctcgatggaatagttctgataaatattcgcgaaaaatggcagaatatagtcgatttcccttaaaagtgcggcgaataaagaatgccccccaactacgaaccattctacctataggccagaaatntaagttaatccctgccgcgatatgtggcggaacaagaccttgantgataaagcacataagaaagcaataagtaatcaatatgactacggtggcaaggcacataaacaatttcatgaccttctaacgctaatttacggacacgattcgaattttgtacatcaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccaggagaacgtccccaaagaacagaaacaggaataagttgcacatctaaactttcagaagtgcggtgtaattcaagatatttattgaaaatggtagtggtttcgtcttttgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattangtttcanatctgcaaatgccgcanaagaacatttgaaagcactttcacgtaaaggtgcaatcgaaatcattcccggcgcatttcgtggtattcgtattttagacatagttcaatgatgaatttgacggttaccgcttgtaaggcccgtggctgctggatatccgattcttgcagagagcctattgaaggaactattcggtgaagccgatatgtttaaac

SEQ ID NO: 463 - DNA, 4313 bp, H. influenzae
  misc_feature (4038)..(4038): n is a, c, g, or t
ctgtatacgattcggactcggtacccttttactcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttctaatttttagaatataaaaatcttttttataaaacactttaatttaacggtgatcgtttaaaacaatcaccgttattggtatcagcagagccagaaaggctaattaccatatttggtttaggcgtataacggactccagctgcaacggcagattgtcctcgataagtccctgcagctatgccagtaatttggcgggttatgcctcttattttattccccactgaaaccgaacccgcagtgcctttccaagttgaaactaattcatttttagctgtttcataagatttagttgcgttgtcaatcttagcttgatttggattagctgcggttttcaacttttccatattgctttttaacctagcaacttcctctttttttttcggcaaatcgtaaagaatattacgtaattctgccaaatcagcataattttgacgctctgttttataagcattttccaatggcttaatatcaaaaatatgtgatcaagatcacaaaataaaaaatcccaacggagattgggatttaaaatcactaaaaattttaccgcactttatgctttgcttacttcaaaacgttcaaatgccaatacttttttctctaatttacgtagtaataatgttgcaatgcctgtgataattaaatagataccacccgcaatgccgtaaattgtgattgcatcatattctgtaccataaagttggcgtgcgtaacccataatatccataatcgtaatggtggatgctaatgccgttcctttaaataccaaaataatttcgttactgtaagaaggcaacgcacgttttaaggcataaggaattaagattttgagtgtctgtaatcggcttaaccctaacgctgcgcaactttcccattgtcctttaggaatggcttttactgcaccgtgaaataattgggtggaataagctgcgctgtttagtgctaaagctaatacggcacagaaccacgcattggataagacataccataatgggctgtcaataatccattgaaattggcctggccctgcataaattaaaaagaactgtactaacagtggcgtgccagtgaataaagtaaggtataaattgaccgcactttttatccatttgttttccattgaaagtaaaaaagtaagaaataaggctaaaaagaaagcaatcagtaaggatacgactgtgagtagtaaactcgttggaatcccttgtacgatcacgcttaaatattcttgaaacattatttcatgcccctttcaaaacgagtaaaacgcagctctaattttcgaataccaacttggctaattaatgttaccgctaaataaattaacgcagcaataccgtaccaagtaaagggttgatgagtattggtattcatcagatccgcttggtgtatcaaatcgtccacaccaattaatgaaaccaatgccgtatcttttagcaatacaagccattggttgcttaaaccaggtaaggcgtgacgccatacttgtggcataacaatatgaatgaacgtatagcttttgcttaagcctaacgctgcacctgattcccattgtccttttggtatggcttgaattgcaccgcgtaatgtttgtgaagcataagctgcaaaaatgagagaaagcgcaaacacaccacagccaaatgccccaaattcaatgtattctcctgtcagtatttcgactaattcagtagaaccaaaatagacaagtaatacaacaataatttcgggtaagccacgtaataatgccacaaatactgtcatcggcttgccaacaaagcgatttgcttcaagcacggcaaaaataaggcttaaaaataagcctaagagcaatgaacagaccgcaagccctaaagtcattagagcagcggtaaacattaaagaaagaaagtcagaaaacataaattattttgtcatccatttatcatagattttttggtattcgccatttgctttaattgcagctaaacctttgtttaattgtgcagccaaatctttgtttgatttgtgcattgcaatacctaaaccattaccaaaatattttttattggttactttttcgcctataaattgaatttctggctctttggaaatcatatcggaaagcactgcggtatcgcccaaaataatgtcaatccgaccgctctttaagtctaaaatggcattttgtaaacttgcataggattttggactatattgcttggtttctgctacggtatattgttggaatgttgtaccattttgaacacctatatttttgcactttctaaggttgctttgcctttaagagcaacatagcttgcagagctatcgtaatacgcatcaggagaatacacttgttttgcacgagcatcgggtatacaatttgcggaaatgctgcatcaaacgttttgcctttaaactgggaattaatgaatcaaaggtttcgctcttgaatttacaggttgcttgaatttcttgacaaattgcatttgctacatccacatcaaaaccaataatttcgcctttttcatttgtggtttcaaatggtggatagctaggttccattgcaaaagtgagttcttgtgcgcttacagcaatagatgatcccaataaaatggcagttaataatgtttttttcatcgtaagctccttattttctagtgagaaagatagtgtttaaattgttccgtttttggattttcaaagcaatcagccgatcccatttcgacgattttaccttgttccatatagacgacttttgtcgccactttttgcgccacattgacttcgtgggttacaatcacttgcgtaatgccagtttcttgtaattctttaataatatctacaacttgcgctgtaatttctggatctagcgcagccgttggttcatcaaataatagaacttgtggcttcatcatcagggcgcgcgctattgcaacacgttgttgctgaccgcctgataaatgcaatggaaagcgatcggcaagttgttctaaacgtaaacgttttaacaattccattgcatcagttttcgcttcactttcactcacaccacgcactttcattggtgcttcaattaggttttcaattaccgttaagtgcggccaaagatgatattgttgaaaaaccattcctacatcttgacgtaattgtcggattgctttgggatttgccattgcattggataaattaaaatcattatttgcaatacttaattcaccagactttggcacttctaacaaatttaatgtgcgaattaatgtacttttgcctgcaccacttgggcctagcaacacaacggtatcgccctcttccgcttcaaggttaatatcaaataacgtttgtgatgaaccgtaaaagaaattgagatttttaacacgaatagccatttttcttctctatgctttataagatgaaaaaatattacatttttatgcataattatgcaagtgctattaataaaaaatcccaataaatttgggattttaaaaactcgattgaaatcaaccgcactttaggcttgttttgccatttcaaactcaattaacatcattaaaatatgaataactttgatatggatttcttgaatacgatctgcctaacgaatatggngtacactaatttcaacatccgctaatcctgccatttttacgccatctttgcctgtgatcgcaatgactatcatgccttctgtttttgccgcttcatgacgtttaaaatatttttcgaattgcctgaaatgcataaaccgattacacatcgactttttgccccaccgcttcatcatagcgagaagagacatatgcatagccgatatcatttactacccggcttaaatggcttgcatcgggaatcgcaatagcggggttacccggccgattttcccg

SEQ ID NO: 464 - DNA, 4711 bp, H. influenzae
atgatttcatctaaaatggcatacaagtttctttgaatggcattgaaacagcacaaccacggatgcctaatgcgcgaacgcctttgatggcgtgctcaatatcttgcgtggtgaatgctttataaatgaaatttaaccctagcttgtcgtacaaataattgtgaaaggtagtaccgaaattactcggacgacctgataaagacatgcagagttgggtatctttgttgatcatggtgtctccttatatatttaaattcattccatcatcaatgccgataaaatattggttcatatcgaaagcaggttttgctgctttatcttgacttacaattcgagctggcacgccagccgctgtggcatattcaggaacggggttaagcacaacagagtttgccccaattttggcgtatttacccacttcaatattaccgagaatttttgcacccgccccaatcataacaccctcgcgtactttgggatgacgatcgcctgattcttttcccgtaccgccaagtgttaccccttgcaaaattgaaacatcattttcgattacagatgtttcacccacaacaatacctgttgcatggtcgaacatgattccgtggccaattttcgccgctgggtgaatatctacatcgaaagctactgaaatttggttttgtaaataaagggcaagggatttacgattttgattccataaataatgggtaattcgatagctttgaattgcgtggaaaccttttaaataaagcaatggagtggaccacaattctacagcgggatctcggtggcggacagcttggatatcgcaagcagcgcaatcaataatcgaaggattagattgataggcttcctcaataatttcacggagagaaatagctggcataataggattggctaatttgttagccaataaataacttagcgcaccacccagattttgatgctttaaaattgtagagtgaaaaaaactagcaagcataggttcgttttcagcaagttctttggcttcttggcgaatatgttgccacacatctaatgtcataatttctccttttattttattcgcctttacatgctcgccccaaaaggctgattgctacatcttgtggcgtttttgccacaaaacagcatttgataaatttgttctgtaatcggcatttccacaccttgtctttgtgcaagcaaataggcttcttttgtattataaaaaccttctacgacttgcccgatattttccatagccatttgggcatctaatcctttacctagcattaatccaaaacgtcgattgcgcgattgattatcggtgcaagttagcactaaatcgcccaatccagacattcccataaatgtattggtatttgcaccgagcgagatacctaagcgggtaatttctgcaatacctcgagtaatcagtgctgtgcgagcatttgcgccaaatcccataccgtctgaaatacccgcaccaattgcgatcacatttttaattgcaccaccaagttgaacgccagtcatatccgaatttatataaactcggaaacctttactacaatgaatacgagactgaaattcccgcgcgaattgctcgttattggcagcaagcgtaatagctgatggtagaccttgcgctaattcttttgcaaaagttgggccagaaagtacagctagtggatattgcgttccgagttgttcttcaactacggtttgtagtaaacgccctgtgttacgctccagaccttttgttgcccaaattaatcggtgatgggcttttaagtgcggtttaatttttataagaatttcaccgaaagcatggcttggcaccacgattaaaatatcttgagaatattccattgcttgtgcaagattactttctaaatgaagatcctcaggaaagatgacatccggcaaaaaacgataattttgtcgttctgtctgcatttgtgcgatatggacgggattgtgcccccataagtgagtgggagaaccattgcgagaaaaggtaattgccagcgcagttccataagatcccgcacctagcacagtgattggtgtttgcgaagttatcatatctacaatttatctagtaaaagaggaaataagtatagatatctttcgggtaacctatcaaccacaggaaaatattacttattcatttggcggaatttaaacggcacgatggatatgccattttttcccattttgtagttgataaaattgagggtagttaaaattatgttgaacgatattgtaaggatttttatcgccttcctgtttggcgttttgataaagttgattaatctcccgcactttttcatctttttcaccatcgcagtggcgatagatttcgagatgattagattcatctaaaatataaacattgaagctgtgatcagaattatcttcaaaaaagaattgtaggaatccttcacttgcgaaggcatccatttctggtggatagcgacgactttcttggtttgtctcgccatcttcaattggtgtttgtaaaacttcgtcaaaatccaccgcactttcagcgtcattacagaccgattcatttccgatttcttgtaagctgatgccgcgatcttcaaaaaataattgccagtttttacccgctacgcgtaaacgtgacgtttggcaaggttgttgaatatcgccgacttggatgctaacgcatcgattgactaatcccatcactaattgacgtaaatcttggcgataacgttcactataacaatagacttggatggaatctgggcgattaacgccacgataaattttgttagaaagcacttttagtgcaagcaaaatggcattttgcccttcaaaatggagcgttcggatttcgttccacacgttacgataagtaaaatcaatactgcccacaaggctttgctcaagcgatccaaaactaaataaatctcgcgatgaaatacccgttaatacttcttctactttggatgttggatcggtcgtgagatttatggcaataaacaagctacgaatttcacattgattcaataaatcgctatttttaggttgtttggcgatggtgcttggaaaagactgacgtaagttagtgacaaagcgttgcaatgtgcttaaagtcacattcttgctaaaaattgacaattcggttttttctgtgagtaaatgattgaaataagcccaagaaactaatttattcaggctttctccgtattcgatcacccgttctttggagaacataatatggtgtattggttgattgataaggtaccaactatctttaaaatgtttattgccacgaacttccacaaaagtcaggtgtgcttctgataaattgtgagatatctgtgtgttgagtaaggacactttgccgggaagttcttcaaaagcagtataaagtttacgagaaagaatgttgatatcttgtggcacgacgctcgagtgaatatgatgctttcgagcaaattccactaaattacgataactcaacattaaaaatttcattatgttatcgtggttttcttttactgccttaattttccaaaatggacgcttattgagatgttttaccgtttctgcagaccatccccattcttgcgcaaggatttccatataacgaatacgccaattattggcttggtaacgtgcaaaatcttccgttgctttcacatagaaacaacggtgcacaaaatccaaacgtttaaattcagaaagtgcggttaaatattgggttacttttgcaagaatggcaatgtaaggatcaaaatggtgatcaggattggtattgcctgaaagtaaatctcgcttaaaagtgcgggcaattaagcaagtgtttgggtattccttggaataggcttccaacaacaaaattttgagcacagatttataaggtgaatcaatccctttataaagatgccataaactggcccccgaaaatatcgtttgcagaaaattgtcctaaaccgcccgaaatcacccaatcatttggatctattttcccttcagtaattaaacgcgcccacctgtttttcatagtcttttccattttccacccataaatgcaaccaaagtagaagtttaccagccaagcgtacggcggagcgatagaactcatcaagcaataacatatattgcgcagagccgctattttcaatagtcagtgggtcagcataatgttcattgcggaaacgttgttgatccatcaaataaaaattaatttccacattaaattgcattgcccattcactaatccgcttggctttttgagtaagaagtgtatattcatctggactcaagccatcacggacacaaatccaagtatcaagatctgaagaagaggtttgacttattgagccaaagctacccattacataaacgcctagaattggtggtaaaacttcgtgaaaatttaccgcacttttgagtgttgatggcttatgatcggcatagtgaatactgtattcattggtgagccattttttttgataatcagaagcaaggaaattcgcaatgccagagggggcgtgaataacatagccgggaagttgcggatggtttaggtgtagaagtaaaggtgcaatcgctaaaacgtgttggaatgcatcgcctgaaccttgtaatgcacgctcaaaacggcgttgatccaaggcgctaacccattgttttgcttgtgctagattacattccacgtggtgtccctaccagaacaacaaaaatggcg

SEQ ID NO: 465 - DNA, 4629 bp, H. influenzae
  misc_feature (4574)..(4574): n is a, c, g, or t
  misc_feature (4599)..(4599): n is a, c, g, or t
atgtatacgaaatcggactcggtacccttctagccataagtctgtacacctttttctttcaatcgagcgattaactcattcaacaataatttccccaatccattaccttgatgagagggtacaatagcaatattaaacaaagtcgcttcatctaatacggtttggcaaatagcaaaaccgataatctgattattctctattaattttaaattgagataacgctcaccttgattattttttaacgtaccaaatgaccaaggcaccagatgtgcttgctgttcgatttcatacaatcgctcgaaatcacaggcttcaatttgagaaataatagacataattaaggctgctgaatttgttgccacaacgctcgtttggcttgatgattagattgaaattgctgccaacttggcgagcgataaacctgctcagcctgcttgcaaaatggcaaagtgcggtcaatttggtcgttattttctgatagtaaccagtaacgaataggctgcttacattccatatgctggatttgatcgtaattcaaacataaacaattttcttttttaagattaaggcttaacagcacatcagccaacaaaggcgagctactgatattttcattggaaacagtgataaagcgaatattctctgccacactaattcctactgaaccttgcagtacctcggggcgatataattcccactgggaaatgcccatttcttgtaaaagaagatcgcgtctgttcataagtgaatttttaaaaacgttgcttgaaaaatagtgttaatttcttttattaatctttgctaaaatggtgcgtaattttaaccaataacccacaggattcaaagcgtgatttctctagaaagccaagttttagaacgccatctttcattttttgatggtaaatcggtattatttgctggcggtatttctgataattttcctcaaacattagcctctaaatgctcatcaatccaaatttggagttgctattttgactatgcaagaacacaaagtgcggtcaatttttccgttgaatttcaaggtcaagccgatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattagcaccctatggagaaatagcaaaaattgactctgctcgtcgttgcggtttatatcatttttcactccaaaataaaccgcactttgaacttaaaaatttctggaaaacctaccaacatcctacgatacaagacttaactatatatagtttacctggtgtatttagtgcagcggaattagatacgggcacagaactgttactttcaaccattgataataaaataaaaggaaaagtactcgatcttggctgtggggcgggagtaattggctctgtgataaaaaaaagctctactaacgcacaaattaccatgactgatattcatgcgatggcgttagaatcagcgcataaaacactttctgaaaatcaattacaaggcgaggtttacgccagtgatgtcttttctgatatagaaggaaaatttgatttgatcatttcaaatccaccattccatgatggtattgatactgcctaccgagcagtgacagaactcatcactcaagcaaaatggcacctcaatcaaggtggagaattacgcattgtcgccaatgcatttttgccttatcccgaattacttagacaacatttcggtgattacgaaattcttgctcaaacaggaaaatttaaagtgtattcagtgaaaaattagaaacaaaaaaatccccatcgcaataatggggatttttctatttattacttatggatttcaccgcactttattcatccatatatcctaaactacgcaatgcacgttcatcatctgcccaacctgacttcactttcacccaaagttcgaggtgaactttgttatcaaataaacgttccatatcagcacgcgcttccataccaatagttttaattttttgaccgcccgcaccaattaccatttttttctgaccttcacgttcaacgagaattaagccattgatttcataagtgccacgttcattcactttaaattgttcaatttcaacagtaacagagtaaggcaattcttcaccggtaaaacgcattaatttttcacggattatttccgatgccataaaacgttgcgagcggtctgtgacataatcttctgggaaatgatgcacaccttcgcgtaaagattggcgtacaattttctctaattcatgaacattattaccacgctgtgcagaaattggcacaatgtgagcaaagttaaatttactgctaagatctgtaataaacggcaataaatcatctttatttttgatgttatctactttgttaatagctaacacaactggtgcttttgcatttacgtagtttgtttagcaccatctcatcatctgcattccagtgtgtaccatctacgacaaaaataattaaatcaacatcgccaatagcactacttgcggcacggttcattaagcggttaatcgcccgtttttcttcaatatgaagccccggtgtatccacgtagatttcttgatacgcaccttcagttttaatcccaacaatgcggtgacgggtggtttgtgctttacgcgatgtaattgaaattttttgtcctaaaattttatttaagagcgttgatttacccacatttgggcgacctacgatagcaataaagccgcaataggttttgtcgaattgttcggtcatttgatgtccagttcttttaaaatttgttctgctgccgcttgttcagctttacgacggctagatccttttgccacaaaagtgcggtcaattttccccgcacttttcactttgcattcaacagtgaaaatttggcaatgggcttccccttgaatattgaccacttcataagttggcaatggcaaatgtttgccttgtaaatattcttgtaaacgcgttttcgcatctttttgattatcgcctggtttaatttctgccaataactgttgataccaatttcgtatcacttgggtcgtcacagccaatccctgatccaaagacattgcgccaataatcgcttctacacaatcggcaagaatagattcacggcgaaaaccaccgttctttagctcgccagaaccaagcgacatataatcgcctaattcaaattggcgcgctaaaatcgctaaagtgggttcgcgtaccaaagtagcacgcatacggctcagttctccttcattacaacgtggaaactgatgataaagtgcttcagcgatagtgaaattaagaatggaatcgcctaggaattctaggcgttcattatgttgagttgccgcacttcggtgcgtaagtgcctgctttaagagcgcaatatcattaaaacaatagccgattttacgctcaagtcgatctaaatgattcatcttattttattgctgtaaagaagcgatcaaaacggaaacctgttggccattcattcgcttctttttctaagctcatccaaatataagtggctttccccacaatatttttttcaggcacaaagccccaaaaacgactgtcatcgctgtgatcgcgatgatcccccatcacaaaatactgcccctctggcacaagccattctgcagtttgcattccctcttgtgggaaaaattcaaggtctgaataacgacgatactcaccaattaacacgttatgtgttacatcgcctttttcagtcaattctaattcattcggaaaagcaggatttgttggattttgtgtatattcaaacgccttggtttcgcaatcaacttcacaaggtttaccatctttgccatatacaatttttaatgttttttgttccacatcaaaaatgatgcgatctccgccctttccaacaatacgcttaatataatccacaccagacatattatcttttgaacttaacgctaaattttctgcaaaagccgctcgagtagccccaagaccagtacgaattaacgcttgttgtggtgctttaaacacaatcacatcgccacgttgtggtttttcgccctcaataatggtgttttggaaaatcggatctttcacaccataagcatatttattcacaactaaaaaatcgccaacgcgtaaagtggactccattgagccagagggaatttgaaacggttcaaacaaaaaagaacgaaccaaaaataccactgcaagcacaggaaaaagtgaagacaaaaattctgaagcctcagaaatcggttcaattttggctttttcttcctcacttaaggttttaccagaacgttgttctgcacgtgccacttgacgatgacgttttggcagcaccacaaaacgatgataacaccataatacgccagaaagtgcggtcaaaattagtaacaaaatactaaaagtatttggcaactgaaaataatctaaaactttccacacaccaaagccgacagccaataaaatcacaaaaaataaatttgacataattttccttatttatcttttcctancgtgtaaaattgctaaaaacgcctnttgcggcacttctacgttacctaaagactt

SEQ ID NO: 466 - DNA, 3224 bp, H. influenzae
aaccacacgaagtgtagtaaaagacaaagtgagtataaaacgaaatggctaattatggattaacgcgtagtggctttgtacgtaagcgtatgccagagcagttaaaagagctttatgaaaatgcgaagaaaatgtttggggaagatattgatttgtcacctgaaactgtgatgggaatgatgttaaacattgaatcagaacgctttgccgccttatgggagcttattgaaagcgtttatagtgcaatgtatccgattagcgcaaccggagcaaatttagatcgagccgtttcttttacaggagtcactcgtttacaagcagaacattcaacggtgccagtgattttttacggcaatgcaggcgttgaaatcccccaatatactgcagtacgcaatgcaggaacacaggttttatattattcagatgaagacgcacgcattgattcaaatcaagccgcttatgcacggattgagctaaattcaaataccattaatacgggcgatgtattttccgtcgtagttaatggtgtgacgtatcgttttacagcaatgcgttcatcaagtgcgagtattattcaaggtttagccaatcaattaaaagcgataagttatgccgatgtgagtaatgataatgtaattattgagatttcggcacaatctataccgcacttttctatctccgttagccaaaatcttacgctttctcgcttaggcgtgcgttgtatgctttccactgaaagccctagtgaagataaagccgatattgggcaaatgattgaactggtaaatatgattgatggcgttgttgaagtgaacaatgttgttgaaggtgcatccggtcgtttagaagaaagtgatattgaattatatcaacgttatcatcgtggtgtttggcaaaatggagccggtacaattgattcactttatgccaatttaagcaaggtagcgggcgttcattcattgagaatttatgaaaacgatgcagatcagacgattaatggtattcctaagcgttcactgtatgcggtagtcaaaggtggtttagatacggatatcgcatcgacattattaaaatttaagcctttgggtattggcacacacgggcaaaccgaagttactgtgcgagacagtcaaaaccaaccgcacttgattaaatttagtcgtccgactaaatgttacatttggttaaaagttaccattgaaacctttgttgatgaagatgaaattgcgagagctggttacattgtaagtgcactcaacaatatcttgaaatatggtaaatcacttggcgtgggagcagatgtaattcatcaacgccttattgctgcttgcattgcggttcaaggcgtgggaaaagttaccgttcagataggtaaaacgaataatattaccgatccagagccaagataccaagaacagaatatcaccatcgcacctgatgaagaagcgattttcgatccgtctatcattgtgatgagttaggagaaaatatgaaagatattttaaccgcacttaatgatgattttaagcagttagggcgagagcgattactttctcaatttaattactcgcctaacttaaacgcatttttatcacttcttcttttaccgcatcacgaaattcaagcaaccttaaagcaaatgcttacagaaaggcatattgataccgctataggaaaacaacttgatggcgtaggcgatattgtcggtatgccacgccctttcgctagagtaaatggcgattggtatttcggtttttctggtcaatcaaaggcaaaaccctttagtcgagcccctattcgtgatttagccacgcaaactaattctagagattttaattatatgctcgatgagcattatcgacgattaattaaatggaaagttatcgccaatcattcacatggcacccttgatgatgtaatcgaagcctgtagggctatatttttagcagagcgtgtttcaatcacagaaggacaggatgcagatgtgcatatagcgattacacgaatggcaaaaaatagattagatgcagtagaacaagagccggttttgtggattcccacggcagcaggtgtaaaggtaacggtagaatttataaacgcataaggataacaaatgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgagggcaattattacgttagcaacggtcaaaatctacccgaaatgggcatggcatattgaagtatttagcggtggggcacaaaaggcgggcgcgcaattgcacgtaagggaatgaaacacaatccaacccgct

SEQ ID NO: 467 - DNA, 3591 bp, H. influenzae
  misc_feature (3501)..(3501): n is a, c, g, or t
gagggggagggggggaggggggaaggggggggggggggaggggggaggggggggagaaggggggggggggggggagggggagggggaagggggaaaggcaacactaacacaaaagggaaagggagaagaaggggaagaaaagaaaaggaatagaaaatcaaaggtagggagaacaaagtatcatgtaatcattgcagcaacaatattagataatcactcgaacattcccgcctatttccccacaaataggcgttttttttattcacaaatcgctaagaatccctataataaaaccttttaaaacataatttaggaaataataatgactaacattaataccgttctcgcggaactaaagcgtggtactgatgaaatcctttcagaagcggatttaatcgaaaaactgaaagaaaatcgcccattaaaagtaaaattaggcgcagatccaaccgcaccagatattcatttaggacatactgttgtattaaataaattacgtcaatttcaacaactcggtcatgaagtctatttcttaattggcgattttactggaatggtgggcgatccatcaggtaaaaatgcgactcgtcctccacttagccgtgaagatgtattgcgcaatgcggaaacctataaagagcaaatttataaaattctcgatccacaaaaaaccaaaatcgtcttcaactctgaatggttaagcaaacttggtacagaaggtatgattcgtcttgcaagcaactatacggttgcgcgtatgcttgaacgcgacgacttcaaaaaacgctttggcaacaaccaacccattgccatccatgaatttatttatccattactgcaaggctacgattccgttgcattagatgcagatgtagaactaggcggtacagaccaaaaattcaacttacttgttggtcgtgaattacaaaaatcagcaggcaaaaaaccacaggttgcgattacactcccattactcgttggattagacggcgagaaaaaaatgtctaaatcacttggtaactatattggcgtaacggaagcaccaagcgatatgttcggtaaagtgatgtcaatttctgatgaactcatgtgggattggtataaccttctttcatttcgtccattaagcgaaattgcacaattaaaatcggaagtagaaaagggcaaaaatccacgtgatgtaaaaatcttattagcaaaagaattaattgcacgtttccacaatgaagaggcggcaaacgctgcagaacaagaatttattaaccgtttccaaaaaggcgcaatgcctgatgaaatgcctgaatttacgttttctggcgaaattggtttagccaccttattaaaagaagcaggccttgttccttccacttctgaagcgattcgctctgctcaacaaggcggtgtaaaaatcaatggtgaaaaagtcgataacgtaaaagataatgcaccgaaaggcacaaatgtttaccaagtgggtaaacgaaaatttgcgcgtgtgactgtggaataaaatagataaaaaaataccgcactttggcaataaaagtgcggtattttttattgaaattttaatttagttaaacatcgcagaaatagattcttcgttgctaatgcggcgaatggcttctgccagcatggaagaaagcgtaagcacgcgaactttaccgatcgctttcatttcttctgatagaggaatcgtgtcagtaactacaacttcatcaatggcatcgctggctaaatttttggctgctgcaccagagaaaacggcgtgagttgcataagcaaaaacacgttttgcaccacgttcttttaatgcttctgccgctttacaaagcgtaccgccagtatcaatcatatcatcaaccaaaatacaatcacggtctgcaatatcaccgataatatgcatcacttgtgctacatttgcacgagggcgacgtttgtcaataatagccatatccgtatcgtttaataatttagcgacagcgcgagcacgcacaacgccgccaatatctggggaaacaacaattggattttcaagatcagattttttcaaaatatcgtgaattaaaactggcgaaccaaatacgttgtctacgggaacatcaaagaaaccttggatttgttctgcgtgtaggtcgcaggttaagacacggtcaataccaacaattgaaagtaaatctgccacaactttagcagtaataggcacacgagcagaacgaacacgacgatcttggcgagcatagccgaaatagggaatcacggcagtaatacgaccagcagatgcgcgacgtaacgcatctaccatcacaaccaattccatcaagttatcattggttggcgcacaagttgattggatgataaatacatccgcaccacgcacattttcattaatttgaacttgaatttctccatcgctgaaacgagcgactgttgcatcgcctagtgaaatatataaacgttcagaaatacgttttgcaagttcaggtgtagcattacccgcgaagagtttaatgtcaggcattttataaaacctcaggtttagattgtcgatgagtatgagttgatgatagctgcttcaacattgcgtgcaagggagacacattgagtcctttagcgacgaaaccaaaaaaatgcttctggtttttgtctaaataccgcttgcgcttctgcttcatgatcaaattcagcaaaaacacaggctcccgttcctgttaatcttgccggcgcatattgtagcaaccagtttaacgctttttcaacgtttgaataatgatttatcacaactttttcgcaatcgtttttataaggttcactcaaaagttgttcgagggattttttcggtgtattacgtggtaaatttggatcttgaaagatgacagccgtcgatattgaatcatcgggttttaatataacaaaccatttctcggcaggttcacaataagtgattttttccccaacgccttcagcaaaagcagcctgtccgtatacaaatattggcacatccgcgcctaatgttaatcccaattttgccagttcatcaatggataaattggcttgccataaataatttaaagagactaatgcggttgctgcattggatgaaccgccaccaacaccgcctcccattggaagaattttatctaaatgaatatttgcacccaattgaatattggctttttcttgtaaaagttttgcagctcgataaattagattattttccgtttttagatttggaatttctggcgttaaaacaatttgattatctttgttcccgaatactaatgtctaaccaatcgccaaaatctaaaaattggaaaagcgtttgtaattcatgatagccgttcggcaattttccattgatataaagaaaaaaattcagtttggcagggctagggaagcgtaatggctgccatttgattgtggttgattttgggcaaagagcgggagaaaattgaggggattccataatgaattccttagaaaccacttcgctacgcgatntttagggtggttttgggcggcatttttaaaaaaaatttcggcctccaatatttgaggatgggtgaaaaactgccgtctttgagaccctcc

SEQ ID NO: 468 - DNA, 5386 bp, H. influenzae
caaatttcattatgtagcaatggatttttccatatatcaccagtttatatttagaaccgataatgcacattctttttctacaataatctctaagtatgatcccattgctgtaatatgatcatttttctccagataggtaactattttctcaatccacgatggtttagctatatcatcagcatccattcttgcaaaatatttactctgaaaaacaaccaaggcctatattcaaagaatttatgaaccctaaattatatttattactgataatttttatccttttatctaatttagatatttcttctaaatgagacaaagtcaaatctgttgaaccatcattgataactataatttctagatttttataactctgattaataatggatgaaatgctttcatctatatattgctcagcgttataagcacaaacaataaccgatactaatgggggattttccatataagatccaattttacactcttatttaaattgttttatacgttatttaaataactagataaccagttaaaactctcctaaattaattgttttacaatagaaatttgagttttttaaatcactgtgattaaaacgccattcatattcctttaaaaatagcttaagaatatcataacctctgtagaaattcatataaacaatactaccttgtttaccttttctcgaataatcagtaacagtgttgcagattgcatattcataaccaccacggtgtatactttgctatttcgtttcaaaaaacaaattacgaagtttttccagcttatccttgaccaagtttacctttcagagcaccaccaaaatagctttcattcgcttgaatttcaccttcaaacatttccaaatgtaggctgctttgagtgataaataatggtagacgatgaaagtaataagctgaagtttatttatatttaccaacttagctgcagctagagctgtcacacttgccagaaatatctcaataagtttattttgcttatattgacttaagcgactttctctcatttgattatcttaacctaaatagagtttttagtcgttatctgtgacagctctagaattattcaaatccaaataattaacgccatgctttaaattgattgattaatccatttgttgaactatcgtggcttgcgactttttcagaatcggttaattcaggaagaattctatttgcaagttgtttgcctagttcgacaccccattgatcgaagctaaagatattaaaaatcacaccttgtacgaagattttatgttcatacatcgcaattaatgcacccaaggtaaatggcgtgattttttgaacgagaatggaattagttggcttattacccgtaaatactttaaatggaacaatatttttcacatcatccaaagatttccccgcttttacaaattcagcctcgacttcctcttttgtttttccgaatgctaatgcttctgtttgtgcaaagaagttggaaagcaatttattgtgatgatctgccaatgggttatggctttgagcaggtgcgataaaatcacaaggaattaaagtagtgccttgatgaattaattgatagaacgcgtgttgtccatttgtacctggttctccccaaataatcgggcccgtttggtaattgttaatgacattgccatcacgatccacatatttaccatttgattccatattaccttgttggaaataagccgcaaagcgatgtaaatattgatcataaggtaagattgcttctgtttgggcaccaaggaaattggtattccataaaccaactaaggctaaagtagttggaatatttttttcaattggagtagtgcggaaatgtttatccatttcatgcgcgccatttaataacgcttcaaagttttcaaagccaattgatagtgcaattgaaagaccaatagctgaccataaagagtaacgaccgccaacccaatcccaaaattcaaacatgttattggtatcaataccaaatttttctacatctttagcattggttgataatgctgcaaaatgttttgcaaccgcactttcatctttcgctgcttttagtaaccaatcacgcgcactttgtgcatttgtcatggtttcttgagttgtaaaagttttcgatgctactaagaaaagagtcgtttctggattgactttttttaaggtttccgcaatatgtgtaccatcgacatttgaaacaaagtgcatatttagatgatttttatacgggcgaagtgcttcggttaccatataagggcctaagtcagagccaccaataccaatattcactacatccgtaatggctttgcctgtatagcctttccattcgccagaaataatacgctgacagaaatctttcattttagctaacacagcattgacttcaggcataacatctttaccatcaacaagtactggcgtattagtgcgattgcgaagtgcagtatgcagcacggcacgattttctgtacgattgattttttcgccagtaaacatcgcttcttttgcactatcaagtgcgcattcttgagcaagttggcgaagatgtgaaagggttgtttgattgatgttgtttttggaaaaatcgacaagaatttggttattgaatgttaaagaataatcgtcaaaacgatttttttcttgtttaaataaatcttggatggtggtgtttgataattcagctttatgtgcttcgagagatttccacgcttgggtgtgagttgggttaatatttttcatggtatttcctttcattaaaaataattgaaattttaaccgcactttctggaatttttattagggagaatgactccctctgttcaaaaaatgcagtgattaatcaacgtattcagttataacacgaggtgttaattttgtaattagctcgtagcttaaaatgcctgtgaatttagctacggtttcaataggtaattccttgccccataaaattacttcatcgcctaccaaatcttggctatctgcgcctaaatcaacagtgagcatatccattgacacacgtccaacaattggtacgagacggccatttaaataaacaggcgtaccttctggcacatcgcgcggataaccatcgccataacccattgcgaccacgccaattttggtatctcgtggacttgtccaaataccgccgtaacctacaggatcgccttgtttatgatggcgaacggcaattaatgacgaggttaaattcatcactggcgttaagccaaactctttgccaatagtatcagttggagaaatgccgtacataataatgcctgggcgaatacattctaagtgagattttggccagaaaagaatgccgccagaagctgcgatagtgcgttcaccttgtttatcttttgtggcggataaaaaacgattgatttgaagttgggtgtaatctgattctagttcatcggctcggctgaaatggctgacaaagcctaagtgcggttgaatttgagggagttttttcagttcttgataaaaataatccacttcatcaagagcaacgcctaaacggtgcattcccgtatctatttttaaccaaaccttaattggacttggtaaatttgaacgttttaaagcctcaagctgttcgtgattgtgtaccacggtttcaatattattaacggctagaataggcaaatcttgttcattaaaaaagccttcaagtaataaaatcggtttagtgatgccgttggagcgtaatgctaaagcctcttctaaacgagccacgccaaagcaatcgacattttgttctaaagttgatgcaacaaacacaacgccgtgaccataagcgtttgctttaaccacagcaataattttgctatttggtgctttttgtttaattatttctaaattttgttttaaggcgtgcgaactgattttcgctgtcgccggttttacgttcattatttttccttaataatcatctcgatattcacgttgttcggcaagattgtcaaagcgtgagaattgtccattaaattttaaccgcactcgaccaattgggccgttacgctgtttaccgataataatttctgcaacgcctttatcttccgagttatcgttatagacttcgtctcggtaaataaacataatcaagtctgcatcttgttcaatagagcctgattcacgtaaatctgaatttacagggcgtttgtctgcacgttgttctaaagtacgatttaactgagaaagggcaactactggcacttgtaattctttggcgagtgctttgagggaacgagaaatttctgcgatttctagtgttcggttatctgaaaatgcgggtgcgcgcattaattgcaaataatccaccataatcatacttaatccaccattttcacgataaactcggcgtgcgcgcgaacgaacatcggtaggtgctagacctgcaagatcatcgataccaagattatccttttgcttgaacattccccactacgctagcaattttattccactcgatttcatctaaattttgacctgttcggattttagtttgatcaacgcgagcaagcgatgcgatcatacgcatcataatttgttctgctggcatttctaaactaaatactaaaacgggtttttcacttgccattgcggcattttcgcaaaggttcatggcgaaagtggttttacccattgacggacgtgccgcaacgataattaagtctgaaggttgtaaaccagccgtttttttatcaagatcggtaaagcccgtcgtaacacctgttacacctgaatgattttcaagtttgcttaaaatatcgattttttcaatggtactttctagcacattgatcacattttgtgggccttcgctagaagttgttcgtttttctgcaatcgcaaatacttcacgctcagcctcatcaagaattaacttaatgtcttgccctttaggagaatagctattttcagcaatgcgatttcctaccgaaataagttctcgtaatatggctttctcacgcacaatatctgcataagccaaaatattaatcgcgttcggagtattattagaaagctctgctagataggcaaatccacctacttcatcgctgacaccgtggcttcttaaggcttgatctagcgtaattaaatcaataggcgattgattacgcattagatgttccatttctgtaaaaattagacgatgctgaaaagtataaaaatcgtcagcaatcacacgttcagcaatgccatcccaatgttgattgctcagcatgatgccacccaacacggcttgttcagcctcaattgagtgcggaggaatgctaacttgtgctgtttttttgtctgaagatttgatttgaggttgtgatgccataggacttattcgatatagaaggggaccgagccgaatcgaacat

SEQ ID NO: 469 - DNA, 3494 bp, H. influenzae
ggcattcttgctgcctgcagttcactctatgagacccccttcttatggtggtcaataatgtcagtaatataagccattaaaagtaagctcttcaaaacaatttgtaagagatttaactgatttagctaaacgctcccccaatgtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaatagaagtaatcttaaataataatccgcacgtaaaatgtgcggattatttttacataggattaaaattcaaactgaacagacattctgtaatttctgccaggtgcataaaagcggtttaagccttcaccagtttctgtttttactcggttaattgtgccaagatgtcgaacagagcgagcagagtcccaagtgagatattttttgttggttaaattatatacaccagcggtaaatgtaagatttttaattggtttccaataggcaatcgtatcgatcactgtatagcgattattacgccataatccgcgagaatcttttacatctttgccgtttgcttttgtagcaggtatatctgttgcattgtcagtatattgcttttcttttctggcgaccatacttgtccattgagaattaaagctatcttttgctttttttgctgcaacattagtgatatacatatccacgccccatttttggcttggtgcatcatagccaatattgtataccgatgtggttggttgtaaggcattcattggttgaggtttacgagcaatggcttcgtattctggatgttcatctttattcaattccaaaaattctttatattttggatgtaatccattgtctttgattctgcctttttgataggtaaatttatagcctaaatggaaaccttgtagtttttcaaataaatcgcccatctcaagacgtgaagcaatttcgatacctctgactcttgctcgatctcgattttggttttgatggaacggatattttattgcagagccttcttcaataggacgttcgcccacttctactaagtcaataaaattacggtaatcgttttgaaacgcatttaacgtaatataactactgtttttataaaaagtgaacgcgacttcttttgttttggaggtttcagcttttaaatctgtgttaggctgaatggaaaattgtggatgtttaaatgtcatataaatttcatcagaggttggcgcacgaaaaccattggcgtatttaagctgtacacgaagccaatttgtgggatcaagatttaaccctaaattgtaagaatgatgtttatagtcagttttgcgtaataacagggcaagattgtcttcaaaattttttttataacacggtgtgtcgtaagtgcaattttcatatcctggaggtattgagtatttactaccataaacatattcctttgagctaaatttcttaaatagcccagtaattaatccattaggaacaggaatgtttttgtcataactaggcaaatattttacgtggtcataacgataatttaaatctagtcctagccaagaggtaagttgcacattatctccaaaatacaacacattatttttagtggtaacagggattaaataggtatctttacctttattggaattcattaagctacatctgtaagcactatgatcaggtgcaggagtatgctccacaggatatgtgccatctacaggtttgttacagaaaaaattgccagcccaccattgcacattggcaacagtgtagtattgatgattcaccatactttttagtgttttttcataaagtccaccatattttagttggtgttgggtatgccataggtgaaattctttgtctaaatcaagtttaatttgttgggtatgggtgtttaaatcacggtcattaacgaagtctgtgctgtagccatggctttttggaaataaaaatttagcactttcatattgggttaatccataattaccttctgctgattttagtgagatttcaccatattttttgccatttaattctttaatggtaatatttcggtcttcataattatatttgtcattcccattttcatcttttccaacaaaaacctgaaattttttattacaatttaatttttcacaattaattaagaccgaatcaagtgagcctccttctgtatctacatcattactaacatcttcaccctttttgttttgtagttctaagccataattatattttcctgtaaattcttgattgtctttatctttaatcttataaattccaccttcttctactaaatgtagcccttgtggattacgtacaccagcacaagtggattgatgacaatactcatcagagcgtgctttattggtaattttttgtgaggaataacttagtttaatatgatcccaaaaaggggtttgactgaaattttcataactaaattgaatattttttcttttagattgatcattaataactcgctcgccatatttttcctcacatttagtatttttgcattgattgaaaatataagacaaatccataccctttgtttctaaagtggaatcatctaatgccacgctcaagcgatggttttcattaggctgaaagcccaattttattaatgtgctttggcgggtaatttgataaggatcggctttttcacgggtaggaccaaccgcacttaaatccgcctgtttattgggataaattttataatcgtagttttctatttcgtgcccatcacgttttgtatcaacgactaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcaccactaccggattttaaggagtcagcacctttggtaatagttgctgttttaacattttcaatttcaatgctattacgagtattattaaaattgccatagccttcaaataattctttaaatccttgagagcttaaggtttcagcttgacgaagcccatcaaccataatacctacacggttttcatcaacccctcgaacagcataaccacttgcgcccgttctacctgtttcaaccaccgtaatacctgtttcatagcgaacgagatcacgagaatcagacgcctgctgtttcgctaattttttggcagaaatttgggtttcacctacctttttctctttcacattaattgtttctgtacttcctgaaacattaatttgttctagttgttcagaaacattactattttggttggttggttggttggttggttggttgg

SEQ ID NO: 470 - DNA, 4019 bp, H. influenzae
  misc_feature (890)..(890): n is a, c, g, or t
  misc_feature (921)..(921): n is a, c, g, or t
ggaattcggctcggtacccataacgcaggtcacacacttattatcaatgggcgaaaaaaccgtattacgtttaattccatctggtatgttacatccaaacgtaacttgcttaattggtaatggcgttgtggtttcgcctgaagcattaatgaaagaaatgggcgaacttgaaagccgaggtattaaagttcgtgaacgtttattaatttcagaagcttgtcctttgattctgccttatcacgttgcaatggatcacgcacgcgaagcagcccttggcaaaaaagctataggtacaactggtcgtggtattggcccagcttatgaagataaagtagctcgtcgtggtttacgcgtaggcgatttatttaataaagaagcctttgccgaaaaactcaaaaacatccttgaatactataatttccaattggtgaactactacaaagttgaacctgtcgattatcaaaaaaccttagatgatgtaatggcaattgccgatgtaatcacaggtatggtggcagatatcactacaattcttgatactgcgcgcaaaaatggcgaacatattttatttgaaggcgcacaagggacaatgttagatatcgaccacggtacttatccgtatgtaaccagctcaaacacaacggctggtggtgttgcaacaggctctggttttggcccgcgtaatcttgattatgtacttggtatcattaaggcttactgtactcgtgtaggtggtggcccattcacaactgaattatttgatgatgtaggtgctgaaattgcacgtaaaggtaacgaatttggtgcggtaacaggccgtccacgtcgttgcgggttggttcgatgccgtcgccattcgtcgtgcaatccaacttaactctatttctggnttctgtatgactaaactagacgtattagatnggtttgatgaagtaaaatctgtgttgcttaaaaatgccaaatggcgaaatcgttgaatatgcaccgttagcggcgaaagatgggaaggtgtagaaccaatttatgaaacattaccaggttggaaagaaaatactttccgcatcacagatgtaaataaattgccacaaaactgcattaactatattaaacgtattgaagaagtaactggcgtacctattgatattctttcaactggccctgatcgtgtagaaacaatgattttacgtgatccgttcgctgcttaatttcttttgattttcagaccgcactttaaaagtgcggtctttttttatattttttactattcttcaatagaacgtaataattcattgatgcccacttttcctaaagtttttgcatccacttttttcacgatcacggcacaatataggctatattttccacattttgatggaaggctacctgataccaccacagaacctgctggtacacggccgtaatgaatttcgcctgtttcacgatcataaattttggttgattgaccaatgaatacgcccattgaaataacacaaccatcttcaacgataacaccctcaaccacttctgaacgcgcgccaataaaacagttatcgccgataatggttgggttagcttgtaatggttctaacacgccgccgatgcctacaccacccgataaatgcacgtttttaccaatttgtgcgcatgaacctaccgtcgcccaagtatctaccatggtgccttcgccaacgtaagcaccaatgtttacataagatggcattaatacgcagtttttagaaatatatgcgcctttacgcaccgttgcagaaggcacaacacggaaaccttcttcagtaaaacgttcttcagtgtaatccgcaaattttaatgccactttgtcgtaatattttgtttctgcgccgtcaatgatttggttatcgttaatgcggaaagatagcaataccgctttttttaaccattgatgtgttacccattcgccagcaattttttcggctacacgatattttccagaatctaatccttcgatcacttcttcaattgccgcatgcgtttctgcatcaacggtttttggtgtaatttctgcacgtttttcaaatgcagcttcaataattgcttgtaaatttgacatagaacttcctatatatgttgtgaataaaacggcattagttttaccatattttaaacgggcaagcaaaacaccgaaaaaaaatcaccgcactttgtagaaacaaaactgcggtgataataaaaagttgatttgattaaaagattgaaagtgcaagccccacgacaacagacatactaaaaacaaccataatcattgcataaccaaaatcgctcattttgttctcctcataaaaaaaataacgcagacattctagcaagaataatacgaaaaaatcacttctttttataaaaaatttgcaataaagatgactaaattctcaacaaacctttataatagtgaaaaattttttagggatttaaatatatggcaacaattaaagatgtggcaaaaatggctggtgtgtccaccacaaccgtatctcacgtaattaataaaacccgtttcgttgcaaaagatacggaagaagcggtgttatccgcaattaaacaacttaattattcccctagtgctgtggcacgcagtttaaaagtcaataccaccaaatccattggtatgattgtgacaaccagtgaagcaccgtattttgccgaaataatccattctgttgaagaacattgctatcgacaaggttattctttatttttgtgtaacacacaaaatgatcctgaaaaagtcaaaaatcatttagaaatgttggcaaaaaaaagggtcgatggtttgcttgtaatgtgttctgaatatactcaggattcattggatttactttcatcattttccactattccaatggttgtaatggattggggcccaaatgcgaataccgatgtgattgatgatcatagttttgatggcggttatttagcaaccaaacatcttatagagtgcggtcataaaaaaatcgggattatctgcggcgaactcaataaaactaccgcaagaacgcgttatgaaggctttgaaaaagcaatggaagaagctaaattaacaatcaatccgtcttgggtactagagggtgcatttgagcctgaagatggctatgaatgtatgaatcgtttactgactcaagaggaattaccaaccgccctattctgctgtaacgatgtgatggcactcggtgcaatatcagcactaacagaaaaaggcttgcgtgtgccagaggatatgtcaattatcggctatgatgatattcacgcctcacgtttctacgcaccaccattaaccaccattcatcaatcaaaactacgtttaggcagacaggcagtaaatattctattagaacgaattactcacaaagatgaaggtgttcaacaatatagtcgtatcgatataacccctgagcttatcattcgaaaatccgttaaatcgattttataaacttagcaaaaatagaccgcactttttaaataatccctaaaaagtgcggttcttttttagctattttttagcttttcttgattattttcaaaatttctctgaatagcatttgccctccaccctatttttagttatatctatcgccaactgacaaattttattttttacttttaggagttcctatgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgcttcagtcaatttttaacctcactacatagcagaacatatcaaccatttcccggaacattctcttgcacaagttcttctcattccttagcgactttcaacgcttaaaagacaaatgcttaatggaagagtgcataaaaccgcgaaaatattatt

SEQ ID NO: 471 - DNA, 5085 bp, H. influenzae
  misc_feature (4896)..(4896): n is a, c, g, or t
tcttaaacctgcatcaacaagcacaaagcctttttggatagctactacagtaccgctaacgattgaaccttgacgagtttcaaggccttttaatgattcttcaaaaagttgagcaaaagattctgacatataaataatcttcttaatttaagttaataacatccacattaaaatccataaaatgcggggttgaggataaatgcttattcttccttgaacaaacagttaaatctaaactgataccttttcttgaatataagacaacgcctgatcgatcacttcattgatactcaaggctgtgctatccaataataaagcatcatccgctggttttagcggcgcaacttcacgatttctatcacgaagatcacgctcttttatctcggctaaaatctgtgcaaagttaccatttattcctttattttgcaactgtttatagcgtctttttgcacgttcttcagcacttgcatctaaaaataattttacttgtgcatttgggaatacaactgttcccatatctctaccatccgcaattaatccatcatttttcgcaaaatcttgctgaagttgtaataaagctgaccgcactttttgaaaaactgctacttttgacgcagcatctgccacttcttgcgtgcgaattaaacggctcacatccattcctgcaagcaaaatgtttacctcgccattttgaggaataaattgaatatctaaatgacgtgctaattctgctaaatctgtttcatttgttagatcagttttacgttgcaacgctgccaatgcagtaacgcgataaatcgccccactatccaacagtgcatagcccaacttttcagccaacgcgtaacaaagcgtccctttcccagcaccactaggcccatcaacagtaataatcattcccatacaaattatcctttcattatcaaaattttgcgcattatagagacaatttcccctcattaccatcctagagattattactagcttccatgttttgtatggcttatctaataaagttaatttcacaagctctaggaaagcgtaaactccctttcaagctttttcttaaatttcagaaaatctaaccacatagaaaaaggtttttaaaaacatttcaaggtttttttaataactattgtggcacttaaggacgaaattctttcagctaaagtagctcttttttctattattaaattggacaatccttctgacgttctacacttcgtttatacaaaaaactgaaattaagcacactagacattatgccttttaatatatacgcattttttcaaacttgttctaaagacttttctacattacaataaaaaacgtagctatcaatacaaataaccaaataatgaggacaaagaaatggctgaaaatcgttatgaactaaataaaaacttagcacagatgctcaaaggtggtgttatcatggatgttcaaaaccctgaacaagctcgcatgccagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaataaatgaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtccaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataagtactttatcgatatatgtaaagtagcataaaccattatctgcatatctgccctccctaggaaacaaaccatattgtagcaatgagagcagataattttcatcaaaaacccgaccagttactagacttaaaaccgaatgcaaggtaggataaggttgaacaaaaacaaaatttcttgttgtattgacgagagcaaacgccacttcgtaattgggctttccccaaaacgaaccaaaatcaacaatcctaaagacattacacaccattgagtatttacaaggtttcaatgcggactgaatcatctatgaaagcaccgacggcttggatcttacgattgccaaaatattatatcaagcagcctttttcgtgctcattgccaatccacgacaaatcaatcactttacaatgtcacatttagtaaccaacaattactgtacaagtgtagactggaataagtcaaataattttgcggtaaacatcagataatttgctgaccttattttgatgagttggctctatctaagaagaggaaataataaacaagcggtcacatttgacatcttgtttgcattttagaggtttattccgcccagtattttttcctcgtcgttttaccaatacctggattaaagctattggttggatccaactctttatagaattttctcaaggttggtttagcctcgtataaatgccctacattgtgttcggctgggtattgcgcaccacgcttgtcaagtaatttcaacatttcgtattctagttcttcataatcataacctttttttacaatgtaatcttggtgaaagacatggcacataaaatgtccgtagtaaagtttagagataattctgttatcaatttctggcggtaacacttcaaaccaatcttgatcattgcgacgtaatgcaacatctaaagcaactatttcttctacttctttttcgtgaattgcacgataacgaattgcagcacttgcaacagcgaaacgatgaagcattgctgcttgggtttcgattgcattacattcaaaatagccaccttttgagccatctgcaatgtaggattccaaatattcacgggcttcttgaatgccttttccacccattttgataattaagtgatgctcgtatttgttgcgataatcccataagctttgtggaagatgttctgggatgaatttagacacagtttgcataagtttatcgcttaaatgttgtggtaaaaagaagaattttttgccgatgcgatccacgtttgattttaaggaaaagagttttggtagccaatgtgtaccaaactttttaatgacccaaaaggtatctttgccatattttgctgcgatgtcaaatgcatcacgatggatatattcacctgaaatgggtagcacttcgaagtttactaacatgtggcgacgaatatcgctcaacacagaagtttgattggtgccgatatagaaaacagccgtctctttttcaagcggaaaggtgtctaaacgaaccgcaaagacagcaagttttcctgcacagcctgaggcttcatagtggcgagctgggtcggcattaaaacgagcaggggagccttcatcaacttgacgaacatagttgcagtagtaatggtcgtgaccatgtccgcaatcttgtcgaatatctttaacctgataacgtttttcttgtagattagttaaaatttcttcaggagtttctcctaaatcaatgcctaaatgattttttagttctaattcacctttttcattaagttgagcgtaaagtgccatttctgtataggctggtccacgttgaactaatgctccacctgagttgttacaaatcccaccaataactgatgcgccaatgcaagatgagccaataacagagtggggttcacgaccaaacggtttaagttgattttctaattcattgagtgtagagcctggtaagcaaataacttgggaagcgttattgatgagtttgattccgtcaattcgcattgtattgatgacgacaatatcgcgatcataatcattgccatctggtgtagagccaccagttaaacctgtattcgccgcttggtttataacaataacatcatgttcaacgcanacttttacaatgttccaaaactcaagtagagtggcagggcgaacacagctagggcgtttcctgttccaatcgataacacttcgatagcttctgtttagttggatcagtataatataccggatccacattttgtccgtcgcgaatgattggtgaacaactattatatccctttgtataaaatagagtact

SEQ ID NO: 472 - DNA, 5466 bp, H. influenzae
  misc_feature (1636)..(1636): n is a, c, g, or t
  misc_feature (1647)..(1647): n is a, c, g, or t
cgaattcgactcggtaccccgcagagcctgggctgcagcaatcacatcttttgttaatgagccatagttataggcataagatgttaatgcggcttgggcatttggcggtaacttatcccatgttgaagatgatacgttatttctcgctctatttgcaaattcttgtgttcgacgtgctaaatcacgctctgcgtcagcgcgactaactacagtatctttcgttactttgacaattgtaccatccgcttttgtgatagtatctgaaccatatccagtgcgataagcattgacatcccaatatgctttatcactaaacccttcaaattttttcaacaaccctgtagcttgatcaagtgcagtccctttaattgctggaactgatgaataagaagtgttacctctactatttccggatgtaccgccagtcccggtgtaagacagggagtttgacatctgaggcacttctaaagtgacattgttacgaggaatattgatattgtcagcatctgccaattcagcagcattgctattcgtaccattagctaaatcgctaatccgtttatctacactgtcacgtgtaacatttccggttccagtgttatattcacgtagctctttattttgtaggattgcaactgcggaattcccggtaagtgatttttgtagatcaatctccattctaatttgacctatttctcggtcaattaaagtgaggatcttttctaactcttcttgagcatctttattgttggccacatttggctcacgcatacccgttaaaacagctcgacgtgcaagaagcattttctccattgttttagctacagcaatttcactggctaaacgctgccctaatacttgagcatcgggatcttctcgtaaagactcaattaagccacgagttacaggaactgttgtagaacttaattctgcaagtacttcaacggaaggagtgctcatgttaagcgctttttgtaattgagttaccgtcttaatattttctttttcaatttcaggtgttaaaccaacaccagctcgagagctactagcagtaccacaatctgttttacaagtagttaattgcttctcaccgatcacattcgttaaccaatctgtcatatctttaggattatcccaagtttgacaaagtaatccgctacaactactaccggagattcgacctgattctaatacattacgcttgttttgcatgttgtagccagcttttgcaacatcctcaacaattttgattggttcttgtccttggccaccgcgttttttacccccgacccactctttaccttccttaccttgagattcctcaagtctctttttagctcgagtagcatctggttcagttgaagtaatgtctttaaaggattccatatccgaactttgagaccaacgaccatttaaagttgcgtctgcaagcttcttagacatttcttcacagctggtttttaagctattaaaatcaattttaccttgatataaaccattcgtaagaatatcgtataactgaggatttgctcgttgaataaccattgcaggtaaactcgccacagctcctgtggctgattcgataacgttactataaagatctttaaatccttcagttaaaccatttaactgattnttaatactcgncttaatgtcaaaattaccgcacatcaagttagctttccaaccaatcccaaatcagctgcaggaatcgtacctcgactcgggggagccatataacctacaccgcccccaatttgataaaacaccatatcagacaaaatagaatcggctttattaaatccaaacggattactattagaagctgatactggcatggttgaggataagattgcgcacgatatagcaatataagatgctttcagtgcatgatttaatttcatactcaattcctttattaattagaccaatcaatactatacaaaaatgtttgtccgcgttttttacagcacttgtaagggcgccataatgcccaggcataactaccattttcagatagcatacttggcgggttatcagggaaaatagcacaagactgtgaagtaaccgggtgaagctgttgccatttatgtgtcttttcatccccttctttcactggagggggaaaccactcaccattcgattgattatcttttttcgcaatcggtatatatacatgtggttggaaagtatttgtcacaacatccgctactcgatgcgctgttacagctgaagctttatagtcatgaacttgtgttactgtacccgctcgtggataaatatttccccaagtgtctccatttgctctaatttctctcatacctggaataagcgcttcaggataaaccatttccggaacaccaaatcgccacgctaaaaagtccaaaccactcaagtaataaggcacaaaaggcgttgtctgacttttgcagtaataccctgtactattaagcatttgactaatcgctccctgcggatgaccgattacatcaacatttttaaatgttgcttgcgtatagtctttgtgtggtgattgataatctccaccttttaccccattgctaaggaaattcatttccacccaaggattttgagcctgatggttataacttgaaaccactacctcgggaatatagtgttttattttcgtagatgtccggattttacagccgaattttgtacaaaatagccaaaaacaagtaccaacgaccttataatctaaacaacttgtcgaagcgcttgatgccataatcgatgcagtgtttaaagaagattgaccggactccgaagcttgtcctgaaatactggtcaacgcaattgcaatacaaagcccggataatgtcatttttttcaatttcatcttgtcccctcttttgtaatctctcgttgccataaacttaatgcctgagcaatattggtttcaccatatatgacactatcctcttttcccggatattgaaataaaactgcaggcaccttcttgattccattttgccaaccacttataaggccctgataagaacgctttaattgctcttcagactgtttccattcagcagactgaaaaatctgagatgcttgctgagctgctacactaggattcgcactcaatcgctgactaatcaaattttcccattgctcaacttgatcaagtaaatacacctggcttgcaagctctgcgtgaagaattggataatcttgtgttgaataaacagtaattatgggattaggcccctgggcgaacactgatagtggtaacaaaccgaaaagaaacagtgatttttttatagacataaccatcccttacgatgaaattggatagttgaaacattaacgaaatgacaggggggaatatataaaaaattctttttgattttgagataaattctccatttccaaaaaacaatttttaatagagattcgacagccttattaagtatgattggacttgataagtcgctgtgcaaacagctcttataagttgcacgattcttgagaagcaacgccttgccttagtgcaagtagaatcatagccaaaatgttatccagcattctgaaaggatactctacgcaatcgtaggaatgccaccttaaagaccttccgagggaaaatgattcccttcgggcatgtcatttttccaaggaattttttatttcacattaggagaatgactatgtcctcatccactcaattggaacactatgatgttccatcaagtaaccctcttgaaactccaacattttcatttcgtgtgggaaaacacttgggccgttttttcgttgcagctaaaaacaaagcaaccgataaatacaaacaagtgacatctggtatcaatcaaagcattgaagacgaagaagctcgtcggctttgcgaattacaaatgatgctagatagccaagcggaagaatatgaggcaattattgatgatgtgcaaagaacgtggttaaaacgaacaacgttatttagcattttatttttgattgtcggtattgttggtacagtgggtactctttactaccttatgcattaacattgcataagctattcattttcaaccctaaggggaatttttacccttagaggtaaaggtttcccttgctgtaggagaaaacttatgaaagtgacattacataacagttgtttagcttatttagccaaacataatgactcagaatctctaatagaggaagttcgcactcaagcattaaatgcctgggaaaatcgaggaaaagatgtatcttctactcgtattatggtgaatatccctagtcaatacggacagaaatatcacttctttacagtttcgccatacgcaaaccgtaaagatttgttaagtgtaagggggtaaacatgattaagcgtttactcaagcttgttagttccaattgggacaaaaaaacaatgctgctggtttctgaagattttcgtaaaatcggcacttacatcttaggtattgcgtttgtcgcaatgtttgttcagaatgacaatattccgctacttcttgccattatcattatgatatttggcggaatagcttggttctgtggtgtgttgttagctaaatattgcaacaacttaatggagacagacggagcgtaacgtatgaatattacgttaaactggaatgggttcctctttgcaattgtctttgtactgttttttatgggaacagttgcttttattggtgtgcgatcattaaaacgtcaacaagagcaaaaagcacaaagcaaaaaaacacattccattggtgttaattcataactgaattaatacctgcaacctttacaacaaaccttgatcatgccattggcgtgttcaaggttttcttttacccgactgggagcaatttcccattcggggggttgttccctttttttattggagaacaaccatgaaaaaaagaactcaacctgccaaagatttataccaacaaattacagaccaaattctcgaagcattagaacaaggtgtgatgccatggcaaaaaccttgggatagtggatggccacaaatggctattccatgcaacggtgaaagtggtcgtcaatactccgggatcaacgtacttctgctttggatgagcgctattagaaaaaactttactcaacgcaagtgggtaacttttcaaggagcaaatcatctaggtggccaagtccgaacaggtgagaaaagtacagttattattttctataaacaaaatatgtttgaagaaaaagacgatagcggaaacattgtacttgatgaaaacggtgatccgaaaatgaagtcatctgtatttattcgtggtcatcacgtgtttaatattgaacagtgtgaaggcttagaaaaatactatgaagaatatcctgaaccagaaaaatcttctgaaatgcaagctcgtccggatttagatgtattacccaataaaatgggtatgcagctgtataacaaagcacagggtaccgagtccgatattcgtataccag

SEQ ID NO: 473 - DNA, 3862 bp, H. influenzae
  misc_feature (3814)..(3814): n is a, c, g, or t
  misc_feature (3827)..(3827): n is a, c, g, or t
  misc_feature (3834)..(3834): n is a, c, g, or t
  misc_feature (3856)..(3856): n is a, c, g, or t
acgatatcgactcggtaccccataaattattgagaatttcttgatttaagacattcaatctagccaaatccagctgattattcaataagtccacatcgggcattgttttattggcttttgcggaaagggttttaaatcgttctactttgccaactaaaccttgttggccaacaagtgcggtgacggtgctgttgtattggttgctgacagtggaaagcgtattgccgagtttacttaaacgttctgccaccaagcaaatttggttatagatttcgcccgctttttcagcaatttctttggcttcagcattaccacgttcgatacgccagaggtttgccacggtgcgtaaaatcggcattagcgtagtgtgagaaaccataattacattgcgttcataaccgtaattaaataaggcaggatcagcttttaaagcctcaatatacgcaggttccaccgcaataaacataagaacaaaattcggactacgcatgccaatcagattgctgtaatcttttttatgcagatcgttaatatgggtttttaatgcggaaatatgctctttgagtaaacgctctcgttcaaaatcatcctcagaattcaccgcactttcgtaagccacgagcgacattttgctgtcgataattaagtgtttttcatcaggtaaattcaacacaaaatcagggtaattacgcccgccttgttcatctttaaaatgagcttgagcacggtaatgtacattttcttcaagtcctgccagttgcaatgctcgttctaattgcacttcgccccagttgcctaacgttttcttttcgcctttcagcgcagaagttaaattactcgcctcttgcgacatattcagaccaatttccagcacttttttaatttccgcttccaatccagcattgcctttcacggattcggagtgaatttcattgacccgtttttggaaaccttcaatttgctcacggaaaggcttgagcaaggtttccaatgccgtttgatttgattgactaaatgatcgacttttttcatccaaaatacgatttgctaggttttgaaattccacactcaactgcagcttagattgttcaaagttctgttgttgtgcggaaaaatatttttctttctctgttaaggttgtttgtaaccccgttaattcttgagaaagtgcggtcaatttttcagtcaaattttgtcgttcttgtgtgagatgatgtatttgttcatcacgttcagttaaacgatattgcagtccttgattttcagtctgtactttaattgtttgttgttcaaactggtttttaatgctactcagttcatcaaatttactggcaagctgattataatcttgagtcgttttcgataattcttgatgaagatgtgtatatttttgctggcgtagaataagtaataaaatcaatataataacaacagctaacaagctgaaaagtaacaaattttctgacatatttctctcttaatggaaaacacaaattgtagcaaaaaatattattttaattctgctttaaagtgcggtaaattttttaactgatttagaatttatatccatacaaaatttaattattttagtcaattttgatggcaatgctttagaaaaacattggtgtattttaacggtatttatctaaaaacttgtaataccgcacaccaatctttgtcgcaagatctttgataattcgaccaccataaacagaagggactttcagtccttcaaaaatagataaacgttcatcgtcacccaaaatcgcctccgctacaattcgccccgcaagaccagtcaaagcaacaccgtgaccagaataaccatgagcaaaataaatatgcggagaaatacgaccaaaatgtggcgttgagtttaaggtcatatcaatcgggccagcccagccataatcgatttttacattttcaagttgcgggaatacacacaacatatttttccgcataatcgcgaccatatctttttctgagctagaatcactaccaaaaagcaagcgattgtcagcacttaaacgataatagtctaataataaattgttatcacacaccgacatgccattattaatgacagaatcagcaaccgcttggcttaacggctctgtggcgataataaaactttccacaggtaatattttacgattaatgccgtgatgaatagatttcgggagcgcatcaatataagcattggtggctaaaataacgtcttgagaaataaccgcacttttagctgttttaacctcaatgcaaccatttttctcaaccatatccacgacaggagattgttcaaaaatctgaacacccagatcgacacaagctttcgctaaacctaagcaataattaagtggatgcaaatgccctgaattactatcaaatagcccccccacataaatatcactgcctaagtgctgttttaatttagttttatcccaaagttgcatattctgatagccaaaatttttatgactttctttttccatttcaattaagtcatccattcggcgttcatttaatgctaatgtggcatagccttttttccagtcgcattgaatgctatatttttcaatacgttcatcaataatatcaatggtctctaatgacatattccaaagtttatgtgctttatcttcgccaacttgtttaacgtattcatcaatgccttcttcaaagccattaattgcctgcccaccactgcgaccagaagcaccaaagcctactcttgcaccctctaagacaatgactttttttcctttctccgccagttctaatgctgcagataaaccaaaaaatccagccccgatcacacatacatcagcatgttcaatttgagtgagcggcgggaattgaaaatcttggttacgagagtcgaaataataagagcgaacgtgttcttgataggcaaaattaagcataaaaaatcccttaggaaaaaactggcaaaatcttaccccgaaagggaaatatgtcaaaccttttagaaaaaatgctatactgcgcgcacgcaaaatttgcgtgttttatgatgaacgataaccctcggaggtcaataaattgaaaaaattctttgctcactcactcaaaaatcttttcctttccaccaccgcacttttgcggcttccgcttttgccaataacaaactttacgtctataactggacagactatgtgccttctgatttagtcgcacagttctctaaagaaactggcatcgaggtaatttattctacctttgaaagtaacgaagaaatgtatgcgaaacttaaacttactcagaatactggttctagctatgatttggtgtttccatcaagttactacataaataaaatgattaaggaaaagatgcttcaaccgattgatcaaagtaaattgaccaatattcatcaaatccctaaacatttattaaataaagaattcgacccagaaaataaatattcattaccttacgtttacggcttaactggtattgaagttaatgcggatgagattgatcctaaaaccatcactagctgggcggatttatggaaacctgaatttaaaggcaaagttctcatgaccagtgatgcgcgtgaagtgttccacgtagcattattactggatggtaaatcgccaaataccaccaatgaagaagacatcaaaacagcttatgagcgtttagaaaaactgttaccaaatgtagcgacttttaactctgattctcctgaagtcccttacgtacaaggcgaagttgcaattggtatgatttggaatggttcagcttattagcgcagaaagaaaatcaatctcttcaatttgtgtanccaaggggatctntagagtncaaaccgcgaggcatgcaacgncatggc

SEQ ID NO: 474 - DNA, 4625 bp, H. influenzae
  misc_feature (4434)..(4434): n is a, c, g, or t
gaacgcggacaaaaactctcattacacggctgggtatatgatgtaaatgatggatttttagtggatcaaggcgtaatggcaaccagcagagaaacccttgaaatttcttatcgaaacgctatcgctcgtttatcaatacttgatgaagaaaatattttgaaaaaagatcatcttgaaaatacataaaaaaacgcccttttgggcgttatttttttaagctttaccgtcagccaaatttttcttttcttctaattcttcccagcgtaaaaatgctgtttctaattcggcttcagtatccgccaatgcttttaatttagcgtcggtaatatcgtgagcctgttggaaaaatgctggatcggctatttcagcttgaagtacggtgattttagtttccaactcttccaatagttgtggcagctgttctaactcacgttgttctttataagaaagtttcacggatttcggcttagaagtgcggtcatttttcaccgcactttcttcttttagcggttcagttttcttcgctttagcctgctcttccactgctttacttgcccagaaattggcttgttgctgtttcgcatcaaagaatcctcccacatacttattcaaatgcccttcaccttcgaataaataacattctgtcgcagtattatcgataaattgacggtcatggctcacaattaacaatgtgccttgataatccgtcaaaatttcttctaaaagctccaatgtttctacatcaaggtcattggttggttcgtcaagaatcaataaattatttggttggagcaacaattttgcgagtaataaacgatttcgttctccccccgataaggctttaactggggtcattgctcgttttggtgggaacaagaactcttgcaaataccctagcacatggcgttttacaccattgacttcaatatcttgtttgccatccgccacattatccattacagttttttcaggatctaaatcagcacggtattggtcaaaataagcaatatctaatttagtaccacaacggattttgcctgatgttggctgaatttcacccagcaataatttaatgaacgtggttttcccacagccatttggcccaacaagcgcaattttgtctccacgtaaaatcgttgttgaaaaatcttttaacaaggtttttcctgcgatttcatagctcacatcttccatttcaaagacaattttgccagaacgacttgaggtatctaactgtaatttggctattcccattacatcacggcgttggcggcgttcctcacgcatcgcttttaatgcgcgcactcgcccttcatttcttgtacggcgagccttgataccttggcgaatccatacttcttcctgtgcaagtcgtttatcaaataattcattttgcaaggcttcaacgcgtagattttcttctttcgtggttaaatataaatcgtaattgcctagataagactgcaattgaccgcgatctaaatccacaatgcgtgttgccattttgcgaataaaagaacggtcatgggaaataaatacaaggctaccttggaaatccagtaagaaattttccagccattcaatagcttccacatctaagtggttggttggttcatcaagtaataacacatcaggatcgcataccaatgcgcgtgcgagagccgctttgcgtaaccaaccgcccgaaagtgcggataattttgtgtttggattcaaacctagttttaacaacacttcattgattttattttcaaatcgccagccatcagcgtgttctaatttatcctgaacttgctctaattgacttaaaatttgatcactgtaattttcttccaattgaacagaaatctgatgatattctttcaataaatccgttaaatgcccgacaccttccgcgacataatcaaaaatattgccttgcgcattacgcggtgggtcttgttctaaacgagaaaccacaagatctttttcgtattggattttgccatcatccataagcacatcgcctgcgatgattttcaataaagttgatttacctgcgccgttacgcccaactaaacaaacacgttcattcggttcaatatgtagttctgcgtgatccaacaaaggtgcatcactaaaggaaaggtatccattggttaaactaattaatgccacagctgccccataaaaattcagtgaaaattaaccgcactattctatacggtttgcataaaaaatcccatcaattcaatgggattctctcttaaatcaaagttgttgatatacccgcaatgcgtgtgcatctgacatgcctgcaatataatcgcaaataattcgcttcttcccttcttttggtgcattacgccaacgattttctgtatttcttggtaataaacgctccggatcagattcaaaaatctggaacatttctgttagcattctctgccctttatattcgattcgttgggtatccacattgcgaataacataatcccaaacgaattttttaaatacaccaagcgcagcaatcacttcaggtggcaactctgcgttataacgtaacaaaggttcatcaaaatttgccgttaatttccaccgcacattagtaataaaaaagttcaccaatgcaccaatcgcctgtttgcgctcaaaatgtttatccgagaaaagtcgttggctaattgaatcaatattttcatgtaaccaagctgacggaatttgtttcaatgcaacatgtgccgcttgccattgatgaggatttaccacgccagttacaatcgcatcttctaaatcatgtacgccataggcaatatcatccgccaattccataatgctgcaatccagtgatttaaaccgagtatgtaaagattcagctggattttcccgcacttttttaaattgacagaataaagtgcggtcattttcagaaagattttccagcaaccaattaaacatttttaaatcatcgcggaaaatgccttttcctggaatccaatcatgaatacgcacaaaacgaggatcaatgttgcgagaaaaattaagttctgcatattgaggcgaagccacacctaacaacgcgggatatttcactacacccaatagtgttcggcgcgttagattcatccctgcattttcagtgtaaggctcaagtttcgttaaaattctaaaggtttgtgcattgccttcaaaccctccctgctctgccatcatataatttaatgccgtttcgccaccatgcccaaaaggcggatgcccaatatcatgagcaaaacacaaactctcaataagatcgttactcggcaataaaggttttaattgtttttgcaactcgtttttatcaatatttaatgtttgcgaaaggctttcaaaggtttctaaaaatttaagctgtgcaacgaggctgctgccaatctgtgcaacttctaaagagtgagttaagcgagtacggtaaaaatcattttcgccaattgcgtgaatttgggttttcgcttgtaagcaacgaaaagcggcagaatgtaaaattcgcccacgatcccgacgaaatggtgggcgattatctttttcgcgtggaggatcaggaagaaaacgttctgtccaagaagaatcaatgataagtggtttcatatcgctttgttttatttcgtttttctgcattatctaatcatttagcgcaaaaaacaaccgcactttatctataacaaacaaaatctagaatgaataaagtgcggttgaatttttattgatatttaaacaaagaaataaatcagcttaaatacaaatggcgcgagaatagaactaataatcccacaaagcacaagagaaatagaactgtaacttcccgctgttggattcgtttccatacaacttactgtaccgagcgcgtgagaaaccgaaccaacagaaagcccaatagcttcttgatgtttaacacccaatttttttaatacaagataaccaaatatcgatccttgcaaacctgcaaccacaacaccaactgcagttacggcaggaatgccgcctaaatgacgggaaacttccatcgcaataggcattgtgatggatttaggtaaaaccgtagcgaccatttcgggcgttgcacctaaaagaaatgctaaaagcccgccacttaacatcgccaaaaaagaggctataaccaccgttgaaagaataattttccattgtctggcaatttggcgaagttgttcataaagaggcaatgcgagagcaacgatactcaagccaagtaaattattaataggcgcatttcctgccatataatcatcataaggaatctttcctatcactaaaatcgccgccaaaattaatactgttaaaacaaaagtattaaaaatcattgacttccaacgtttgctaatttgtagtgcgagccaaaacccgaaaattgttaaaaatgtataaagataaataatgtactgctgcatataaactttncttacatactaatttcgcttgttttacctgaatttctcttacgtttattacttttttgcgtttatgtgtaaaagaatgcatctgatacaaataatgacctaaaattctatacaagtaagtggcacaggtcttccaattttggaacagcaaaatttaatttgtttatcataaataggattattgaaattccc

SEQ ID NO: 475 - DNA, 4724 bp, H. influenzae
  misc_feature (2104)..(2104): n is a, c, g, or t
gccagcttgctgcctgcggtcgctctaggacccccaacgctttccgtgaagtatgttgttattgaataatatcttattaatgaccgcactttgcgttgtattcttaggaacgttgttaccactcgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatcagcgtatttgttatgctgattgcaggttttgcgttaccttatttcttgcaagataaaattaccgtgagttcagtgcttggttcaatgatgactgtgattattgtgttacttgtgctttatgaattgcaacaacgtgcgacgcatcgtgaatcattctttgttggcgtacgcaaactatctcgttctcattggggaatgatgttagctcacttaggcgtagctatgactgtttgggggatcgcatttagccaaaactttagcgtagaacgtgatgtgagaatgaaagttggcgagaacgcacaaattggtcgttacgattttaaattcgctggtgtgacggatgaaaatggtccaaactatattggtggaaaagctcaaattgatatttcgaaagatgggcaaccagagacaagtttattcgcagaaaaacgtttttacacagtaagtcggatgtctatgacagaagccgcaattgctggtggtttaactcgtgacctttatgtggcacttggcgaaaaacttgaggacaattcttgggcgttacgcttatattacaagccatttattcgctggatttggattggcggcttatttatggcgttaggtggattgttgtgcatgttcgatcgacgctatcggtttaatgtgttgttgaagaaatagtttatactgccatgggtaggtatacccatggctaattgaaatggttcccctttggggaatttcaactagcctcaaagaggctatacttttactagcctagggtatacttaccctaggcactaattttaaagtgcggtaaaaaatgaaaaaaaaattactcgttcctcttattctctttttatcgataacaattgcctttttagtgcaattaaaacgtaatgcacaaggcgaagatattaaagcattagagtcagctttggttggaaagcctgtgccagaaaaaaatttgacggagttgtttgaaaataaagcttacacgaacgaattgtttcaacaaggtaagccagttttgcttaacgtatgggcgacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggcgtgattcattatcgttatgctggagatgtaaacgaaaaagtttggactcagactttaaaaccaatttatgacaaactttcggagcaacaataatgaaaaaaacatggttatttttgaccgcatttttgtttagctcagtggcgttttcagctattgacgcattaaattttagttctccacagcaagagagtgattaccaccaattaacacaatctttgcgttgtcctcaatgtcaaaataacaatattgcggattccaatgcgactatcgctgtggatatgcgtggcaaagtatttgagcttttacaagaaggcaaatcgaaaaatgacgtagtggattatatggtggcacgttacggcaattttgtaacctatgatcctcctataacagcgagtacattagtgctatggattgcgccattattgcttgtgttgttaggcgtggtgtttttattaagacgccaacctaaaacccaaagtgcggtgaaatcccaagaggttttaacggatgaagataatgcgcgtttggcagaattattaaccagggataaatagatgaantttacattaatttttatcttaacccctttagttgtggcgttaattttggttttatcctttatttacgtcatttaaagcgaaacatgggcaaaaacgtgatgatttaaataaggcgttatatttctcacgcttggaagaaattgagcaagataattcccaaggtttagttgaaaatgttgagcaactcaaacaagaattacagaaacccttgcttgatgatgtaccgagcaaggttcaagagaatgtggattattctggcaaatcttatggaaaaatttggtttgtctctggtgtattagcgttaggaattatcgcaggttcttcttattttatggtgggatcttggcaagccgaatcaatgttagagcaaacttatgcgaaattgccctatttctttgaccgaatgaaagatgaagataaaaatccattttctgatgcagaaatgcagcaattttctaccgcacttcgaatcgatttgcaaaaaaatccaactgatgctaaaaaatggtggatgctcggtcaaattgggatgaatttaggtgatgcacgtttggcattcgatagctatcaaaaggctaataaacttgaaccagataatgtgcaatataaattaggctatgctcgtatattgatgttttctgaagatgcgactgataaacttaaaggtggcaatttattgcgtgaagtgattcgtcaagaacacactaacattgaagcattgagtttactcgcattccgttattttgaaacagaagattataaaatggcggcagtgacttgggcgatgatgctacgcttaatgccgaaagatgatgagcgagttccattaattgaaaaaagtattcgtaccgcgcgtgatgctttagaagcgcaaaatgaagaaaaatcaaaaagtatcactcccgaaaaataacctagtacgttataagactttttgatatagtgcgaaaaaattattcgtagtcgaacagattagcatttaataaagtactaaaggaacgagaaatgaataataaaaattgcacttttttctttgttctgcgtcattattggaagtttatttacttcacaattttcgattgcagaaaatgattctagtgcagttgattctgaagataaaaaagcatttaattccgatgtttcaaataatgatgctcaaaaactagctcaaagtattgaatttaaagtttataaaatagatgaaaccacttcatcagaaagtatttatgaatctccagctggaatttgtcagggatttaagattacaagaggtgtagattacacaaattcgacttaccattatctttatccagacaatagaggagaattctatggcagtgtggttggtgcaaccatttataaccaaaaagatcctcaaaatttaagttatgtgcctgtttattcaattacagacaaagatttgtctaagtgtattcaggcacaagaaaataaaaaattaaaggaaaaagcagcgaattatgtatcagaaggtagggctgtattaactgacgtaatttgtaaataggatgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgttcttccagttacaccaagcgtcgggtatcattataattatcactattttagataaaaaattatcttgttatctgtgctaaaaattcttcttctgttaatactgtaatatttagttcttgagcttttgcaagtttagagcctgccccatcacctgcgataacgaaatctgttttactggataccgaaccacttacttttgcaccaagctgttgtaataaggcttttgcttcattacgccccatttgtgtaagagtgcctgtcagtactacagttttatctttgaacaagttttcactcgcttctttcacttctacagtttcccaatgcacaccttgtgcgattaaatcctccacgactgcaacattatgcgcttcacgccaaaatataaaaattcggttcgctacaacttcccctacatcaggcacttgttgaagttcttcaagatttgcgtctttaagcgcatctaaagttttgaaatgattagcaagatttaatgcagtgggcttcgcccacttcacgaatgcctaaagcaaaaataaagcgatcaagcgtcgtgctttttgcattttcagactattgagtgcgttttctgcagattttgcacccattctttctaagcgtgggagcgggggtaaatcaagtttaaataaggccgcaggtgtatgaattagctctcgatcgactaaatgctctattaatttttccgcctacccatcaatatccattgctttacaaaagacgaatgtgttaacgcctctttaccctgggccgacagaataatcctccgggcaagggctactggtcggctttatacaataatttgagatcgcccagggcaat

SEQ ID NO: 476 - DNA, 4925 bp, H. influenzae
  misc_feature (4382)..(4382): n is a, c, g, or t
  misc_feature (4893)..(4893): n is a, c, g, or t
  misc_feature (4899)..(4899): n is a, c, g, or t
tagtgattaaagatatatttatgatggcaggtggcttaacagctgcagcagagtgtgcaaatcgaattttagcacgtaaaaaataagtttatcgatataaaaacagctccaagtataaattggagctgtttttattatcacgactagttaaatattgatcattacgttttgtattattaattcataatgcctttatgtcttaataagatgtctaattgttgatatattaaatttaaatctttccaccaacccctttaaatttctctacaaatgcagcaattttttggaaaattgtctgctttttagtgagatattgtggagtaagtggactcatttttggcaatacttcatttaacgctgtgccgttttcactggcatattcgcgttttaatgaagtgctgatatagcgttttgctgcatcgacattcaaattttcttcttgaattaaggattctgcttcttttcgctgttctgcttgagcaaataggaagaatgagtcaattaaagtcgctttatcgggaatatcatctaaatttgtttggttgataaaatcgacaatcaagctctctttagcacggttacctaaacttgaacgaactgtgcggcggatttcatcaattaacacctctttgtcttggtttttcttatgatgctcgaaaattaacgcaagaatataatccaaattgatttcttgagattttaataaatccacttcaaatacgacatcgtcccaatttatcggcgaattatctttatcattcccttcttttctttggcgtagccaatcgcgaatatcattataagttgaacgataatcttgctccgctcttactggtaaagtgggtactttcagcatttctgcaatttgttcatcattcacataatgtacttgcttgaatttctccattgcaatcggatcatttaaatcgaccgcttgtaaggcttgcaatgctgcaaactcatcgtaattctgcaaaatattttcgacacgtagatattcgccaaataattttacaaactcttttttatcttgctctgtttcgatttctgttggattaggaaagcgattttgtagctcttgaacaacctctaaataaccacgttgattttcatcaccattaaaataggtttcgtagcttttctctaaaaccatatttttggtattgtcatcgccaaatagcgtgattgcatcaatggtattttgttccaaatcgcggaaagtgacgatattcccaaaggttttagttgtgtcataaatgcggttggtgcgagaaaaagcctgcattaatccgtgataacgcaagtttttgtccacgaaaagagtattcaacgtaggggcatcaaagcctgttaagaacattccgactacaatcagtaaatccacttcctgatttttcacacgtttggcaagatcgcgatagtaattttggaatgattgactatctacgccataattcgtgccaaagtagtgattgtaatcatcaatggcttttgttaaaaattcttttgccgtactgtttagagcagtgggttcaaaggtctcatctggaatatcgccaattgcatcttgttcttcattggcggcaaacgaaaagattgttgcaatttttaacggatgctcctgctctgcctgtaaattttgtaaggtttcgtaataacgttttgctgcttccacactgcttaccgcaaacattgcattaaagcctttacctgtggcattcaagcggtgggttttttgtttaaaattgttaagcaaatattgcgagatttctttaatacgctcagggtgtaaaaaggcttgtttctgctcaagtgcggttaatttttcaggatctttttctgtttctaaggctttaaattgtgggcggacatcgttgtaatcgaccttgaatttcagtactttgtcatcacgaatagcatcggtaatcacataagaatgcaattccgtaccgaacacacttgttgtcgtttccgcacctaatgcgttttcagggaaaataggtgtgccagtaaaaccaaattgatagaattttttgaatttacgttttagatttttttgtgcttcgccaaattgggagcgatgtgcttcatcgaaaataaagaccacctgtttttgataaatagacaggttttcttcacttttcattaaattattcaatttttgaatggtggttacgataattttgttatcatctttttcaatattgcgtttaagcccagcggtactttccgacccattcacgctatcaggcgaaaaacgctgatattctttcatcgtttggtagtctaagtctttacgatcgaccacaaaaaagactttatcaataaaatcaagttcagtcgcaagacgagatgctttaaaactggtgagggttttgcctgagcctgtggtatgccaaatatagccaccactttctttgttgctccaatttttggcgtgatatgaacttttgattttccataaaatacgctcagtggcggcaatttgatacggacgcataatcaatagagtgtcggaaacatcaaacacgcagtaatttaccaacacattgagcaaagtattcttttgcaagaaagttgcggtaaaatcctttaaatctttaatcagagtattttttgccgttgcccaattcattgtgaagtcgtagctattcttattgcgtttagtcgtattagcaaaatagcgagtatccgtgccattagaaatgacaaaaatctgaatatatttaaagagagaattttctttattgaaactttctttgctgtaacggtgaatttggttaaaggcttcacgaatcgccacgccacgttttttcagttcaatatgcacaaggggtaaaccattcaccaaaattgtcacatcataacgattatcatagctgcctgtttgctcaaattgattgatgacttgcagagaattattggcaagatttttcttatctagcaaatagatattctgaatgcgtccgttatcgaacacaaaatcataaatataatcatcgtgaattttgcgggttttctcaatcagattatcgctcggtttatccaaatattcctctaaaaaacgttgccattctgcatcggagaaaataacattattcaaccgttgtaattgaacacgtaagtttttaatcagttcatcgtgattattaagcccttgtaaatactcatagccttgagcctgtaaatcacgaataaactcacgctcaaggctcccttccgtttggtaaccagcattaggttcttccacaaatttattatattgatctaaaacgataaaattattggattcagcgatagttttgtattgggtcataagtagttccttaatgcttttgctttttcagatctttctgccagttttctaaaatttctaaatcttcattatcagcttgtatgcgtttttgttgttttctgacctgatcaaataaggcatattgttctttggtaaaggtttccatttgttttacggttcgggttccattaccgataagcaacggaaaaccgttaaattcaattaaattatcgacattattacgccagaaatttaatgtgagatcttgacgatttttaacgcgtaattcagcactttctaaaaagatcatcactaaacgattcaaagaatctaattcatcatgagttaaatagtttttagcggtaataatatcgcctttacgtacaacagcacctttccaagaggtaagacccatattaggcaatttggcatttgcacgcgtacaaataagctctgcggcggtttgttgtgtaatggcataaatcaacttattttgtgtttctgcaaaaaacatttgagtgactttatctgttttatcgtagtcactggataatttaaataactctcgtactttttgataaaaccgcaattcactggctcgaatttcgcgaatttgttccagtaattcatcaaaatgatcaaatcgaccttgaggatttttcaaccgctctttatctaatagaaaacctttatctaaataagtacgtaattgcgtattcgcccaacgacgaaactgtacaccacgagggctgcgcacacgaaagccgatggcgagaatcatatcaagggaataatgttttacttgatattgtttgctatcttgggcagttattaagtaatccttaataactgaaaactcatctaactctttgtcttgtaatatgttttttatatgagtggttatatttggtacagaggtgtcaaaaagttccgcaagctgattttgagtcagccaagcatcattttcgacaaccaataaagcaacgtgagatttgccgtcatcggtgttgtagatgattaagtcgttcatatttactctgttatattatcagtttgtggctctttaatattataatatatatagaanccataattattaattagatgttcaagtaaatatttaacaatcttcttttcggcatctgttggttcagcgattatctcatttgataacgtagagtgactagtaaaattgattatacgagtgtaatagctttgtcttgcatcatcattgggtaatagatttgaccatcctgaataaccaagaaagttagcagttttttcatataaatttctcagtaacatgaaatgatatttttgaatatctttagatttaacttcttcaagtagattttttagaaaaagatgataggagaaactcttgtttgaaccaccttgtttcacctcaagatcaaatctttcgttttcattcttattttcatcttttcttagaatataaccattttttgctccaagttcattgtataaaacgttataaaataaaggattgtgtgtggtgataataaattttatagtatcgggactatctttgactaattctgctaaatcaacagctaattgaataagatgttttcatnccaatnaagggtaccgagccgatatcgtatac

SEQ ID NO: 477 - DNA, 3679 bp, H. influenzae
  misc_feature (1914)..(1914): n is a, c, g, or t
  misc_feature (1959)..(1959): n is a, c, g, or t
  misc_feature (2131)..(2131): n is a, c, g, or t
  misc_feature (2134)..(2134): n is a, c, g, or t
  misc_feature (3584)..(3584): n is a, c, g, or t
caaaagatgtgggtaagagaggagaaatggagaaagagtgaagggggaagtatggtgaatgaaagaaaggacgatatagaggagagataatggaagggaagggggaggacggagtaagaagaagatgggggaagagagggtgagaaggaagaagataaggaaattagaggaatgaaagaattagaagtgaaatagtgaaagataggaataaagggggagggtggataggagtgaagcgaaagaaggggagagcaaagaataacgcggagagataagaagaactgaggtaaagtcgaagccaaaaaaggcgtgaaaaacaagtaaagaacaaagcttcgcgtggaagcagaagacagctgggcatgtaggggaaagtggatcaggaaattccaaacagcttggctttaatggattattgccagccaacggttaagtgaaggctctgccattttaaagggaaaaaattagttaatttaccgaatgctgaattgaataaaatccgcgccgagcaaatttccatgatttcaaagatccaatgacgtcactcaacccatacatgaaaatcggtgaacaactcatggaagtgctgcaattgcacaagggctatgataaacaaactgccttgccgaatccgtgaaaatgttagacgcagttaaaatgccagaagctaaaaacgcatgggcatgtatccgcacgagttttctggcggtatgcgtcaacgggtgatgattgcgatggccctattatgccgtcccaaactactcattgcagatgaaccaacaaccgctttggatgtgaccgttcaagcacaaatcatgaccttgttaaatgagttaaaacacgaatttaatactgcgattattatgattacccatgatcttggggtagtggctggtatctgcgatcaagtcatggtgatgtatgctggacgaaccatggaatacggcacagcggaacaaattttctatcatccaacccatccctattccataggcttaatggatgcgattcctcgcttagacggcaatgaagaacacttggtcaccattcctggcaatccaccgaatttattgcatttgccaaaaggttgtccattctcacctcgttgccaatttgctaccgaacaatgccaaattgcgccaaaactgactacatttaatcacggtcaattacgtaattgttggttatcagcggagaaatttaacctatgacagtctcaaacaacaaagaattactccttgaagtcaatcacttaggcgtcagttttaaaattaaaaatgataaatcccttttcttcgccaaaccgcaaaccttaaaagcggtgaaggatgtgtcttttaaactttacgcaggtgaaactctcggcgtagtaggtgaatctggttgtggtaaatccacacttgcacgcgctattatcggtttagtcgaagcgagtgaaggggaaatcttgtggcttggtaaacatttacgaaaacaatcagcgaaacaatggaaagaaacgcgtaaagatattcaaatgattttccaagatccgctcgcctctctcaatccgcgaatgaatattggcgaaatcattgctgagccattaaagatctaccaaccgcacttaagtgccgccgaagtgaaagaaaaagtgcaagctatgatgttgaaagttgggcttttaccgaacttgattaaccgctacccacatgaattttctggtggtcaatgtcagcgtatcggtattgctcgtgcgttaatcattgagcccaaaatgatcatttgtgatgagcccgtttcagcgttagatgtgtcgattcaggctcaagtggtgaatttattgaaatccctgcaaaaagaaatggggctttccttaatttttatcgcccatgatttagcggtggtaaaacatatttctgaccgtttattagngatgtatttattctatgcaatggaattatgcatcgatgtggaagnatataacgataccaaacatccttataccacagccttaatgtctgctgttccgatccccgatccaaaattggaacgcaataaatccatcgaattacttgaaggtgatttgccttcgccaattaatccaccgtctggttgcgtatttcgtactcgctgtctaaaggctaataanaantgtgcgaaccaaaaacccccccttcaccagccaaacaaccaagccatttgtggcttgcttgaaagtcttataaaacaaaaagtgcggttaaaattcaccgcactttttacttttacaatcctaacttttcttcaattaccttagccaaatcatctagcatcgcataacgtttacgatacatggaacgttttttacttggaatatcatccagatttctatccatttctaaaggcaattcccagtaatcttttaattctccgcctgattcgccaaaaattgcatcataatccacagtatattgtttactttgaatgaagcgagatttattttggtatttttgcggaatgccaagcaatttatcgtagcctagtatttttgtgagtgatttcatggtttcaaccattaaataggcagggcgtaaaccgtggcataatttggttagttgtttcaccatttcctttgagccttcaaaatttggcccttgtacaacagcaataagcaacgcatcgcctaatttggcaaaggtaagcaaatagactaattcgtttcttggtttatgccatagctccaatacccaatatccttccatcggttgatgggttgtcatgcttaatgtcatttcaaaatcaggaatgacttcgccaaaacttagaggtttttcccataacggcgtagaaagtgcggtaagtttttcgggtaaaaataaaagattctcacaaacggcatgaaaacgttgtgatgcgttaaaacgcttatctaaaaaacgacaagcaacaggataactataatccaagtgcgtattaaaaatatcgacgagaaaaggatattgattgataaattgttcaaagcgacgaattgaaccacgatttaaaaagctacgtaagttataacgccaatgttttggtgcatcaaaacgccctggtcgatatggataaatatccttagattgaggccattggtaagttgtttttgttgtcatctggattgccattaattgattataatttcagagagaattttgacataatttcaggaaattttccatttatgctattctaaacacaatttttaaaaggaatacttatgtctgaaattaaacttaattaccacaaaacccactttttaacgagcgcgccgaatattcgttccattcctgaagatacgggcattgaaattgcgtttgcgggtcgttcaaatgcgggaaaatcgaccgcacttaatgcactaaccaatcaaaaaaatttagcgcgcacctcaaaaacaccggggcgcacgcaattgattaacttatttgaagtggaaccaaattgtaaattggtagatttaccgggctatggctatgccgccgtgccagagcaaatgaaaatccaatggcacaaatcccttgggcgaatatttgcaaaaacgcgaatgtttgcaagaattggtttgggttgatgggatattcgtncaccctcttaaagatcttgaccaacaaatgattgaatggggcgggttcagcaaatttaccgggaccttttattggttactaaagccgataaataa

SEQ ID NO: 478 - DNA, 5466 bp, H. influenzae
taagagaggggaaaataatttccggtgacaatcccccaccccctaaaaaaaacgccgaatatcgggaataagcaaagcgggttccccccttaatttatgaccgttttccgtaaaataaaaataaccggaaaatgcgccttctgagttaaaagaacccccattaaaaataacttaaaaaagtttgataataagaaagtgaaccatacccttctacgcccaattaccgggataaattagggcaaaagtaaaaaaaggaactaacttggccgataattccccaacaaggtaattagcactatctttaaaaactttcataaatatcaccgcacttttgatgaattcgagcgttcgtttatcaaaaaataagggggcttattttaacaaaatcaacatagacaagctatgactaatcattataatgaaactgctctacatcaaggatcttatctatgttagaactcggaaaacttcttaccacacttatcgcaccacctcttaatacctttgtattactgattattgcagcgattatttattgtgttcatttcaaaaaattagccaaatttcttgcgattataagtttcacttggctttatatcatgagtgtgccttttactggtttattgctaacaaataatgatgattctccagcccttacgctagatgagtataaacaagctcaagccatcgtcatattaggcggtggatcttaccaaaccaaagagctgtatgcagaaacggcttctggtgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttagtgaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcgttaaatagcaatatggttttattaaaagagtggattggttattggaaagcccattatgtagaataatttgcttataaaactcgatgacttgttgtttgaaaagaaaattatatttgctcataaaaaaatctgcaccttagttagttgtttagtccaacttttggggtgcagatcaattcaaggcttttttattatatttcaacattttatctataagaaaaaccgaatcccatagagattcggctttaattatgttgtgtttgaaaattattctttatgtattatgacttacgctaattccgcacgtaattttttggttacatccaccatcacttttaattggtcgatggtttctgtccagccacgcgtttttaaaccgcagtctgggtttacccataagcgttcttttggaattacatttaatgctttacgtaataaatgttccacttccgccgccgttggtacacgagggctgtgaatatcgtaaacacctgggccaatatcatttggatatttgaaatctgcaaatgccgttaataattccatatctgaacgtgaagtttcgatggtaatcacgtctgcatctaatgccgcaatggcaggtaagatgtcgttaaactcggaataacacatgtgagtgtgaatttgcgtatcatcttgcacgcccattgagcttaaacggaatgcttcgcctgcccattgtaagtatgcgtcccaatctgcacgtttaagcggtaaaccttcacgaatggctggttcgtcaatttgaatgactttaatgcctgctgcttctaaatctaacacttcatcagataatgctacgccgatttgtttacatacggttgaacgtggaatatcgttacgcacgaatgaccattgtaaaatagtcacagggcctgtgagcattcctttcattacacggtttgtgaggctttgtgcatattgagaccagcgtactgtcattggctctgggcgagttacatcaccgtaaatcactggtggttttacacaacgtgaaccatagctttgtacccaaccaaatttagtgaatgcgaaaccatctaataattccccaaagtattccaccatgtcgttacgttctgcttcaccgtgaactaacacatctaaatctaattcttcttggcgacgtactacatattcgatctcttttttcattgccgcttcgtaatctgcaagagataactcgccttttttgaaacttgcacgtgcgtgacgaatttcagtagtttgtgggaatgaaccaatgtttgtagttggcagaagcggtaaatttaaccacgcattttgcttaacgatacgttctgcaaatggcgatttacgttgatccgcaccttttggcaagtttgctaaacgttctgccacttcagggcgatgaatttcttttgaggttgcacgtgcatctgctgccgcttggcttgcatctaatgctgcttgtacagacgctctgccattatttaacgcttgttttaatacgtttaattcttctactttttgtagcgtgaaagataaccagctgtaaagtgcggtatttttttcttttaattgtacttccacttctaaatcaaatggggtatgcaataatgaacagcttggtgcaatccataaacgctcacctaattttgcttttaatggctctaatacatctaacactttgtttaagtttgcacgccagatattacgaccttcaatcacaccagctgataacactttgctgtaatcttcaaatgccgcaagttgttctggtgcacgaactaaatctaaatgcaagcctgcaacaggtaaggcttttaataattcagcgtgttctgcaactgaaccaaaataagtggctaataataattttgcgttcactttgcttaattcagcgtaaacagatttataggcttcaacccattctgctggtaaatctaatgctaatgcaggttcatcaatttgaatccattctgccccttcagccactaatgcatttaaaatttcaacataaacaggcactaattgatttaataaatcgaaacggttaaatgcttcgcctttttctttacctaaccataagaatgttaatgggccaacaatcacaggtttgaagtttaagcctaaggcttttgcttcacggatttggtttacataatgtgctggattagctttgaaagcggtcgatttttggaactcaggcacaagatagtgatagttcgtatcaaaccatttggtcatttcaattgcgaattgatctttgttaccacgtgcaagttggaaatattgatcaagggttaaattttggctatcaaaaccaaaacgagcaggaattgcccctgttgccacttgtaaatctaaaatatgatcgtagaacgtgaaatcgcccactgcaacgaaatccgcattggcagccgcttgatgtttccagttttttcacgcaatgctttcgctaaatctaataaatcttgctctgctaattctttacgccaataacgttcttgtgcaaattttaattcacgttttgcccctacacgaggaaagcctaaaatatgtgatgttgtcataataactcccaatttaaagtaatttttttaatcatttagacggctaaacttctataccaatatagaatgcttgatcttcatttattatgcaaacttattattttcaggatttacattaaataaattcataatcaagcattcttttatctatcaaataacgatgaatcaattcagctaacttatttccttaaaattaatctcgcttacgacttaataaccaccaaatcattacaatgaaaagcaagctcgggatcaatgcaccaaaaatagcaggaataccgtaaactacactcgtttgtcctaaaatttcattaacaacataaaataagaatcctacacaaatcccagtaactatccttgcacctgcagtcacactgcgtagcgagccaaaaataaaagataaggctaataacatcattacgccaacggatacaggctggaaaattttacgccaaaacgtgagttcaaaacgactcacatcttgccctgtttcacgcagaaatgaaatgtaatgatataaacctgagatagataatgatgtcggacgcaaagaaaccgcacctaatttatctggcgtcaaactagtttcccaagtttctgataaatgattcgttgtgatgatttcatctttcataatcgttgaatgattaacttgacgcaatgtccatttagcttcatcttcagaataactcgcctggtttgcatgttttaattttattaaattatgctgttgatcaaaggtataaatataaatatcgtctaattttgtatcatccgtcacacgcctaacaaatacaaaatgatgaccatctttcgcccacacaccatttttaattgaaagtattgaaccaccagaaagagccttagcgcgcatatctcgtgcaaattgttctgtttgtggaattccccactccccaataatcattgtaaatactactaatggtaatgcagttttcattaccgctatacctattttaaagcgagaaaatccagctgattgcataataacaagttcgcttctgctagcaagattacctagtgcaattaatgccccaagcaatgctgccataggaaagaaagtttcaatatctttcggtatagttaaaccagtaaaaattaccgcttgccaaatatcataagtgcctttacctacactacgaaattgttcgacaaatttaataatcgccgacaatcccactaaagtcattaaagtagcaaaaatcgtgccaagaatactttttccaatataacgatcaagggtatttatcattttgccgatcctttcttactgaataaatagcgaaatttatacattatttcactgtcccagctattcaacaccacagcaagtaagaaaaatccgatattaacaagcggcattaaaagttcagcctctaattttcccgctgaacctgcagatttaaaagagctttgtaacaagaaataaattaaatagagtaaaagtgcgggtaaaattttggcaaatctaccttgtcgaggatttacgcgacttaatggtacagcaatcaatgccattaatggcactgccaaaattaaggtaatacgccaatgcaattcagctttcgcagaagaagaatctaaatcgataagttgagacaatgttaattctgctacttcatcattggtattttctgcggattgataacctaaataggcgtgatattcatcaaaatgcgtaatgcgaaaatctggcaaagcggaggttccttcaacccgtttgtattggggtctcccagagtcgaccgcaggcagcaagctgc

SEQ ID NO: 479 - DNA, 4008 bp, H. influenzae
  misc_feature (3841)..(3841): n is a, c, g, or t
  misc_feature (3895)..(3895): n is a, c, g, or t
aaaccgcactttgttctatgagtcaaaagtgcggtaattttttgtgtgtttttatacgttgaatcggaaatgcattacatcgccatcttgcacgatgtaatctttgccttctaaacgccatttacctgcttcttttgcaccgttttcaccgttgaattggataaagtcttcataagcgataacttctgctcggataaagcctttttcaaagtcagtgtggattacagctgctgcttttggtgcggttgcaccgactgaaactgtccaagctcgtacttcttttacgccagcagtgaaataagtttgaagatttaaaagtgcataaccagcacgaattactcggttcaatcctggttcttcaatgcctaaatcttgtaaaaactcgactttttcttcatcgtcaagttctgcaatttcagattcaatcgcagcacatactggaacgaccactgccccttctttttcagcaatttcacgaacgcaatctaagtatggattattttcaaaaccatcttcatttacgtttgcgatatacattgttggttttaacgttaagaagttgtaactcttgattgcttgcaattcttctttatctaacccaacagaacgaatcattccagcattttcaagcacaggaaggattttttccataacggaaagttcaaatttagcttctttatcgccaccttttgcacgtttttgtaaacgttggattgctcgttcacagctgtctaagtctgctaaagctaattcagtgttgatagtttcaatatcatcaagcggatcaattttccctgcaacgtgtacaatgtcatcgttttcaaaacaacgcactacgtgacctatcgcatcggtttcacgaatattagcgaggaatttattacccaagccctcgcctttacttgctcccgcaactaagcctgcgatgtccacgaattccatcgtagtaggtaatatgcgttcaggcttaacgatttctgccaatgcgtctaaacgtggatctggcattggcacgacacccgtatttggttcgatagtacagaatggatagtttgcggcttcaatgccagctttagtgagtgcgttaaaaagagtagatttgcccacatttggcaatcccacaataccacatttgaatcccataatttttccttattttgagtaaaacggttgtaaaactaaccgcacttttaaattttaaaactgtttaaacgattggtcgctttgatcattccatctttgaaaattatttctacacaatcagttgcctcatctaacactttttcaagtgcatcgcgatctgctggagatggtttatttaaaacataacctgccactaaatcacgatgaccaggatgcccaatgccaatacgtaaacggtagaaattattgttattgcctaattgagccacaatatcttttaagccgttatgcccaccatgtccaccgccttgtttgagtttcgctgtgccagcaggcaaatctagttcatcgtgaataaccaaaatttcttcaggtttaatacggtaaaaacttgccaacgcgccaactgctttaccgcttaaattcataaaagttgttggcactaaaaggcgtacttcttttccattcactaaagtgcgggcagtttttccgaagaatttactttctggatttagtgaaacgttaaaacgacgagccaagcgttcaataagccattcgcctgcattatggcgtgtatcggcatatttttcgccaggattgcctaaaccaacaatgagttttatttctgacatttttatttgatgatgtaaaaatttgatgatgtaaaaaatagtggcgtattgtagcgaaaaagccttaaattctcaatctataaggcggaaacaaagaggtaatttattgctcgtgatttatcattaaaagtcaccgcacttttccgttataatggctaaaattttttaacaaagaagtaaaaatgaatcagattaacattgaaatcgcttatgcttttcccgaacgttattatttgaaatcttttcaagttgatgaaggaatcaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgctgatccgaaagaaattcgccgtaaacgtgcagcagagcaagctgcagccaaagacaaagaaaaaggagcttaaaaatgaccgcactttcatccgttgatttttgtttacctgaacatatcacgccagaaatttttctacgtgattattggcagaaaaagccacttgtgattcgtaacggtttgcctgaaattgttgggcagtttgagccacaagatattattgaacttgcacaaaatgaagatgtcaccgctcgtttagtgaagacattttctgatgatgattggaaagttttttttagccctttgagcgaaaaggatttccaaaaattgccagaaaaatggtcggtgttggttcaaaacttggagcaatggtcgcctgaattaggacaactttggaacaaatttggctttattcctcaatggcaacgtgatgatattatggtgtcttacgcaccgaaaggtgggctctgtcggcaagcattatgatgagtatgatgtatttttagtgcaaggctatggccatcgtcgttggcaagtgggtaaatggtgtgatgcaagcactgaatttaaacccaatcaatcgatccgaatttttgatgatatgggcgaattagtcattgatgaagtaatgaatccaggggatattctctatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttgtttaagcaagccgtagcaagtgcggtaagttctcgtcgttatgagttattagtctctgatgaaatgtgtgatcctgatgaagtgcggtcaattttagaagaagatggcgcattcctttctcaagacaacaattgtaaattgctttacaccgaaaatccgttgcgaatttatgcgaacggcgaatggttagatgaacttaatataattgagagcgaagtattaaaacgcttgtctgacggcgaaagtttagattgggcgtttttatctgatttagccaataaaacagaagatcccgaaacctcaatggatttgctgttagattcaatttgtaactgggttgatgatggttgggcgttaattgaataatatgtcagacaatatttattccgtctctcaactaaattctgccgcacgtcagatgttggagggtaatttttcccaaatttggctaacgggggaaatttccaattttacccaacctgtgtctgggcattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcaacttattattgattctatgcacccagcaggcgagggattattgcaacagcaatttgaagcgttaaaaatgaagttggctgncgaaggattgttgctcaaaactttaagaaactctaccgcactttataaagcagnggggataataacttcttctacggtgcggcattgcaagatattttgctattctggcccgcccggatccagttaaaagtccgtttttttccactgcggttcaaggaagaggcact

SEQ ID NO: 480 - DNA, 4079 bp, H. influenzae
cttgggttaaccaggatttaagtcccttccccataaaggcggccattcatttccccccaaagactcagtagaaaactaatcggtcttccagtaaaggttaagccctccccttccaaaaatttaggtctcccccggtaatcacaacatataaatctccagctggtgcgccattatcgcctgctgcacctttaccagattagcgaagttggttgcccgtatctacgcctgcaggaatttttaatgaaagattatctttcttatgaactcgtccttctccatgacaactgcgacaaggtttttcaattttcttaccgctaccgtgacaagttggacaaatactttcagatacgaagaaaccttgctgacgacgaattcgaccagaaccgtggcaatgcggacaagtttccactttagaacctttttcagccccagagccaccacagctatcacaatgtgcaagagtattgatttgaatatctttggttgtaccttttacggcttcttctaggctaatttctaagtcataacgtaagtcttcgccacgaacaacgcgctgacgaccacgtccaccaccgaaaatatcgccaaaaatatcaccgaacatatcaccaaaatcagcaccgccaaagccgccaccgaagccaccagtgccaccaccttgttcaaaggctgcgtggccatattgatcgtaggctgcgcgtttttgatcgtcgcctaatacttcataagcttcattaatttctttgaatttttcttctgcttctttactgccttggtttttatcgggatgatgtttagacgctaaacgtttatacgcacgtttgatgtcgtcctcactcgcccctttttgtaggccaaggacttcgtagtaatctttttttgccatagtaattttgtaatttgttgctgaaaataaatacaccaaaagggcgtgtttccacgccctttgtttatgctaagaagagcggtgaattatttattatctttcacttcttcaaattcagcatctaccacgccatcatcttttgctgatgattgttgtggttgctcgccaccagcttgttgagcttttgcttgcactgcttgcattaatggttcagaggctttaattaccgcttcaatttttgcttcaatttctgctttatcttcgccttttgctgctgtttcaagctcagcgactgcagcttcaattttctctttgtctgcgacactcaatgcatcgccagcttctgcaatttgtttacgtgttgcgtgagcaataccatctgcttggttacgagcttgaacaacttcttcaaatttacggtctgcatcagcatttgcttctgcatcacgcaccatttgttgaatttcttcatcagataaaccagatgatgcttgaatacgaatttgttgctctttacccgtatttttatcttttgctgatacgttgattacgccgtttgcatcgatatcaaatgttacttcaatttgtggcataccacgcggtgcaggattaataccttctagattgaattgacctaaagatttattgtctgccgcacgtttacgttcaccttgaagaacgtgaatagttaccgcactttggttatcttctgctgttgagaatacttgcgattttttagttggaatagtggtatttttctcaattaaagtggtcatcacaccgcccatggtttcgatacctaaagataatggagttacgtctaataaaagaacatctttcacatcaccttttaatacaccaccttgaactgccgcaccgattgccaccgcttcatcagggtttacatctttacgcgcttctttaccaaagaactcagcaactttttgttgtacaagtggcatacgagtttggccacccacatgaataatatcgtggatttcgcttacacctttatctgcatcttttaataccgctttcactagactcaattgagcttgccactaaatcttctactaatgcttctaattttgcacgagtgatatttaatgctaagtgtttaggacctgtcgcatctgcagtgatgtacggaaggttcacttcagtagattgagctgatgaaagttcaatttttgctttctctgcagcttctttcacacgttgtaatgccattgcatcattacgtaaatcgatattttgttcttttttgaactcatcaataatgtaatcaattacacggttatcaaagtcttcaccacctaagtgagtgttaccaccggttgccaatacttcgaaagtttgttcgccatcaaagttatcaatttcgatgattgaaatatcaaatgtaccaccacctaagtcataaacagcgatcacttggttctctttgcttgaacctaaaccaaacgctaacgcagccgctgttggttcattaatgatacgtttaacatctaaacctgcgattttacctgcatcaatcgttgcttgacgttgtgcgtcgttgaagtatgcaggcacagtaattactgcttcagttacagattcacccaagaaatcttctgcagtttttttcatttttttcaacacttctgctgaaatttgcggtggggctaatttatcacctttcacgtttacccaagcatcgccattgtcggcacgagtaatttcgaaaggcataattttaatatcgcgttgaacttcttcactttcaaaacgacgaccaattaaacgtttaatcgcaaacaatgtattttttgggttagtgattgcttgacgttttgctggctgaccaactaaggtttcattatctgtatatgcaatgattgacggagtagtacgtgccccttctgcattttcaattacgcgcgctttatcgccgtccattacagctacacaagagtttgttgtacctaagtcaataccaataatttttcccattttgtactcctagtaaaaattttaaaattcggggtagggcttttagacctatttattacgaattgtaagatgtggatattctttcgcatttcaagagaaaattttaaaaattttttatttcttaaagtgcggtaatttccgttcttgtttttcaaaataagtctcaaatgatgaagttcaaagggaaaacaaaaattttcaggcaagaaaaagggatttgtgataaatttggcgaaaatttttactttaaaataggaaagaaataaatgaaaaaatcaaaaattgctgcaggcgtagtcatttctcttgctgccgtttggtgtgcaggtgcatggtttacagggaaaaaagctgaagaagaatatttacatcaactaaaacagttaaatcaactatttaccaaaactgaggcattagaagaaagtaaaattttttataaaaatataaaatttgaaagaggattatttgcctctcacattcaagatcaaatagaaattcacaaggcaaatgaaacgatcattattcctttatcatcaacactttatcacgggcctttgccgcttgatcgtgtggcaaaactgaatttcgttccagccattttttcaagccaaacattgttaggaaaaaatgcaacaactcaggcattctttgatatcacagaatcagagaaaccgttacaactgaatttcgcaatgaattattcattaagcggtaatgcggaattaaaacttgcatcggggcaatatcacaatgagcaatctaagacagattttgattggtcaaatgtcgtattaaatattgatttaaaccaaaatacaccaaataactatgtgctatctgtcgatacatttaattcaaatgcccctaatcatgcagtttcaaccgcttcatcaattaaaataaaagatcttgtcgtacaaggctcgttgcaaagcacaaaatggccatttatttatagtgggaatatcaatagtaaaataggctattttgagcaaaataccgaatctccagagactggcgaaaaattctctcttattcagaaaaatagccaagcaaatttaactacacaagttgagggtgatacagtaaatatcatcaataaaacgaatctggatgaattacatattaacggtaacaacttaggtaaagtgaccaacaatgtagaatccaaccgggtaccgagtccgaatcgtaaaca

SEQ ID NO: 481 - DNA, 3730 bp, H. influenzae
ttgttggttataatagagcatttccctatataaaacagaaaaaatccgcctgggttgtaatttttaaggagaagaaaaaattgcaaccagtttcagcaaataagtgcgttggggggcgttaatcgttgctattcttcctcatttatgaaaaaagtctcaccagcttatggtatgttggtgggagctttggttggagggttaattggtggtgcggatttatcgcaaacagtgagcctaatgatcggtggcgcacagggtattactactgcagttatgcgtatcttagctgctggtgtgttggcaggcgtgctgattgaatcgggtgcagcaaattccatcgcggaaaccattactaataaattgggtgaaactcgagctttactcgccttggcactagcgacgatgattttaactgcggtgggtgtgttcgtggatgtggcagtgattactgtttcaccaattgctttagcgttatcgcgtcgcagcgatttatcgaaagctgcaattttgctcgccatgattggcggtggtaaagctggtaatattatgtcgccaaacccaaatgccattgcggcagcagatacttttcatttgccactcacttcagtgatgatggctggtataattcccgcgctatttggtttgattctcacctacttcttagcaaaacgcttaatcaacaaaggttctaaagtgactgacaaagaggtaatcgtgcttgaaacgcaaaatttaccttcatttctgaccgcacttgtcgcacctttagtggcaattttgctattggcacttcgtccattgtttgatattaaagttgatccattaattgcattgccgttaggtggtttgattggtgcgctttgtatgggcaaacttcgcaatataaatagttatgctatcaatggattgagtaaaatgacacccgtggcaattatgttacttggtacaggcgcgcttgctggcatcattgctaattctggtttaaaagaagtattgattcaaggtttggaacattcaggtttgccatcatacattcttgcaccaatttcaggggtgttgatgtctttagcgacagcttctaccacggcaggtactgcggtggcatccaatgtgttcagtagtaccttgttagaacttggagttagcagtcttgctggtgcagcaatgattcatgcaggggcgaccgtatttgatcatatgccacatggttctttcttccatgccacaggcggtagtgtgaatatggatatcaaagaacgtttaaaacttattccttatgaaagtgcggtcggtttgatgatgaccatcgtttctaccttaatttttggcgtatttaaattctaggagttgttatgaaatttgtgattgcacctgattcttttaaagaaagtttgaccgcacttgaagtcgctaccgccattgaaacaggcttcaaacgtgtattccccgatgcggactatgtaaaattgccaatggcagatgggggcgaaggtacagttcaatcccttgtggatgccacgcaaggcaagctcattgaatgtgaagtcaccgcgcctttgggtgacaaagtgaaaagtttcttcggtttatcgggagatggaaaaaccgcgattatcgaaatggcagcagcttctggtttacatcttgttccgcctgaaaaacgcaatcccttgcttaccaccagttacggcacaggggagttgattaaattggcattagatttaggcgtagagagtttcattcttggcattggcggtagcgcaaccaacgatggtggtgtaggaatgttgcaagctctagggatgcaatgtttagattcgcaagataagcctatcggttttggtggagcagagctagcaaatattgtgaagattgacgttcaacaattagatccacgtttgcaacaagttcacattgaagtagcgtgcgatgtgaataatccgctctgtggtgaatgtggtgcatctgccatttttggaccacaaaaaggcgcaacgcctgaaatggtgaaacaacttgatgctgcactttcgcattttgctgaaattgccgaacgcgattgcggtaaacaaattcgtgatcaggctggcgcaggtgctgctggtggtatgggtggtggcttgctattattaccaagcgtacaactgaaagcaggcatacaaattgtgttagagcggttacatttaattgaccatgtaaaagatgctgatgtagtgattacgggtgaagggcgaatagatgcacaaagtattatgggtaaaacgccaattggtgtggcacgtacggcaaaacagttcaataagccagtgatcgccatcgcagggtgtttgcgtgaagattatgatgtggtgtttgatcacggtattgatgcggtgttccctattattcaccaacttggcgatttatcggatattctcaaacaaggcgaacaaaatttaatttctaccgctcaaaatgtggcgagagtactggcatttaaatttcattaagaaataaggcttgttttaaattcgagccttattccatgattatttattttgtgatgttgaataatttctcgcaccaaaaatcgcagtgccaatgcgtaccattgtagaaccgcattttattgcgctcggcatatcatccgtcattcccatagaaagtgtatcaatttgttgattgggtaaggcttgtttcagttgttcaaataggtctgacatttttctgaacacggcttcttgttcagcgattttatcggttggtgcgggtattgccattaagccacgtaggcataagtgcggtaaattttcgatgtgttttgctagtgttagcatttcctcaggttgaatacctgatttactttcttcatcgctgatattaatctgaattaatacattcaatggagccttgttggtcggtcgttgttcatttaaacgatctgcaatttttgctcgatcaagcgtttgcatccaatcaaaatgttctgcaacgagacgggttttattcgattgtaatgggccgataaaatgccattcaaggttaactccttgcgattcaaaatattggatcttttctaccccctcttgcacgtaattttccccaaaagccgtttgtcccgcttgataagctgaaagaatctcggaaataggtttggtcttagatacggcaagtaattttacggtattttgattgcgattttcttctttacaagccgtttcaattttttgctgaattaggttgagattatgctggatattcataggttttcctttataaaaaagtgcggttagtttacacgaaatttattgactaagaaaatttctgaaaaatttgtcactttctgtttgacaagctcgggaaatttcggtatttctttacgcattcatttttcaagataaaacacaatgaaaaataaccgcactttatccgtaatcattagcacgattaccgccattatgatgaccattattatgattaatggcgcgggttagtgcagcaaaaacaagatacagaaaacccgcgattcaactgaatagcgggtttttttataaatttaaaaacacaatatctaggagaaccaattatgcgcgtacttaaatttggcggcacttcgcttgcaaatccggaacgtttttcccaagcggcgaaattgatcgaacaagctctttagaagagcaggctgcaggtgttttatctgcaccagccaaaataaccaacctgggtaccgagtccgatattcgtataccag

SEQ ID NO: 482 - DNA, 4441 bp, H. influenzae
  misc_feature (4411)..(4411): n is a, c, g, or t
caaaattcttttcataaggcataattaaaccaatttcgcccgcataatcaggatgtgtaaagactttagcagggccatccgtgtgggatttatgctgtaatgtccaaccatttttcagcaatttatccgctaagatttgtccagaaagatggtatctatcaaagaaactatccatttcgcccgtttgcatcaactcaataaagcgcatttgaattgggcgatgttttacccaagcaaggaattgctcaaactctttgtcattcagatttttcattaaaactgaattaactttgactttattgtaacccacttcaaatgcacgatcgataccacgcatcacgtcatcaaatttattgatacctgtaatttgatggaacattttcggatcaaggctatcaacactaacgttaatagacgtaatccctgcttgcttccaatcagccacatcttttgccatgcgatagccgtttgtcgtgacggctaattgacgaatgccatcaatgttagcaatgctttcggcaatagaaataaaatctttgcgtaaagtcggttcgccacccgttaaacggattttctctgtgcccatttcagcaaacgcttgagcaagatggataatttcttttaaggttaagaaacttggtttgttagcttcgggttgataaccatcaggtaaacaataggtacaacgaaaattacactgatcagtaatcgacagtcgtagatagtaatattgacgttggaaaggatcgactaagcgagactctcctacgttcttgataggaatggattgcattttacacctttctaaatatggagaggataaaccgtttccagcgtatccctgaataacacacggcgttattggcttgccaccgtatttcttctgaaacttaggctaaacaagctcggagttatgcgttaaatttgatttgtcgtcattctaaaagattcacttcataaacacaatcaataatattgatgaaaatcagtattttcctaaattcttaaaaatcaattatataaaaaaatacataatgaatttaaagctggctcattagtgataattaatcctatttatattaataaccataaatttttagctgattattatgaggtatttttattgatttaaatcataatttaatcaataaataaatttctctacttttcataatcagaaaaatatcctaccatttttatcggatttatttttactaatcaatataggagtgatttatgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaaataaagcagaaaataatgataaagattggacttcggcatcttatgcggagatgatcgatcacattattactcgttttcataatcgccaccgtgaacaactccctgaattaattacattggcggagaaagtagaaaatgtacatagtgatcgtgatgactgtcctatcggcgtaaccgcacagttagaaaaaatttatgctgaacttagccagcatttaatgaaagaagaacaaattttgttcccaatgatcaaaatgggaattatgctatggcctcaatgccaattcgtgtaatggaaatggaacacgatgaagcgggacaagatgtggaagtgatcaaatcacttactaacaattgcacgccacctgcagatgcttgtttcagttggaaagctttatatagcggtattaatgaatttattgatgatttaatgcaccatattcatttggaaaataatattttatttccacgtgtattaaacgaaaaataattcaatattcatcaaaaaataaccgcactttaatctattccgaaaaacaaactaaagtgcggtcatttctataaaaattttgagttggtcgataagccgagttctgtcgtggacaatcattcctctaggcaacaaattactctgccgctcaagcaacctacccgaactctggacgggccacccattgagttcctatttggtcttgctacgagtggagtttaccctgctgccaaccgttaccggaggcacggtgcgctcttaccgcaccctttcacccttaccgtttacacggcggtctgctctctgttgcactggtcgtcggctcacgccgcccggacgttatccggcactctgccctgtgtagctcggactttcctctcgtttacttgtcccactaggtcgtataaatacggttaagggcttcaataaaccagcgattgtctaaccaactcggcgcgtagtataggggcaatcactagtgcggtcaataaaatccccaatttttgaatattgcttcatcaatcttataaacaataatgcctaatttttcattcgtatttttttatgattccgctaaaataacgccaatttcaaccgcacttttaggaagaaaaatgaactatctaaaaattgcacaggattccctttcagtggaaagtaacgcacttttgcaactcagccagcgtttaggcgaggattttaatcaagtcatcgatcttattttagcctgcgaaggacgtttggtaatcggagggataggaaaatcgggtttaatcggcaaaaaaatggtggctacctttgcctctacgggtacaccaagtttctttttacatcctacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtgtgtccaaataatctcgcgccaacaacatccgcacttgtcacactggcacttggtgatgcactcgccgtatcgcttattacggcacgcaatttccaaccagctgactttgctaaattccatccaggtggcagtcttggtcgtcgtttattatgtaaagtgaaagatcaaatgcaaactcgcctaccaaccattttacccaataccaattttacagattgtctgaccgtgatgaatgaagggcgaatgggcgttgccttagtgatggaaaatgaacaacttaaaggcattatcactgatggcgatattcgccgcgcgcttacagccaatggtgcagaaacactgaataaaacagccaaagactttatgacaagttcaccaaaaactattcatcaagacgaatttttatcaaaagcagaagactttatgaaagcgaaaaaaattcactcgctagtggttgttaatgatgaaaatcacgtggtgggtttagtggaattttcaagctaaggaatcccaatgcaacaaaaattagaaaatattaaatttgtcattactgatgtagatggcgtgctcaccgatggacaacttcattatgacgccaatggcgaagccatcaaaagttttcacgtgcgcgatggtttaggcataaaaatgctgatggatgcaggtattcaagtggcagtgctttctggtcgcgactcccctattttacgtcgtcgcattgccgatcttggtattaaattattctttcttggcaaacttgaaaaagaaaccgcttgttttgatcttatgaaacaagcaggcgtcactgccgatcagaccgcttatattggcgatgatagtgtagatctccccgcctttgctgtttgtggtgcttcttttgcagtggctgatgcccctatttatgtgaaaaatactgttgatcatgtactttccaccaatggcggcaaaggggctttccgtgaaatgtccgatatgattttacaagcgcagggaaaatcctctgtgtttgataccgcccaaggtttcctaaaatcagtgaaaaatatggggcaataataactcattcgtcagtgttattgcttagtaaaacgaagtaaccgcaaatattgcctatttaaattaactgtttaaatatacaatgcaatagaaataaatcaagatttttgtgatgacaaacaacaattacaacagcttctttgcaatctatatgcaaatattttaaaaaaatagtataaatccgccatataaaatggtataatctttcatctttcatctttcatctttcatctttcatctttcatctttcatctttcatctttcatctttcatctttcatctttcatctttcatctttcatctttcatctttcacatgaaatgatgaaccgagggaagggagggaggggcaagaatgaagagggagctgaatgaacgcaaatgataaagtaatttaattgtncaagggtaccgagtccgatttcgtatacag

SEQ ID NO: 483 - DNA, 5174 bp, H. influenzae
gagaccccctatggtcagtagggcttttaacccctgtcagcattcagggttaaaagccctgaccgacaggaaaaagtatagataaaagagctgttgatttcaacagctttttgcttttaggtatgaattaatatccagtgaaaaaacttatcaaacgccgtgaaattccagttggaaattctgtttcaaaccatcccttattagatcgcctttatcgtgctcgtcatattaaaaacaccaaagaattagaccgcactttgaaatcaatgctcaatccaaatcaattatatggcattgatcaagctgtaaatttattagttgaagcctatcaacaacagcaaaaaattgtgattgttggggattttgatgctgacggtgcaaccagcacagcattgagtgtgctggctttaagacaacttggcttttctgatgtggattaccttgtgccaaatcgatttgaacaaggttatggcttgagtattcctgtggctgaaatggcgattgaaaagggcgttcagcttttaatgacggtggataatggcgtttcgtcttttgacggtgtggcatttttgaaagaaaaaggcattcgagttttagtcacggatcatcatttaccccccgaaactttgccgccagccgatgctattgttaatcctaatttaagtcagtgtcatttcccttcaaaatccttggcaggtgtgggtgtggcattttatttgatgttagccgtacgagcaaaatttcgtgaactcggtatttttacggcagaaacacaacctaattttactgatttgctcgatctggtggcactaggcactatagctgatgttgtgcctttagatcaaaataatcgtatccttgcttatcaaggtttaatgcggattcgtgcacggcgttgccgtcccggtattgttgcgttggcagaagtggctaaccgtaacgtagagcagtttacttcaagtgatctcggtttttgtattgggccgcgtttaaatgcagcagggcgtttagataatatgtcgattggggtagagcttttgctggcgaacgaaatgtcaaaagctagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaacctgattggcatcaaggcgtattaggcattgtatcatcaaggattaaggatcaatatcatcgtccagtgattgcctttgcacaagatagtgagggaattttgaaaggttctgctcgttctattgaaggtttacatatgcgtgatgttctggagcgtattcattcgcaacatcctaatatgattttaaaatttggcggacacgcaatggcggcaggcttgagtattcgcgaagaacattttgccgatttccaacatatttttaatcaaaccgttgccgattggcttgatgaagaacatatgcaaagcataatttggacagatggcgaactaaattcaaatgaatttaatcttgaaacggcagagctgataaaatcggtaggcacttgggggcaagagtttcctgagccttgctttgatggcgaatttaaaattttagaccagcgcgcaattgggcaaaataaaaatcatctaaaaatgttgctagaaccgaaacaagggcggggttttattagatgcgattgcatttaatattaatacaagattgtatcctgatctttcaattaaacaggctcgtttagcctataaattagatattaacgaatttcgtggcaatcgtagcctacaattattggtagattatattgagccgatagatgagtgatagaatgaaattaaagggaatattggcattttgtttgctttttttatcgtcgtttgttttagcagaagtcaatcagaaagaattttcagtgcaaaattctccgcacttgccatcaagggacacaatctattttgaagacgggcgtgattatttttcttataaagaacctattgaacaagtgtctcgagcggataaaaaaatccgcattcaattcttttttgattatgattgtcgagtgtgttcttcagcgcaggatattttagaactttatagccaaatacgcacatataaagttgtgttggaacaatatcctattgcaactgccgatagccagtttagcgcacgtattttttatactttgcaagcattaagtgcgagcgaattatccaatgttttgttatttgaaacttcagaaaaatcccgttatacagaattgtccacatcaaataaaattcagcaatgggcggaagaacaagggctagataagcagttatttattcaaactgaaaattcacaaagcgtaaaagaacagatccaaaatgcgattgaattgacggaagaatatggtgtttttacctatccttacgttgttatcggtggaaaatatgtactcactgcaagtacgctttataacgatgattatagcgtagcagtgttagattttttggtaaataaaatagaacaggaacaaaaacaatgaaaataggaattgttggtgcaatggcacaagaagtcgaaattttaaaaaatttaatggctgatagaacggaaactcgagtagcaagtgcggtcatttttgaaggcaaaattaatggtaaagatattgcattattgcaatcaggcattggcaaagtggcagctgcaattggcacgacggcgttattgcaattagccaagccagattgtgtgatcaatactggttctgcaggtggggtagcaaaaggcttgaaagtgggggatattgtgatttctgatgaaacacgctatcacgatgcggatgtgacagcttttggctatgaaaaagggcagttgcctgctaatcctgctgcatttttatcggataaaaaattggcagatctcgctcaagaaatggcagaaaagcaagggcaatcagtaaaacgtggtttaatttgttctggcgatagttttattaatagcgaagacaaaattgcacaaattcaagcagatttcccgaatgtaatgggcgttgaaatggaagccacagcgattgcacaagtttgttatgcttttaatgtgccttttgtggtggttcgtgctatttctgatggcggcgatggcaaagcaagtatgtcttttgaagagtttttaccattggcggcgaagcagtcttcggcattagtattagggatgattgacagactgtcgtaataatcttttaataagataataaatgctaaaattgaaggcatagctattagctatgcctttttatatgaacctattagaatttatagtttaaactcagaatataagttcttccacgtgcaaagttataaagcacggttttatcttttcctccatcttcacaatcctgacttttactacaaattgaatcatttaaacttgaataataacgttgcgaagccgcatcatttccagcatctaacggatcaacataacgtttatctaatagattttgtacttccgctttaataatcaaatctttgattggttcatagctgacgtgtaaatctaaaataatcggttgttttttaatctcttctgtttttttcacaacgtagtaagttcttttacctgaggtctttaattcaaagtgagatccattgatatattcttcttcaattgtcgcacgtttactttttccataataacgagctgccatacctaaggttaatttttgatcaaaccaacgtgtaccaatctctaatctgccgtagtcttttggtagcattgaaacacgagataagccataaccttgtttcaaaatgtcttcttttgaagcattattcggacgtgagctggcatcggcataattggttggctgattagtacgttgataagcgtaagagacattcgcaaaaaaacgtcccatatcataattaagctctaactccgccccgctttttttcacgataggttgataattttgatgtgcgatagtaaagcgaaaaccagtactgtctgcccacgtaggtacaacgccatctcgccaccaaacaccgtaaacattatggatatagtttttaataaagctacgataacccactaatttgatgcctagcacatcgtcttgagtgaagagaccttttttataagtattaaagcctagttgataggtatcagattgttcaggttttaatgccgtgtttacccctgcattagacacttgagagaaaaacatctcttgaatattcggcattctgtgtgtgcgtgaataagtgaaaaatggcataaaataatcgcttagctctgcacttaatgtagcggaatgattgaatgcctttttatgccctgatttatgcaaaatcggttcattaatttgattcgctgtattttcatatccaacatactcaccattaaacgcataatgggtaaaattcacgctgtaatttaaatggtaaatacctttagaaagtgcggtatcaaaatacaccgttttaaatttttgcttgccagaaggttgtaaaatcactgaacgttgtggcagtaaattacgattacctctaaatcgtcctaaattactatagttaccttgatcatgtgaatcatcgttataaaacaaacttaattcttctggaaaacggtttttactgtattcattggtaaaatagttaaaacctaatgtggtttttaaatcgatttcttttggcaacaagaaagtatggctgttgtttatatcaacaatatttgccacatttttggtaataagtttgtctgccactcgccagccagcaaaaaaaccacccttaggataaatggttttaccaatgttatgtgcagccattaaattaagatcgagatagttgttattattgaagttataattgacttggtaattacggttttcaattttgcgagaaccaattttattatccaatgtacgtatttgtgctcctaaattttggtgatcatcgccatattcaaattttaataaatggctacgcgagcgtgattgcaaactaccaggctcaattggtgcaacactatattgatctttattacgttcaaatgatttgtcagtttctttaattccatccttaccgttttggagctcgtcaatattctcaggttttgttccagggtaccgagtctgatattcgataaca

SEQ ID NO: 484 - DNA, 3662 bp, H. influenzae
  misc_feature (46)..(46): n is a, c, g, or t
  misc_feature (3624)..(3624): n is a, c, g, or t
  misc_feature (3648)..(3648): n is a, c, g, or t
gccagacttggcatgcctggcaggtcgactctaggaggacccctgnagcatctttaaattggcaggcattacaacctgatttggtaattcaagattttcctttagaaccagtggatttctgggcgttacaaccgaatgctacacagggtatcgatttatttttacgtcatccgacacgttccttactaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggagaggcgttaagtgcattgtattgcgatcaattccagcttttcggtagttttcggattcatccaagttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgagttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcttcaacttttgctgaaaaaactgcattaagtgcggtggattttgagggtatttttcaacaaaaattagcacaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggcatgatgattgcgcaagcttgcctttccaatatcttagatttgccctcgcaattgccattttctgcctcattagtgtttgaacagtcttatggtgaaattgatggtgatagtgcatctttggcgattttctgtgtgctagcaagcgctttagctgatttgcctttgcctcaacatatcgcaattacaggatcgattgatcaatttggacttgttcattctgttggtggtgtaaatgataaaattgaaggcttttttactatttgccaacgtcgcggtttgactggaaaacaaggtgtaatcattccaatgacgactattcagcaactgagtttgtctaatgaagtgaaaagtgcggtaaaaaatggcgagttttttatttatcctgtggaagatatttatcaggcttgtgaattgttatttgggcgtgatttgttagatgaaaacaaagattatacagaaaaaactgagcctttatctcgtcttattcaacgtcgtattgagggacgtgccgattctgaacgaaaaagtttttggcattttttccgctcctaatagagaaaagcgagcattttttcgcttttctttttttctataatttctaagagtgactgctccgacaagttttgcgaacaagtgttagctatttacaggttactgcgttcattttaaaatagaatatttcagttataactgggatttatcatatataaaggattctgaaaatgcaaagcacttggacacttaataaaaaaaaatagctattcttatgatgatttgctcgcatcaggtcgcggcgaattatcgggtaaagaaggggccgcaattacccgcgcccaccaatgttgatgatggatcgtatagttgaaatgaatgaagaaacaggtgctttcggtaaaggatacattgaagccgaacttgatattaagcctgaattgccattttttggctgccatttcattggcgatccagtaatgcccggttgtttaggattggatgcgatgtggcagcttgttgggttttatttaggctggattggtggcaaaggaaaagggcgagcattaggggttggcgaagtgaaattcactgggcaaattttgccgacagcgaaaaaagtagtttacagaatccatatgaaacgagtaattaatcgtaaactagttatgggaatggctgatggcgaagttgaagtagatggtcgtgttatttataccgcgacagatttaaaagtaggactattccaagatacctcagcattttaatttttctttattaatttatataaaagtgcggtgaaaatttttcttagattttcaccgcatttttccttattaaattgtaataaattcttaaaatatctataatattcttgctattttttcaattttattagtagtaaataaaatttattttaaagctttttaatagacgttattatagaaaataataaattaatttctatttaaactataaataatatactgaagtagtgggaatatgatggcaaatgatgattttcaagaatatgtgaagcaactggtaacaaaacatcgagatgaacgaatttatccttttcaatatgaaggaaaaaaatattggttgaaacaacctgaaaaattgaaagggatttggctattattaaaaccccatcctaaaaaatcttttaaaaatgaattacatactttattgaagcttgctgaacaaaatgcgccagtgccaaaagtctcttattatagtgatcatttttttgtgttggaaaatgtgggactgactgtatcacaatggctatgcaataaaaatatagatgaacaacagaaatttttaattatttatgatgcttgtctcgctttgattgatttgcacgctaaaaatttgatacacggtcgtcctgctattagagatattacttgggataaagggaaggttacttttcttgattttgaatctcgtgcaaatagtcaaaatcaaaattgggtagttattcgggatatgttatttttctttgatagtttatgtcgagaagaagatatttcagacgattttattcaaaaagtagcgttgtattatcaagcttattgtagagtagaaaattggcagaatatgatcgtatttttgcagcgttttcgctgggtttattatcttttattgccttttaaaccttttgcaaagaaagatttaattgcagtttatcgcttatttgaaattttattaataaagaaaaaatgatgaagaaaatattttttatttttgtattatcaggcatattagctgcttgtgccatgggtggtggtattcgtgctggtggtggaagtaatggtgtaggattaggtgtggggattggatctggcattcgcttctaataatgaaaagtgcggcaagtttgatctttatnctgccatgggtaccgaaggcccgntattcgtataccag

SEQ ID NO: 485 - DNA, 5986 bp, H. influenzae
  misc_feature (57)..(57): n is a, c, g, or t
  misc_feature (958)..(958): n is a, c, g, or t
tgtttacgattcggactcggtacccatcaaaagttgtaccattttttttccttgttnatttgagaaatttttttgagaatataattgagaatgaatttcaatcactcggggaattctagcaaaggctgaataatgcgtaaaccttgaatttaaaaatttctgaattttttaccgcactttatgtggaaaagtgcggttattttttgaaatattatagggaacgaagataatcaatgatcatttgatgatggtcttttatcttaaatttatcaaatacttgcataatagttccgctttcattgattaaaaaactaattcgatgaataccgtcgtaagttctccccataaattttttttcgccccatacgccaaattgctccgcaacttgatgatcaggatcagaaagcaatgtgaaattaagtgcttttttctcaataaattgagctaattttttcggggcatcaggactaataccaagtacaactaagcctagtgcatctaattcagatttactgtcgcgcaatccgcaggcttgtgtggtacagcctggagtgagagcctttggataaaaataaattaaaacttttttaccacgaaaatcacttaaagaaacaaatttttcttgttgatttaataaggtaaaagcaggtgcttgattaccaacagataatggattcataaaaaactcctttaatgaaaaaaaatttgcaaattaacgttattttagcgactatacaagtgaaaccaaatataaaataaaaacgcacggaggtatatgtcagcgcaaaatcctttatttcgggtagcatagttgcccttgttacgccaaatgaatcattatggcgaagtcgatttttcctgtttagaaaaattagtagaacatcacattgaagctggttctaatgcgcttgtttctgtgggtacaacgggagaatccgccacgctaagtattgaaganaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataaaaataaaggggtaagtaattacccctcacttttatgtattatagatcagtaaaatgatcaaaaagtgcggtcagaatttatcaaattttcaatttagttaaggttaatatatgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggatttataaagtactttaattcaatagggcgtgtcatataataatttctctaaaataataaatatttaaacatgagacatagatcatccttttgaaaattactctgatatttatctttaaaacacttgaaaatctaacataagaacactattttgttattaactagaatttaaatcacgcaacaaagaggtaaatgctatgacacttaatattaccagtaaacaaatggacatcactcctgcaattcgtgaacacttggaggaaagacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaggattcttttgaaaactaaatactgtagataaaatctaatctggcagtcttattgtaaaatgatatgtctgtcagattaattttagatgaaacaattaaatcactaaaaattgatgatatttaataaaatattaataatattttattaaatatagattaatttaacctatcgtgcaaggcgatgtaaacttcagtacattcacgcttatccactacaagaacataaacgacaactttatcttcaataacttcataaacttaaacaatgccctacagagcgaaattttattttataaaacacaccaaaaaatccagaaaaccgatcggcaaatacgtatgaatttcctaagcgtttgattaattttttcttaaattgcttttaataaaaatagagactaatgaaagatacagattaaatttatattttttaacgagatagatattatttgacgggattaatggcggtgagaaagggatttgaacccttgatgcagtttcccacatacacgctttccaggcgtgctccttcaaccactcggacatctcaccgtaaaaggttcgcaaactataaagatttactctggtttagtcaagttttttactctaaaaaataaaaatctttaaaagattagttaaaaaataggcaataaaagctattgagctaattcagagttagaagatactaataatttagtaagatgtaaccttgataattattaaaacagttgatttttaataaataccatatattaatttatcttttattctctttcttaatctttttattttaattaaaaaagggattttctcaaaatgatcataccaagatgatggtatatcaataattttatccatttcttttaaaagtaaatttcctatatgacaatttaagtgactgcattttttgtgccaaaatttatttggaccacaataatgagaaataactattggcatttttacgtgtaataaatttttctttttaatcaaacctcgatccgttggtgtaaaattaaatctattattaataaattttacttttcctttacagataccatttagaatatcttgatcttggtatttcataacattattgtatttattcatccaatttattgatttttggaaaatattttcttctttccatttatttaaattaattaataatatacctgcattaaaataagaatatccttctaaaccaatggattttttataagcttcattttttacatcaataaaagtatctcgacatcctgccaaataatagttcattatatctatattccaaagttcttgaagtgaagagtttgttaatgtgtccacatcaatataaatagctttttctatattctttatatatttagttaaatttagtctagcgtaagtcgctaaagatatgtaatctattgtttttggaaagttttgaaaatctgcctcactgacaggcaagaaaaatactttacaaaaatatgcagttgctaaattatttattattgtcttattttcctgatttattttcatatcaagaatataaaaatttattttttcaggtgtatttttaataatgctaaaaatacttacagctaaataaggtgcataatggttgtcagatgaaaatataatatttattgtctgtctgtctgtctgtctgtctgtctgtctgtctgtcataaaattatcttctgattaacgtgtaaattattattttttattaatagattaaatacttttattaactttataatttattttttaaaatattcaatgcctttgctcgatgagaaatttttttcttctcagctgtttctaattcagcaaatgtgcaaccttgttctggactaaagaataaactgtcataaccaaaaccattttcgcctttttcttcaaaaccaatcacgccacaacactcgccttcggctataattggcgatggatctgttggatgctgtaaaaacacgatacagctcacaaatttagcttggcgttgatcttttgcaacatgagcaagctctgccaataatttctcacggtttttagcatcattgccctcttcaccagcataacgagcagaatacagacctggtgcgccattaagtgcggaaaccaccaagcctgaatcatccgcaatagcaggtaaacctgatttttctgatgcataacgtgcttttaataacgcattctcaacgaaagttaagcctgtttcttctgggctttcaatgcctaaatctgtttgcgcaatcacttcaaagccaaaatcagataggacatcagccatttctttcactttgcctttattgcctgtagcaagtacgattttttgtttcataattagtccttttattgatgataagctgccgttaaatcagcccagttttgctcggtaaattgaatattcattcgtccaacttctttttcaaaggaacgttttaaacggttcagattttgtgctttccaaaaatcccctgattttttaccgcacttatcaaaatcaatcaaccaacatttttgctcttgttcagcttgttgaagcaaaatattgtgtgcattcaagtcagtatgacaaatctgtaaatcatgtagttttcgaatcaaacgaccaatttgcctccaagtttcttttggcaatgtttgtgtttgtaaaagtgcggttaaatcctgcgcgttttcgattttctcagtcaaaatatccgcttgatagcaaatacctaacttgcctttttgaatacgcgcggcaatgggtttaggcacaggtaaaccccgcttcatacaaacgttgcaacaaatgaaactcagcaaaactacgggtagtttcaagaacagaaaaaccataccgatcttcgctcactcaaccccatattccaccgcgatatttatgaccccacgtccaagttaatcctcaacccattccttccgtcttttattcactttcccgtccccctatttccttgttcttttttttcccgccacctgttcccgtcccacccttgcttccctccatctccgtatttctttcttccgtgttttctcccttccccttattttccgcgattttctttccgtcttgtttacccccacccccg

SEQ ID NO: 486 - DNA, 4093 bp, H. influenzae
gggggagtgtatagggtgtgcatggtgctgagatagtgatgggattgcgaaaagtagcggggtaaattcacgtatcataaaaatcgagatcaccgaaaaaaggccgggtcgtcaaagaaggaaaggaatgagttgtgttgtattgttgaacagtaagatgggatccaacggcggggctgtggattgggaggcagggtgtgtcgtggcataattcggtcagaggcaatgcacttaacatgctagtgcaattcaaatcgcaattaaggtagcactccgccgggtcgggtggtgcgccaataaataacaaaccggcggggtgccttttcgatatgccggtggatggtgggggcaccgtcgctccttcaggagttggggtagtggatatccatcactaactctcctttatcattcggcactaaatttggccctttttcatacatatagctaacaaatgggctatttgatacaaagtgggcaattccatctgcctcatattgacaaactttcaaaccaccgatccatgccattacaataaaaatagcaatacggataaaattaataaattgacgctgcattggtgcaacaattctcgcgacaaattcaacaaatgtattaaatactgacatataaatttccacataaaagtaaataaaattgagagcctaattctactcgctttaatattaaaaagcaaaatcaattccctttaatataaaggtaaataacggagaaatttgaaaagttttactaattaaaataaaatttgattttcccattttaagcctatttattatctttaaatcacatttaaataatctttacacaactaccttatgatattaaaatttacaaaatttaagcaaatcctccacatcttctaaccaaagatttccaatttcatcaatcaattctccacaattaaaaacatcagaatttttagccgcactttctaaagtatccgctaattgacgtaaatgatttaaccctaccgatgccgctgcgcctttaattttatgggcggtatcttctgtttctttcatattatcttttgataattgagccagataatttggcatagtttgtttgaataaagataaattttctaaaatttgtttttttccaagtgtttctatcagcgctaaatcaaactgttctgaaagctcattatcatcattcatttctataatagattcgctttcatctgcaaaaaattgctgtagacaatggtgtaaatccttaattgaaatgggtttacgtaatacgccatccatgcccatttctaaatattcttgctcgctttgcataacattcgcggtaaaagcaatcattggcggtaaaaaatcataaataccgttttcatagttctctcgcaaatattgggcaatttcaaaaccactcatatctggtaatttaatatcgagcaatagaatgtcgtaaacatttttctcaaataaagtaatcgcctgcttgccatttgtcgcaacatcaacatgatgcccaagtttttctaaaatagtttttgcaaccataatattgagatcaacatcttccactaaaagaatattcaaggatggtatatttttcttaacagattctttttcagaaatttcctgagcgtggagagtaagatggaaagtcgcgccttttcctcgctcactttcaactgttaaatccccttccattaactgagcgagatttttagaaatagccaacccaataccgctacccgcactttgctgacggctttctttcacttgataatacatttcaaaaatatgtttttgttcttcaggtgaaatccccattcctgtatctttcacaataaaatggtaacaatcctgatttctcataattttaagaataatatttccctgatccgtaaacttcaccgcattactaattaagttccacaaaatttggctcaagcgaacacgatcaagattcaaccaattaggcaaattaggttcaagctctaaagaaaaaataagatttttttctttggcgaggaaactagcaaaattataaatatcgtttaataaggcggggaaatctgttggctggcgatttaattcaattcggctggcatcaattttttccaaatcaataatatcgctaaaaatatagcctaaactgaccgcacttatgttgatagtttttaaataattacgctggagatcatccaattcatcatcaagtaaaatttgactaagcccgacaatcccattcaatggcgtgcgaaattcatggcttattgtggcaagtaaggtacttttatcacggctatttttttctaacttttccaatgcttgggataattttttctgagcagcaattcgctcggcgacctcattttccaatcgattaaccgagctagaaagatcaagacgagaatgttcaagtttttctactaataaagtgaaaaaataaataacaaaaggcgcagtgagtaagccaaaagttacagaacgaaaaatatctacccaagatatctgatgaacaataaatagactaaataaaatctgagtacaaagggctaaaaccgcgagaatcatcacgcctaaaagagaaaaacgaagacgcccaagacgaataacccaatccacataactctgagcaaaatatttgaaatttttcatcaaatctcctaaaacattattatcgttataaaaaaacctgtgcatataggctttattatatccataaagtaaaagagattgttattactatgtgtgcgtaagaaatgaaaaacttaatctttattaattatctgtttgactaaaatttgtaattcaggaataacttgctcttcaaaccaaggattctttgttgcccaaagctgattacgtggggaagggtgcacgagaggcataaagtgcggtaagaattgacgataatttttaacagtgttagttacattatctttattttcgggtaaataatatttctgtgcatattgcccaataagaatagtgagctgaatattaggtagattccctaaaatcattggatgccatctttctgcaaaaccttgacgaggtggtaaatcacccgatttaccttttccaggataatagaaatccatgggaagaaccgcaaatatcccagaattataaaaataatcgtaatctactcccaaccattctcgcagacgatcaccgcttttatcattccaatacaaacgagattgctcagcttttaacccaggagcttgaccaacaatattaattcgagctgttttaggcgccgaaaataaagggaaaattccacgttctgtaaaatctttattttgaggatcagcgataatacttgaagttatttcgtctaaatttttaagcataatgaaggagattagaaatgaatatataaagtctatttgaaaaatatgaaaaatcaaaactctaaatgatgtaaataggtatatttattaaaactatattgtaggcaatacaaaactaaaaacttgatattgaaatacaatctctattttctactttaatccttttcatgaaataatgagtaaattcccaaaagctaaaaccccatatctttcgacacggggttcttctgtttttatttaacttagataagcatttgataacctggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttcctctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcattttctggcaagttcg

SEQ ID NO: 487 - DNA, 4643 bp, H. influenzae
  misc_feature (4615)..(4615): n is a, c, g, or t
caattcatcgtggcacgattcaaggctgtggcgtaacctctattggcaataacaatttattaatggtgaatgttcacgttgcacacgattgccaaattaaaaataactgtattctggcaaacaatgcaacgcttgcaggtcacgtagaattagatgatttcgtgattgttggcggtatgtcagcgattcatcaatttgtgattgttggtgcacacgttatgttaggcggtggttctatggtaagccaagatgtaccaccttatgttatggcgcaaggcaaccacgcccgtccatttggcgtaaacttagagggtttgaaacgtcgtggttttgataaaccaaccatgcacacaatccgtaacatttataaaatgctctatcgtggcggtaaaacacttgaagaagtgttaccagaaattgagcaaattgcggaaaccgattcagcgatcagtttttttgttgaatttttcaaacgttcaactcgcggaattattcgttaataaaacttcttcattttcaaccgcactttgcacaccaaagtgcggttattttttaggataaatttgatgaacaaaacaaatccaaccattgctcttgttgcaggagaagtatctggtgatattctcggtgctggtttaattcgccagctcaaagcacattatcctaatgctcgctttattggtattgcaggcacaagaatgttggctgaaggctgtaaaacgctcgtcgatatggaagagctttctgttatgggtttggctgaaatcttgaaacatcttcctcgtttgctgaaaattcgtaaaaatgtcattcaaactatgttgcaagaaaaacctgatgtttacatcggcattgatgcgcctgattttaatttggatgtagaactcaagctcaaagctaacggaattaaaaccattcattacgtgagcccctctgtatgggcatggcgtcaaaatcgtatccataaaattgccaaagcgacccatcaagttcttgcctttttgccttttgagaaagccttttacgataaatttaatgtcccttgccgttttattggacacacaatggcagatgctattccgctcaaaccaaaccgtgccgaagcatgccaaatgctacagattgatcccgcacaacgctatttagctatcctagttggaagccgtggttcagaggtggaatttctggctgagcctttcttaaaaacagctttattgttaaaagaacaatttcctgatttacaattccttgttcctttggtgaacgaaaaacgacgaattcaatttgaagccattaaagctaaaattgcgccaaatctagacctgcatttaattgacggcaatgcacgacaagcaatgattgcagctgatgcaacacttcttgcttcaggaacagcagcacttgaagcaatgctttgtaaatccccaatggtggtaggctatcgaatgaaaccactgacctatttcttagcaaaacgtttagtgaaaaccgattatatttctttaccaaatttgcttgcgaatgaaatgctcgtgcctgaaatgattcaagaagaatgcacgccagaattgctcgctgaaaaattatctgcttatctttctgatgatgaaagtgcggtaaaaaatcgccatattttaattcagcacttcacggatttacaccaaaagattcaatgcaatgccgataagcaagcggctcaagcagtcattgatttattagaaggaacagaaaatgtttgaatatccacaaggctatgaattgatcgctggtgttgatgaagttgggcgaggccctttagttggggctgttgtcacggctgccgttattttggatccgaataatccaattgaaggactcgctgattctaaaaaactttctgagaaaaaacgtttagcccttgctgaagaaatcaaagaaaaagcccttgcttgggcattaggtcgagctgaagctaacgaaattgacgagataaatatcctgcaagcctccttgctggcaatgactcgagcagtaaaatctttaaaaattcaaccgcactttgtgttggttgatggcaataagatcccaaaagatttagctattccagcgcaagccgtcgtcaaaggcgataaccttgtggcagaaatcagtgcagcctctattttggcgaaagtggcacgagaccaagaaatggaagaattagacaagcaatatccagaatacgcttttgcccagcataaaggctatccgaccaaattacatttggaaaaattagctgaacttggtgcgttaccgcaacatcgtcgtagctttgccccagtgaaaaaagcactagaacagttttagaatgctaatttggtttaacaaaggctgtgttttaatactgtgttaatgctttcactaaaatttgatgcacataaacaaaattttttgacttctgtgagtcaaagaaaacaggttaagagagtaattaaacctgtacggtcgataaatatacctaaacactctgctattcctttgtaatagcacattaaaataatgacttatgaggatttataacgatgaagacagacattcaaaccgaattaacccaagccctactatcacacgaaaaagtatgggcgaacgaagaaaaaaccattttagccaaaaacattctgttggatttggtagaaaaaaccgacccgactattatcgggttgttattggggaatgatgagttaaaacgccatttttttgtggaagtgaatggtgttttggtgtttaaattgcaggattttcgttttttcttggacaaacacagaatcaataattcctacacaaaatacgccaatcgcattggcttgacggacggcaaccgctttttgaaagacagttcggatattgtgttggattttccgtttaaagattgtgtgctaaatggcggacaaagcaccgaagaaggcgaagaaatttattttaaacgcaataacagccagccagccaattatacactaaattaacccgaaaaagacaagaaatcttttttaatcaaacccttgcttttgatgaaattgaccgactttttgacgcaaaagcattctcaaaattctctcgctataccgcagatggcaagcaacccgttggcgaaatcaaacgccattttgacggcacgccagccgaaaatctcattatcaaaggcaataatctgatagccctgcattcgcttgccaagcagtttaaaggcaaaatcaagctgatttatattgatccgccatataacacgggcaatgacggtttcaaatacaacgacaaatttaatcattccacttggctcacttttatgaaaaatcggctggaaattgcgaaaacattgttggctgatgatggcgtgatttttgttcaatgtgatgacaatgaacaagcctatttgaaaattttaatggacgaagtttttggtcgtgaaaattttgttacaaccattcattgccaaatgtccacaacgcaaggaatgaaagttaaagcggcacaagatggaaatattgttaaaaatgctgaatatattatagttttttcaaaaaatggacataaaaatattgcaataaatcccttgtatgatttgcgttcagaatatgatgaacactattcgctatatttaaaaaacgatggggctattgggcaacttaaagaattatatgattatagatttccaaaagatttaaaaaatacaaccgcactttctttaaaagaagcatttaagaaaagtaatgaatttgccgagattgtgaaaacacatctttccaagattgtaagaagcgataaagttactggatttgatttatccgttgaattagaaaatagcaaatggaaagaagttgagagaaatggaagaaaatatattcttacattagataaaaatggcaaagtttgccaattattaagactacaagattcttggggaaaaactgataattacaataatgatgagggacttcgtaaaattcgtggtaattggtgggaaggtttttaccttgatatgggaaatgttggaaaagaagggagcgtagattttaaaaatggcaaaaaaggagagcgtttaatttcacaaattattaaaacagcaaccaacgaaaacgacatcgtcctagactaccatttaggcagtggcacaaccgccgccgtcgctcataaaatgaaccgccaatacatcggtattgaacaaatggattatattgaaacgcttgccgttgaacgcttgaaaaaagtgattgaaggcgagcaaggcggtatttccaaagccgtgaattggcaaggcggtggcgagtttgtttatgccgaacttgctccatttaacgaaacagcaaaacaacaaattttggcgtgcgaaaattcaaacgacatcaaaacgctgtttaatgaattatgcgaacgctatttcttgaaatacaatgtaagcgtgaatgaatttagtcaaatcattgaagaacctgaatttcaaaccttaccacttgacgaacaaaaacaaatgatgcttgaaatgttggatttaaatcaaatgtatgtttcattatccgaaatggacgatgaacaatttgcaggttgcttaaacgatgacgataaagcgttaagccgtgcgttctatcaatcagtaaaaaancagggtaccgagtcgatattcgaaaaca

SEQ ID NO: 488 - DNA, 3809 bp, H. influenzae
gatatcccctcattaaaaaggacaatgcaatgcttaaccaaattaaaaaagatgctcaagatcgtatggaaaaaagccttgaagcattaaaaggtcatatttcaaaaattcgtactggtcgtgctcaaccgagtttacttgatgcaattcaagttgaatattacggtgcggcgaccccacttcgccaattagcaaacgtagtggcagaagatgcgcgtactttagccgtaactgtttttgatcgttctttaatctctgcggtagaaaaagcaattttaacctcagatttaggtttaaacccatcttcagcgggtaccacaatccgtgttccgcttccgccattaacagaagaacgtcgtcgcgatttaatcaagatcgtaaaaggcgaaggtgaacaaggtaaagttgcgattcgtaatgtgcgtcgtgatgcgaatgataaaatcaaagcattattaaaagacaaagaaatcagcgaaaacgaacaacataaagcagaagaagaaatccaaaaaatcacagatatttacattaaaaaagtagatgaagtattagcggataaagaaaaagaattaatggatttctaatcatcaaaaaatacgaaaggcagacagttttgtctgcctttattttattaggtatgcgaatttagacgtaccaatgaaaatataatcaacaaagtgcggtaaagattctatgcaaaaacaaaacattgtcattcttggttcaacgggatcaatcggtaagagtaccctttctgttatcgaaaataaccctcagaaatatcatgcatttgcactcgtcggcggaaaaaatgtagaagcaatgtttgaacaatgtatcaaattccgaccgcactttgcggctcttgatgatgtaaatgcggctaaaattttacgtgaaaaattaattgcgcatcatattccaacgaaagtattagcaggacgacgagctatttgcgaactcgcagcacacccagatgccgatcagataatggcgtcgattgttggtgcagcaggattgttaccgactctttcagcggttaaagcaggtaaacgggtattactggcaaataaagaatcactggtaacctgcggacagctttttattgatgccgtaaaaaactatggctcgaagcttttaccagtagatagtgaacataatgctatctttcaatcattaccgccagaagcacaagaaaaaatcggtttttgcccactttctgaattaggtgtaagtaaaattatactcactggttctggcggaccattccgttacacgccacttgaacaattcaccaacataacaccagaacaagcagttgcgcaccctaattggtctatgggtaaaaaaattctgtcgattcagctacaatgatgaataaaggcttagaatacattgaggctcgctggcttttcaatgcaagtgcggaagaaatggaagtcattattcatccacaatcaattattcattctatggtgcgttatgttgatggctcagtcatagctcaaatgggaaatccagatatgcgtacaccaattgcagaaactatggcatatcctcaccgcacttttgctggagtagaaccactcgatttctttaaaatcaaagaactgacttttattgaacctgattttaatcgctatccgaatttaaaactggctattgatgcctttgctgcgggtcaatatgcgacaacagcaatgaatgcagctaatgaaattgccgtacaagcatttttagatcgtcaaattagttttatggatattgcaaaaattaattcgaaaacaattgagagaatttcgccttataccattcaaaatattgatgatgtactcgaaattgatgcacaagcaagagagattgcgaaaacactaattagagaatagacctagaataactaggtctagtttattcgatttaatggaatacaaattccaaaatgcacatataggctgcaatacaaaataaaataatcgccaataattttcttgttaaaactggattcattaatccacgcaatttcattgagaagaaactcattccaaatgaacccaaggtaacgacaccaactacaagaaagtttacatatcctagttggccacttaggctgatatcatagggaaaagctctagtgagatagccgtatagattaccaataccaccaataatcatcatatagttcgtataaacggcaatttgttgcgtttttaccccctttaattgcccgacaaggggcgcaagaatagaaccgcctccaatacctgtaatacccgcaattaagcctcctccacaaaaactaatactacctttagctcgttctataggagacatattaaacacttctatttgtattctcgatctgttcaaaaatgttttaatcgctagtgcacttaaactaaccgtaaaaattaaactaattatcgctgtagaaaaataaaaacttaattcaaaaccaatttgcaccccaatcaccatagcaatagaccataaaatcatattgatataatcaattttaattttttgcttatggaaaaataataaattaatcaatgcggtacacatcacaatggtgagtgacgtagctgaaataacttgaatcggtaacgcaggaaacaatgtacgtaaaattggcaccatcaataccccaccgccaataccaaaaatagcagaaaccatattggtacaaataccgcaaatcagtaagataaaaattgtactaaacgccatcttagatcctatttaaaaattcatttaatcatacttcattttgacgtaagagcatatgcgcaacttatgatcgctatcatatacagttaaaattattctgctatgataaaaagaataaggaggatacgtagatatgaattcatttcaattaatggcaaaacctactggttcaatttgtaatttagattgtaaatattgcttttacttggaaaaacctcacttaaatcaacgggctatgactaatgaagtattagaagcctatatcaaatcctatattgaagcaacgcctcaacaacaagttactttcctatggcaaggcggcgagccaaccctagcaggtcttgatttctacaaaagagcggtcaatttttaattaatatttttgatgaatggtatgccaatgatgtcggcaaaattggtattcaatttattgaacaatggtttatggcttaccttggtttacaaccaagtttatgtatttttcgtgaaacctgcggcgatcaattggttattgaacaaaatggcgatatttatagttgcgatcattatgtttatcctgaatataaactcggaaatcttattgaaacccctctaatacagctccttgataataatactaaacaaaagaattttggtgcagcgaaatcttttctttccgaacagtgtaaaatctgtaagtttcgctttgcatgtcacggaggatgtccaaaacatcgtacaattcaaggatttggtaaaacacataatcaactttgtgaggcatattattcagcactttctcatatggatccatatttaaagtcatttgcaaaatcatttggcaaaataaaataatatttatctagttcaaaattttgttaaacacttcacattttcataatttgcttatagaagaaaaatatagaaatttgtatagtaatctaaagttattgatatattaaaagacgcctttatgtttacattgtcctattatctaccacaaaacttaaataaatgtattatatctgagagtaaaactctagaaaaaaacagcttaatttatgcacaaggcgagaagcactaaagaattttatttataa

SEQ ID NO: 489 - DNA, 4831 bp, H. influenzae
  misc_feature (4818)..(4818): n is a, c, g, or t
actttatgaagcattctttgcggatcaagataaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcttttaacttaggtaaaattgaaaacttagatgaattagaagaacttgcggatcttgcagtgcgttcacttgatgccttattagactatcaagattaccctgttgtggcagcaaaacgtagctcacttgcacgccgttcactcggtattggggtcattaactatgcgtattaccttgcgaaaaatggtgttcgctattctgatggttcagccaacgatttaacacaccgcacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccgcgtggacacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttatacgcccctattgtcttccccaacttatggggaagatagcacgacataacgaattaggatactttcctcagtctttgatagtctcccctgataaacagggaaagctaaataaatgataagttctatttaaaggataaataaaatggcatacactactttttcccaaaataaaaacgatcaattaaaagaaccgatgttctttggtcaaaacggttatgttgcgcgttacgatcaacaaaatacgagacttttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggtcgtagcccgaacgtggcattattgcctttagtgtcgattcctgaattagaaacttggattgaaacttggacattctctgaaaccatccactctcgctcttacacacatattattcgtaatattgtgaacgatccttctatcgtatttgatgacatcgtaactaacgaagaaatcatcaaacgtgcacaagatatttcatcttactacgatgatttaatccgtgatagccaactttatggcttatacggcgaaggcacttataccgtagatggcaaagaatgcgtcgtaactttacgtagtttgaaaaaacaactttacctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtaggtcaaattgactcaaaagttgatacgaatgattttgacgatttttctctctaattaaaaacacataaaaaactaaccgcactttggaatattctttttaaatatttaaagtgcggttaattttttattcattttaaaaggctttctaacacagaaagccttttatttcttagatttctaataacaatcttgttggatcttccaataattctttaatcgttaccaagaaaccaacagattcacggccgtcaattaaacgatgatcgtaagataaagcaaggtacatcataggatgaatcacaacttgaccattaagcgcaatcgggcgttctttaatagcgtgcattcctaaaatcgcactttgtggtggattgataattggagtggacataagagaaccgaacacgccaccatttgtaatagtaaaattgccgccagtaagatcttctactgttaatttgccatcacgacctttttcagctaatgctttaatttgtttttcgatctctgccatactgagcttatcgcaatcacgaagcactggtgtgactaatccacgtggtgttgaaactgcaatactaatatcaaaatagttatggtaaacaacatcatccccatcaatagaagcattcacttcaggataacgttttaatgcttccacaaccgctttaatataaaaagacataaagcctaaacggacaccatactgtttttcaaatttttcgccgtaggttttacgcaaagtcattatcggctgcatatccacttcattgaaagtagtaagcattgctgtactatttttggcttcaagtaaacgttcagcaatacgtttacgcaaacgggtcattggcacacgtttttcagaacgtgcgctataagccaccgtactaattgtattttgctcagtggcagcttcttgtttcacttgctgtgcttgtcgttttgcaatttcacgttcaatatcttcacgtgttaaacgaccacccacacccgaaccttgaatttgatctgcttgtaaatcatgttctgctaataaacgacgaattgcagggctctgatccgcattatgattatgactattttcaatcgctgcattttgacgatcagatggtgtgggttcattcgttgcttttaacgtcgctgaactgacatctccttcttgagccgtagaaattttgcctagcaactgtttactcaccactgtttcgccctcagcttgaacaacttcagccagtacaccatcagaaagtgcgggaacttctagcacgactttatccgtttcaatttccacaataacctcatcacgtttcacagtatcgcccagttttttatgccaagtggcaacagttgcatctgcaactgattcaggtaggtctggaacaagaatttcgattgtcattttatttttccttttcttcttttttactatatcttaattatcttggctcccctatttacagaggaaagcaaagataaaaacctttattaaattaaccgcactttaaaaactcaacgcatcttccactaactgtttttgctgtttagtgtgaagcgacatataacccacagcaggcgaagcagaagctggacgccctgcatatttgagtttaacggattctggaattgctgattcaaaattatgtttgctgcaataccaagccccttggttaagtggttcttcttggcaccatacataatccgtgacatgcgcataaggctcaagcgctttcttcacatcctcatgcgggaatggataaagctgctcaatacgaataatcgctacatctttctgattatttgcacgacgttgttcaagtacatcgtaataaactttacctgaacacattaccacacgttttacatctttaggatcaagctcatcaatttctccgattaccgtttggaaagttccattaatcaactcgtctaaactggacactgccaatggatgacgtagtaaagattttggggaaatggcaatcaatggacggcgcattttacgtaaagactggcggcgcaacatatggtacacctgtgcaggtgttgatggcacgcaaacttgcatattttgttctgcgcaaagttgcaaataacgttcaagacgtgcggaagaatgttcagggccttgtccctcatagccatgaggcaataacataactaaaccacacattctgccccatttttgttcgccagagctaataaattggtcgataacaatttgcgcaccattagcaaaatcgccaaattgcgcttcccaaatggttaaagtttttggatctgttgttgcgtagccatattcaaaagcaagaacagattcttcagaaagtaccgaatcccatacttcaaaacgaccttgattggcgtgtaaatgtgttaatggtacataccccgtaccatcttttgatgggtaccgagtcngatattcgataac

SEQ ID NO: 490 - DNA, 5729 bp, H. influenzae
  misc_feature (5680)..(5680): n is a, c, g, or t
cgggtctcgggtaccccaagtatcccaattaaaatctcaattaattgttcaagttggaaatcagattctgtggtgattttaatcgtttcatttttttcatttaattcaattaccgcttcgacaccacgaaaatcataacgcgtgctaagcacacggtttgcattttccactgcattacgaacttcgtgtaaagtaatttcagaaacaatatcaaaagatggcatagtcttctcccattttattaaattcgatcattggcacttagaaggcataaaagtgcggttaagtcggcgaagtttaccacaatttgcgcttgttgttgcactttaggtttagcatggaacgcaacacctagtcccgccacattcatcattgccaagtcatttgcaccgtcgccgatagcaatagaatgttgggaataaataccgtattcctctaacaaatgttgcaatgttttagctttatattgggcatcaaccacatcgcctttaactaagcctgtgagttttccatcttcaatatcaaattgatttgatgcagcaaaatcaagttgcaataaggctttcaaataatccgcaaaataagtaaatccgcctgaagcaattgcagttttccagccatatttttgtaaggtttggatcgtttcaactaatccagacattagcggtaaattctctctaacttgctgcaaaatgctttctggcgcaccttttaatgtacccactcgacaacgcaaactttgctcgaaatctaattcccccctcattgcactttccgtaatcgcagaaacaagttcgccaacacccgctagtttcgcaatttcatcaatacactcaatttgaatagcggtagaatccatatccatcaccaacaaccctgcttgagacaatttagggctgaaatctaatttagcaatatccacttcaacatcgtgagcaaatttaatgaaatcagaaaaccattgacctttcaataagacgataatatttttcgctaccatccaaacatcaaaaatctgaaaattttgaccgcacttttgttgaaatttttctagcttagttatgtccaactttgtgccgtataagataaaaggctctccgttctgtataggctcctcattagccaaaagtgcggtaggaaattgtggatatttttgtgtaatactttcgaaacattgaatttgcataaaaatcctgtaagttgtggcgactaaaaagattttaaccgatgtgaattgaaaaagtgaaaataattaaagaaaaactactcaatgatacttgcaacgattatttcgctaagcctagcgatatttggcgttatcttatttggtgtaaaacaagtattttttaagtcattatcgctgttcttatcataaactcaaagagaaaaaagtgcggtaaatttgacaataaaatctagtagtatgcgttttcatcaatgtcgtcgtagaatttgattattgtcacaaactattaaattgagtgcggatttttgctaaatttccttcagaaataaggtagaatgcgcaagattatttttcaaaacgaattatcacaggagaacaaaatggcaactcgtagacaattagccaatgcaattcgtgtcttagcaatggattctgtacaaaaagcgaaatctggtcaccctggtgcaccaatggggatggcggatattgctgaagtattatggcgcgactttttaaaacacaatccaaccaatcctaaatgggctgatcgtgaccgttttgtgctttcaaatggacacggttctatgttgatttatagtcttttacatttaactggctatgatctttctatcgaagatttaaaacaattccgtcaattacattctaaaaccccaggtcacccagaatatggttatgcacctggtgttgaaaccacgactggcccgttaggtcaaggtatcactaatgcggtgggtatggcaattgctgagaaaaccttagctggacaatttaaccgtgaaggccatgaaattgtcgatcaccacacttatgtgttcttaggcgatggctgtttaatggaagggatttctcacgaggcttgctctttagcaggaacattaggtctgggtaaactaatcgcattctacgatgacaacaatatttccattgatggtcatgttgatggctggttcagtgatgacaccgccgagcgttttgaagcttatggctggcaagtaatccgtaatgtaaatggtcacaatgcagagcaaattcgcgctgctgccgttcttgctcaagcagaaaaagaaaaaccaacgttaattatttgtaaaaccatcattggttttggttctccaaataaatcaggttctcatgattgccacggtgcgccattaggcgatgaagaaatcgctttaacccgcaaagcacttggttgggaatatgcgccatttgaaattccagctgaatactatgctgaatggtcggcaaaagagaaaggtgctgcagcagaaaaatcttgggaagaaaaatttgccgcttatgcaaaagcctatcctgaattggcagcagaatttaaacgtcgtgtttctggcgaattaccaacaaactgggcggcagaatctaaagcgttcatcgaaaaatttcaagcaattccagcgagtattgcaagccgtaaagcatcacaaaatgccattgaagcctatgcacacctattgccagaatttttaggtggttctgcagacttagcaagctccaacttaaccttatggagtggttcaaaaccgattcgtgcccacgaaaacgtaagtggtaactacattaactacggtgttcgtgaatttggtatgtctgccattatgaacggcattgccttacacggcggtttcattccttacggcgcaaccttcttaatgttctacgagtatgctcacaacgcagtacgtatggcagcattaatgaaacaacgcacattattcgtttatacccacgattccatcggtttaggcgaagatggacctacacaccaaccagtagaacaaacggcttcactacgcttaattccaaaccttgaaacatggcgtccatgtgaccaagttgaatcagccatcgcatggcaacaagcggttgaacgtcaagatggcccaagtgcgttaattttcactcgtcaaaatcttgctcaaatgaaccgcacttctgcacaattagatgcggttaaacgtggtgcttatgtattaaaagactgtgatggcacacctgagttaattttcattgcgacaggttctgaagtggaattagcagtgcaagcagccgaagcattaagtgctgaaggtaaaaaagtacgcgttgtttctatgccaagtactaaccgtttcgataaacaagacgaagcataccgtgaaagtgtattacctgcagcggtaaccaaacgtgttgcgattgaagcgggtattgctgacttctggtataaatacgttggattcaatggtcgtgttgtcggtatgaatagctttggcgaatccgcaccagcagatcaattatttaaactctttggtttcactgttgaaaacgtggtagcaaaagcgaaagaaattctttaagattaaactaaactagctccttgatattcaaggagcttttttattggctattgaaaattattgtgagatatgaaataaagaaaggaatagatttatacttaatttctcagctttctaacgcaaactacaactttttattttctgcagtttctggctctaaatctaattttgccatcaataactgatcgccatcttcttctggattatctgtaacaagtaatttatcgccatagaaaatcgaatttgcccccgccataaaacacatcgcttgcatttcttcagtcataccactacgacctgcagaaaggcgaacataactttttggcatagtaatacgtgcaacagcaatcgttcgcacaaactccgtccaatctaattcttccgcatcggctaacggtgtaccttcaaccttaacgagttgattaatcggcactgactcaggttgcggatcaagatttgcaaggctcgcgattaatccagcccgttctttacgggtttcattcatccccacaatgccaccacaacacacttttaatccagctttgcgcacttttcctaaggtactaagacgatcatcaaaacggcgagtaccaatcacttctgcataatgttctggtgcggtatcaagattatgattgtaataatctaatccagcttcttttaaatcttccgccataccgtcttgcaataaaccaaaggtaccgcaagtttctaaaccaagtgatttcacggctttaataatttctgtgactttctcaatatcttttggcttagggcctcgccaagcagcccccatacagaaacgtcccgcaccacgtgctttcgcaatttttgctttagcgacgatctcatcaacatctaataactgctgattttgtacgccagtatgataacgggctgattgagggcaataactacaatcttctgggcatccccccgttttgatagacattaacgtggataactgaatcgcgcgaggattaaaatgcttacgatgaacttgcgttgctcggtaaactaattccaaaaatggcgtttcaaataacgcctcaactttgcaaacagaccaatattctacacttggatgaggtgtaatagagttaatttgtaatttttccgctaacatgtttttcctttgaaagtgcggttaaaaacaccacgctttttatactttcttaattgatgaattagtgtatatggtagaaacaatcaattcaacgttatgaatgaaactaattttacacccctttttgcaattgacttatctgaccattttccaccactaacacttgatctatcgaaccgattaattccgatggttggtgggtaacaagtagcaatgttaaatctttctcgtcacaaagtttagcgattaaagccagcatttctacccgaagtttctgatctaatgcagaaaaaggctcatctaataacaaaattggcttatctcgcaacaaacaacgcgccaatgccactcgttgtttttgcccccccgaaagagaattcggtaaacgctctaaataatcgcccaatcctacggagcaagcggcctgttcaattttttcctgctcaagtgcggttaattttaaagagggttttattcctaaggcaagattttgttgtacagtcaaatggggaaataagttattttcttgaaatagcatggaaacaggacgctcgtaaggcgcactacgcgtatgatttttatcgtttaaccaaatttctccttgagcaggaaattcaaacccagcaattaaattcaataaggtacttttccccgccccactttcgccaataattgcgacacgttcgccagccttaacgttcaaattaaagcacattggtaaggttttatcattcaaaatcacattatttagataaatcatcagcatccctatatgtgtgaataaaggcaaacaatatgccacaaagcaataataaaatccctgcggttacagcggcatcttgattacgataattacctaactgctgatataacaaatgcggtaaagaagtaaactcttgattgccaaataacgcaatagccgtaaaatcgccgagagataacgccaaacctaaagcaaaagcataacgcaacggtgcgcgcaaggttttnccactcaatcagataaaaacgtgccgggtaccgagtcgatatcgtaagc

SEQ ID NO: 491 - DNA, 4017 bp, H. influenzae
  misc_feature (2502)..(2502): n is a, c, g, or t
gagaccccattttatcccgccagtgggtgtaattcgtaaggaaagcttgattttaaatcttcctggtcagcctaaagcgattaaagaaaccttggaaggcgtgaaagataaagagggaaatgtgcttgtaaaaggcatttttagcgcagtgccttattgtttgcaactgattaacggcttatatattgataccaagcctgaaatcatcgaaagtttccgtcctaaatccgcaagacgcgaaaatctggagaaatagcatgaaaaaaatcgaagcaatgattaaaccctttaaattagacgatgtgcgagaaagtctttcagatattggtatttcaggtatgacaatcacggaagtacgcggatttggtcgccaaaaaggtcatacagaactttatcgtggtgcggaatatatggtggattttctgccgaaagtgaaattggaagtagtggttcctgatgaacttgtggatcaatgtattgaagcgattgttgaaacggcacaaacaggcaaaatcggtgacggcaaaatttttgtttatcacgttgagcgagcgatccgcattcgcacgggcgaagaaaacgaggatgcgatttagtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgtgtgagtgatttaactggattgttgcaacgtttcaatctgcctttcacgctttcgcgtgaaaccatccaagaaaattttgacccaagcatcattatgaattttgtaagccgagtattgctgaatttctctggtgtagtgagtaatgtgtttgttttagtgttggttgtgatttttatgcttgccgaagcaccaacgatgaaacataaatttgcaatggtaattagttcaacccctcatgatgcagccaaagaagaacgccatattgatcgcgttttgcaaggcgtaattggttatcttggcatcaaaagcatcacgagtttactgactggcgtcggagtgtttattttgttggaagcctgtggggttcaatatgccattttgtgggcaaccttgagtttcttgctgaattatattcccaatataggttctatcatcgcggctattccgattattgtgcaagccttattactgaatggttttggcattggctttggcgtagcaatcggtgttattgcgattaatatggttgtcggtaacattattgaacctaaaatgatggggcaacgattagggctttcaaccttagtggtgttcctttcattattgttttggggatggctgcttggaacagtgggaatgctactgtctgttcctttgacgatggcattaaaaattgccttggagtccagtcccaatacagcgaaatatgcctgtctattaggagatgtcgaagatttcaaatagattttagagataaaagtgcggtgaattttcaccgcatttttttatgataagtcttgcggatcgacgtccaaaattaaccgcactaggctgtttttttcaagttcggcttgttgatattctcttaatgctttttgcaacgtcattcttgacggatgttgcaataataactgccagcgatattgccccgcttttttgctgaacggtgcaggcattgggccaagcatttgtaatcccgtaatttgcttcgattgaaaaaaatctgcaatttggcttaagcaattttctgcaagatcagaatgtcgagcctgtgctttgaataacgcctgaaaagtaaaaggcggcaatcccattgaatggcgtaattgtaaggtttcttttgcaaaagcttggtagccatttgccaataaagtggtaagcaaaggatgatcaggataatgtgtttgtagcacaacttcaccttgtttatcggcacgtcctgcacgtccagcaacttgaatataaagttgagctaaacgttcttctgcacgaaaatccagtgaaaataatgcactatctacattcactaaggcaacgagagtaacattcggaaaatgatgtcctttcgcgagcatttgtgtgccaatcaaaatttggcttttgccttgttgaatatcttctaaataaccttccaattttcctttacgtgccgtgctatcgcggtcgattcgcgctacagaataatgaggaaatagcggtctcaaggtttcttctaaatgttctgtgcctagaccagtagtaactaaatgggtagagccgcaaatcgccacattggcgaggaatagttctttgtgcgccacaataatgacaacgccaatacattntgatgctgatgataggtataaggtttttcacaatgagggcattgtgcgatccaaccacattcatggcaaagcaatacgggtgcaaagcctcgtcgatttaagaaaagcaacacttgattgcctttttcgagatgggctttcattcgttccaacaagggttttgataacccgttttgtatattttgatttttcaaatcaataacgaaatgacgaagtgcggtagaatttcccgctctttttgataaaactaaatgttggtatttgccgttttgtacattattaatactttctaaacttggcgtggcggagcccattaataccgcaatatttagtttttgagccagcacaatcgccaagtctcgcgcatggtaacgccaactgtcttgttgtttgtaagacgaatcgtgttcctcgtccaaaataattgcaccaagattagaaaattgcgtgaacaatgccgatctcgtgccaatcacaatggcactttgtccagagcgggcgcgatcccatacataaagccgttgcgtatcggttaaattagaatgcagtacatcaatttctacattaaaacgtgctttaaaacgttgcaccgtttgaggtgttagcccgatttcgggtacaagcactaatacttgcttacccgattttaaaatttcttcaatatactgcagataaatttctgttttacctgaaccagtcacgccatcgagcagccatacattgaaaccagaatggaagagcagttggctgaaggctaaggcttgctgcttatttaaggttaaacgattttcagcattgactattgggttattgcctaatctttgttgccagcttaggggatttgtttggatagtaatttcttcaataaaccctttggcttttaaggcagaccaaatggcagaggaaaaattattattgcctttttcaagatcagtttcagataagcattgtagggcttcagcttgctttttcgagcgttttaattcgccttgttcaagggcatttttccccgcatccgtaattcgccaaaaagtgcggtcattttttaccgcactttcgccgttacgcaatttcacaggcaaggcttgaaataacacatcgcctaatcccgcttgataataatttgctgcccagtgaagccaatcccaataaatgggcgtaaaaagtggggctaaatccaatggttgaagaatagccttgagtttatcctctggcacgtccgattttgtcggaaaatcagccacaatggcgacacgtttttgagtgccaaaaggcacaagaacacgcataccgatttgtaatgaaacatcatcggggacgaaataatcaaataagcgaggaagcggcacagccagtgccactcggacaattttcataatcaaccttgggaaaaaatttgccctattatacgagaaaaattggtataatcgccgccaattttttcacgaacaagatttttatgacacaaactttgccgatcaaaaacgggtaccgagtctgatattcgtataacag

SEQ ID NO: 492 - DNA, 5436 bp, H. influenzae
  misc_feature (101)..(101): n is a, c, g, or t
  misc_feature (5156)..(5156): n is a, c, g, or t
  misc_feature (5265)..(5265): n is a, c, g, or t
  misc_feature (5294)..(5294): n is a, c, g, or t
  misc_feature (5391)..(5392): n is a, c, g, or t
taataatacgggtaattcatcagcaggaatatcagtaaattctggaatatattgatgccctccccatacgtaattttggagtgagcctgtaagttataaantcattatttatttctattttaactagcgtaaccgtgggtaagtatacccacggctagttatagtcgttcctctttgaggaatctcacactaccccaacggggtagccttaaaattagcctaggatatacctaccctaggcaatttgtcttcccctagattatttatttaaccgcaggtaagtatacccacggttagttatagtagctcctctttgaggaatctcacactaccccaacggggtagtattgagattaacctagggtatacctaccctaggcaatttgtcttcccctagattatttatttaaccgcaggtaactataataaataaaaaatccgcacaaaggcggacttttttttatcgtaaacaaattatttctttaaggctaatactactgattctccagccactacttcgcctgatttttttacgatacaagaaatttcatccatatttgaaattacgattggtgttaagacagattttgcttttgattctaataaaggaagatcaaattcaatcacggtatcaccacgcttaatagattgaccttcttgtgcaatacgagtaaagccttcgcctttcaactcaacagtatcaataccaaagtgtacaaataattctacgccttcttttgattccattggaaaaagcgtgattggtttcaaaaattttaccaatcacaccatccactggcgcaacgattttgttaccaataggacgaacagcaataccatcgccaacgattttttcagagaaaaccacatcaggaacatcttcaatattaacgatctcgccagagatcggtgcataaatttcaacttccacagatttgttttcttttgaaccaaataacttgtcaaataagcccattttaatctcctatccattcaagatggatgctattttaacgtaaaatcaaatacttttgtttaatttaatgaattttccagcaaaaattcttcaattaattgatcaatttctgcagcggtcggtttttgtaatgcggcatcagcaagcgcttttgcatcttggaaatttacattacggattaattttttaatgcgaggtacagaaatcgcactcatgctaaattcatctaatcccataccaagtaacaataaagtcgcgcgttcatcccctgctaattccccacacattcccgtccattttccttctgtgtgagaggcatcaatcacttgtttaattaaaccaagcacagaagggtgcattggattataaagatgggaaataaactcattaccgcgatctacagccaaagtatattgagttaaatcattagttccgatactaaagaaatctacttcttttgctaaaaattttgcatttaccgccgcagagggagtttcaaccatgacacccacttgtatgttattatcaaaaactctcccttcttcacgtaattccgcctttaatgtttcaataaccgcttttaattctcgaatttcttctaccgaaataatcatcgggaacatcactgccaatttaccaaaagctgaagcacgcaataccgcacgtaattgtgcatttaaaatttcacgacgatctaacgcaatgcgaattgcacgccatcccaagaatggattcatttcttttggtaaatctaaatatgaaagctctttatcgccgccaatatccatcgtacgaagcacagttaagcgtccgttcattgcttctaccacttgtttataggcaataaattgttcttcttctgtgggaagctgttcacgatccataaataaaaattcagttcggtatagcccaatcccttccgctccattacgttctgcgccgtcacaatcacgaatcgtcccgatattcgcgacgatatcaaccttatgtccatccaatgtaatagctggaagatcttttaatttagctaactctgctttttcctcagaaattttcgcttcaagtgcttttaattcatcaatttgagatgccgttggattaatataaacttgattatttatcgcatctaaaattaagtaatcgcccgtattgactaatttagtcactttatttgtgccgacaatcgctggcaattctaaagaacgtgccataatcgaagtatgggaagttctgccaccaatatcagtgacaacccctaatactttttcgagattaagttgggcggtttctgagggagtcagatcataagcaacaagaatagattcttcctgaatatcgccaagatcaacaatgtgcatgcccaaaatatttttaactaaacggttagcaatatcccgaatatcgcctgcacgttctttcaaatattcatcatcaatttcagataacattgtcacttgttgatctaaaattttactcgctgcaacccctgcattcactttatttgaacgaagataatcaagaatttcttcttctaattcttcatcctcaagaatcatcaagtgaccttcaaagattgcggctttttcctcgcctaaagaaattaatgcacgttctctaattgaattaagttgttctaccgccgcagcacgcccttcataaaatcgagcaacttcttcatcaatttgatcatctgtaattttttgcgtatcaagaacaatcttttcttctttaagaacaagtgccttaccaaaggcaatacctggggatgcgagaatgccagaaatcatagataccttccgaaacaattaacaaagtaataaataaacaatagccataaaatttcacaattttatggctaagtaagaattattctaaagtaggaattaacgcaactaaatgttcaactgcctgttgctcgtcttctccatcagcagaaatggtaagtattgttccctgcgttaaaactaatgtttgcaacttaaataagctctttgcacttgcacttttcccccctgaggttactgtaatttcagaagaaaatgctttcgcttctttcacaaattgtgcagcagggcgcgtgtgtaaaccgtttggtgcaataatttccacatcttttgaatacataatgctacctcgactaatcaataattaaaaatataaaaccagaaaattgccctagtatcctttttcaaaacaaaataatcaagaataaacactaaaaagcctgaattaaatcataaaaataagctaaatagtttatttattattcacaatctcaatcgttaaactaatgaaaaatgacgttgtgattttgtttcacttaaactttcaattaatcgatgatagctatcataacgaacaggcgaaattttgccttgctcaacggcttcacgcaacgcacatccggggtcgctcaaatgtttacaatcacggaatttacaggtgcccaaaacatattgaaattctcgatagccttttgtgatttgctctgcatctaaatgccaaaggccaaattctctaattccgggcgaatcaattaaattaccgccttgtggcaaatggtaaagacgtgacgatgtcgtggtatgctgccctaagcctgatgtttcgctcacatcccctacttgagcgtttacgctaggcaaaatatgattaattaaactcgatttaccaacaccagattgcccaacaaaaatcgccgtgccttgtgccaaaagtgcggtcaatttttccatattttcaccgctctttgctgaaatcattaaaatttcatagccaatatcttggtaaattttaagttggtcttcaatttcttgacgctgttcttgtgccaataaatccactttattcaaaacaatgagaggcgtgattcccgcaatttcacacacaacaagataacgatcgataatatttaaggaaagcgttggcaacaccgctgatacaataataatacgatcaatattcgccgcaataggtttcaaaccatcataataatcagggcgggaaatttcattttctcggggatggatcgcctcaatcacgccactcacaccttgtaattgttcattgcctttacgccaaacaactttatctcccaccaccaaactcgacaaggtacgacgcaaattacaacgataaatttcgccttgttcattttcgacatctgcgtgaatagaataacgtgtgaccacaacgccttcttgtgattcgccaagcatttcatctgaccattcaatgtcttttttcttatggcgatgtaatgttttcgcattattcgattgaattcttctagtttggttttgagttaatttacgtttagccataaaagtgcggtcgttttttcccttgtttttggtaaaatgaaaaaaatttttgcataggatacctgatattatgccattcgataaacaaaatcttatttggattgatttagaaatgaccggtttagatccggaaaaagaacgtattattgaaattgcgactattgtgacagataaaaatttaaatattttggcagagggcccagtattagcggttcatcagtctgatgaattactcaataaaatgaatgattggtgccaaaaaacgcatagtgaaaacggcttaattgaacgcgtaaaagccagcaaacttaccgaacgagcagcagaattacaaaccttagactttttaaaaaagtgggttcccaaaggtgcatcgccaatttgcggtaacagcattgcccaagataaacgcttcttagtgaaatatatgccagatttagccgattattttcattatcgccatttagacgtgagcacattaaaagaacttgctgcacgttggaaacctgaaattttagaaggctttaaaaaagagaatacgcatttagcgctagatgacattcgagaatccattaaagagctggcttattatcgcgaacacttcatgaaattagattgacgaaaacttcaacaaaaaatttctttttatgaaattgcccttgcaagccctaaaaatatttgtataattcgggctcattcactgatgtgaactgcgggaatagctcagttggtagagcacaaccttgccaaggttggggtcgcgagttcgagcctcgtttcccgctccaatttcacattataaaagcattattgcgggaatagctcagttggtagagcacgaccttgccaaggtcggngtcgcgagttcgagcctcgtttcccgctccaaatttcaatccttagccaaaagctgggggattttttctatctacaaaaatagatcatcaaaatgttaaaaagtgcggntgaattttctcaaaaaataaaggcttgtngatttaataacacaagcccttatttttatgctttcttcaaccgtttggcacgacgtttcattcttcttaccccaacgggtattcgccatgcatgcgnntattgatagacataagggaaaataaatgaaaagccaacaacatc

SEQ ID NO: 493 - DNA, 4282 bp, H. influenzae
gccaaacaaggcgccatagcgcatctccggcatgcgtgagcacaaagaatctgatttagatttagctcgaatttaaggccgccacttgtggatgcagattatcaaagaagctattacttatagctttgtggatccaaaaattcaaagtttattacatccacataaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtaatagagttcgttttgttgcaaaacaatttgatgcattacaccctggccaatctgctgctattgaattagatggtcaagaaattggttttattggtgcaattcatccatctattagtcaaaaacttggcttaaatggcaaaacgtttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaatatggctacgataactaaacttgatattattgaatatttaagcgataaatatcacttatctaaacaagatacgaaaaatgtggtggagaactttttggaagagatccgcttatcgctagaatctggtcaagatgtgaaattatcaggatttggtaatttttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatagtaagcaacaaaaagtgcggtgaatttctaccgcactttttatatgaaaaggtatgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacccttattggtcgaaagccttctggcaagtcagacggatttaaaaagtataatgctggaattttccagcattttttataatgatttttttcaaattagggagataaaaatgccctcaaacttaaccgcacttcaaattcaacttgaaattttacgccttattccaaaaactcgttttattaccgcagaagaaatcttacaaaaacttgctgatattggtgttcaacgtgatattcgttcaatccaacgcctgctagaaagtttgtctcaacagtttgaaattgagcgagatatgcgtgataaaccttatggatatcgatggaaatcaaatgctaaaggcttggatttaccgattttaaatgaacagcaatcacttgtgcttatgcttgctaaacaatatctcaatggcattttgccttctagcattatgaactcaatggaggcgttctttcaacaggccgaatataatttggtttatgacagccataaaaaatcaggggcagaatggcttaataaagttgctattgcaccaactagtcagccgttattacctgccaaaatcaatccagaaattttttctcaaattagtaccgcactttatcaaaatcgatttttacaggtgcattatcggagtattcacggtaaagaacataaggcacaggtcaagccattggctttggttcaacaaggaccaagtagctatttagtcgcacaatatgagaatggcgatattttacaccttgctttgcatcgcttgcttaaggtaacagtgagtacaatgatatttgaacgccctgattttaatttgaaatcttatgtagaaagccaaaagtttggttttacctatggtcgaaaaattcgattaactttccgcattaataaagatattggtggatttttaacagaaacaccattatcaatggatcaaacagtaaaagattgtggcactgaatatgaaatttccgctaccgtgattaagagcgctatgctggaatggtggatagcccattttggtgaagattaccaagaaattgaccgcacttatttagacgaaaatgcctaacgacataaattgtcgcttcatcttttatcattaagccatcaacagagagggcattaaaatgaagaaaattgtttatattgatatggataatgtgatggtagattttccatcaggtattgcaaaactagatgataaaaccaagcgagaatatgaaggtcgatatgatgaagtcgagggcatttttagcttaatggaacctatgccgaatgcgatttctgcggtgcataaattgatgaaaaaatatcatatttatgtgctttctactgcgccttggcataatccttctgcttggagtgataaagtaaaatggattcaacattatttcggtgaagaaaaaggttcagccttatataaacgattgattttatcccatcataaaaatctcaaccaaggtgattatttaattgatgatcgcactaaaaatggtgctggcaaatttcaaggcgagcatgttcattttggtacagaacagtttgctaataaaaggagcctgaaaaatgacagagaaaaataaaccaatttgcgtggtattaacgggagctggcattagtgccgaaagtggaattccaacttttagatcggaagatggtttgtgggcagggcataaagtagaagaagtttgtacgcccgaagccttgcaaaagaaccgtgcgaaagtgcttgatttctataaccaacgccgtaaaaatgcggcagcagctaagccaaacgctgcgcatctcgccttagttgaactagaaaaagcctatgatgtgagaatcatcacgcaaaatgtggatgatttacatgaacgtgccggcagctcgaaggtgttgcatttacacggtgaattaaataaagctcgcagtagctttgatgaaagttatattgtggattgttttggtgatcagaaattagaagataaagatccaaatggacacccaatgcgcccttacatcgtcttttttggtgaaatggtgccgatgctagaacgagcggttgatattgtggaacaagcagatgttgtgttagtgattggcacttctttacaagtgtatccagccaatggcttagtcaatgaagccccaagaaaagcgccaatttatctgattgatcctaacccaaatacaggatttgttcgtaagcaagttattgcaatcaaagaaaaagcaggcgagggtgtgccaaaagtggtggcagagttattagagaacaccaaaaactcatagaaaaatgaccgcactttttaaacaaatagcgacttcggtcgctatttatcattttttctcttgcttaagcatatgcataataagcctaataagcgtttctttttgtttcggatcagattcagcaactaataaagtgagcgcggcaagcccagtatcattgataactgggtatccattatgatcaaacaaacgcccatttctatgtaagaatctacaaataaaaatgcgccgctacgtttattacctctgaaaaa

SEQ ID NO: 494 - DNA, 7106 bp, H. influenzae
  misc_feature (7056)..(7056): n is a, c, g, or t
  misc_feature (7071)..(7071): n is a, c, g, or t
atggtatacgaatatcagactcggtaccctttcttggtgccttcgccttttggtaattctgcatcaaaaatgaatttatcgccacgtttaagaaaatttaccgtctttaaaagtagaaacacgaattttaggaccttgtaaatcacctaagattgccacggttttacctaattttttcgcaatagaacgtacacgttcagcacgtccgatatggtcatcaggtgtaccgtgagagaagttcatacgaactacgtttgcgcccgctgcgataattttttcaagattgttatcacggtcagttgatgggcccatagtacatacaatcttcgttcttcttagtcttctagacattatttactccgtcaataattacaaaattttaaaggtgttattttacttcgctacatatattagccagataaaaaatcggtgcacattatacgcttaaaacttttggaaatcaaaaacggctcagttatttaagctggttttgtttacttttttgccagttatatcgggttttaagaaaaatacttgtgttcaagttaaaaatatctataatcacgactacttcacacagtgcgactatagctcagttggttagagcaccaccttgacatggtgggggtcactggttcgagtccagctagtcgcaccaaattttcttttcaatccctctcaatccatatcaaataaaattaaatttcctggtaaatcaaggcattatctgcttttataaagtcaatctatatcaatctatattaatctaactcacttttttggtattatatttggtaatataattttggatttttaggtgtcgtaataccaaaattcataaaaatactaaaaaatcacgcttaccaaaattattttcgtaataccaaatggggggaaggatggctgtattagtgaaaccattaagcattacagaaatcaataatgctaaacctaaagagaaagactactcactgtctgatggccaaggtcttttcttgctcgtaaaaatgaatggttcgaaaatttggcgatttcaatattataaaccaatttctaaaaaaagaactttaattagtcttggtgtttatcctgagatttcattgaaagatgctcgagagattagggatttatatcgttctttgttggcgaaaaatatcgatccgcaagattatcgtttacagcaagaacaaaaagccatccaagaacgtcaatttaccttgagcgaaatggggaaggaatggctatacctaaagaaaaatgaagttgatactgggcgattaaaagaagtgacttttattgatattgggaaacggttagaacgtcacttgtttaaagtgttggggcattattctattagtgagatttctgctcctcttgctattgagaaattaaaaccattagaacgagcaggaaaattggatacattgcatcgtattattggttatttaaaccaaataatgatttattcggttaatagaggggtaattaattataatgcaaccgcagatattggaagggtatttattcgaccaatagctgaaaataaccctactattcgcccagagcaattacctaaattgtttgaagatttgcagaatagtacccttgaaattgaaactcgttgtgcattagagctactactacttaccgcaggtcgggctggggctattactcaattagaatgggaaaatgtagatttcgaaaacagcttattgaatataccgaaagaaaaaatgaaggggcgacaaggtaaagtacaagattttatcttgccattatccaaacaagctgtaacgattttgcgcttgttacagaagttgaatcgttgcaatagtaagtttgttttccctagcaaaaaaaatccaagacagcctatatcgaaagagacgccaaataaagcacttggacggatcggttataggaatattttgaccgcacatggtttacgatctgtttttagcacagctatgaatgaggccgaatttaacagtgagattattgaggtgtgcttggcacattttgaatattcttccgttcgtggcacatacaataaagcaaagtatatgccacaacggatcgaatatatgcagtggtgggggaattttgtagaagaggcatctgatgggaaagcattaatgggctgttaagatgaatagcagcctgattcaattctttcaatgtaatcatttatttgtgcatcagtccaaaagttattcccaccgactagatgaggctttggaaaattggggtcgttttttatccttctgtaaattgttggtgcgctcatatctaataaagcagaaacagttttcaaattatgtaattttcttgtcgtagattccatatttcctccaataaaaaccgcccttatgggcggttataacggtttattttagttagcccacttcatctaacttattcatctttttgtaaagaggatagggcgatttaatgggttgtaaatgggttttaaaaatcgttcgggtcgtcgtcttcctctagctctatcacatcaagccgttgaataacttcaaatttagctaaaaaacgcagtctgttctcaaaatcaccatctctccatacatacataacttcgcgttccggttcttcaaacatatcccaggaataagcgttttctttcgcgatatgtaaagcgacattatcaaaacacctactttcatcttcccatgtatttccatcatcattgtttgtaggattgttactttccaatgcgtaacgatataaatatttagccataatttattcctccggtggttgtggtagcggttgccaataaataacctccacttcctcgccagggttttcatccgattcccaatacggaattaaacaaccttcacaatccgacttatcgtcatataaataccagccaagaccaacagcccaatgatcaccatcctcagtaaaataaattaggtgtttgttagttgcattacgatactctaagtcggtagaaaatggttctggtagttcgtttgcacaattaatccagccattattttcactcatttttcccctccaaaattgctttgcgttttgctttaataattggcgtaactacccgtttaatcgccagttgcaattcacctataaaggtctcatctttcatattgtcaaatgcaatacccatcaacttcgtcaaacacaccaccttcccagtctaatagcacgatatttccgcctaacacttgcgtattttttgatattttaagttgatcacgttggtagtcgtccatttcaacttcgattgttatgcggactttttgggttatttcattgctcatttcctactccttttcctttgtaacttggatattcagatctcaaaatccgataacaatttgtttttaactcaaaaatgcttctcggcagagcgttaataggcaatgttttacaggctctcccggtgtcgtccataccatacggcacaccgattgcgcgccaacatcgtgcggcatgtaccgctgcgtctttaaccacatccgagttaatcacaaagctattcggcccaatgcgttgcaacaaaacaccttgtgccataagctttttaacccgccgtctaaattgactttcgcttaatccagagccttcaataaggtgtcttacactcaatattgcaaagtcttctgctcttttctctgcatgatcatcgctatacgtgccaacactgccaccgatatacgttaccaaggtgtgttgtgcgatgcggtctaatgtttcatcccagatatactcaaggatatgttcgtctagcactttcatatcttccccaatctcattctcatccctgacaaccgctccgaacatttaatccattcgctcatatcacaccaccaatacatataatagccattctgtgaatcctttcatgcttactcctaatataaatcttctgagaacagaatatctgagtttggtgaaccagataaacgaattacttggttctgagctttagcaatttccattgcttctttacgacctacaaaacgacctttattagttagaaacccttgttcccaatctaaaagagcatacttgtattgtttttctaattctttaatctgcttacgcatgaatgggtcatagtgtcttaaaccatatacttcatggataatctcaccgccatcttcatttgtaccatctctttcatctacaaacacttggcaagcagagcatacaattctttcaggaatatctacatattctcttttttggtttaagagtttaataaattcattgaataatgtttgtctttcttcaggcgtttgttgtttgattaaattaataatatccatcacttactccatcatactcttcataaaatcaagccatttttgagcatcttcttttgtgcggaaacattgaccatttatcatcaagttagctgcacaatctgcataaaacgaaaaatatctaatcactccatcgcttaaatagaaaaactcatcgccaatatgtggtttaaacggcttaggtaaagtgcttgtgtcgaattttggatcaagtttttttacaaagaaccattccatggtcagattagcgagccatggttggatgatgccatcttccggctgcatcacaaactcgccgtttttagttttggcgataacttttagaggtaaatcaggattaccatcgcatagcactagcaaatcctcattacaagccttttccagcacttgttctgacgttagtttaggatcttcccacattccaatgatgtcatattccatggttgcccaatgtactgatttacctgttaagttccatgatgtcgtattaatgtaaataccatcaaatctatacccgattaacggatatacggtatctcttacctctagcttttcaacctcgttaagcaaattgtatttaacaacggcttttcctccatttctcaacatcacaggctcgccattcaaggctgcttttaagttaaattctttcattttctttctcctaaaacaaaaggcgctcacttggaacgcctattggatttatttgtttaaataattaatcattctttccccgatccacttaataaccggtacagccatactattgccgatagctttatagcgtgggctatccgggcaatcttcggctggtttatttcgatacgatatttgcgtataacctggaggaaaaccttgtaatttttcgcattctgaaggggtaagtttgcgaatgttttggttgatgctcatgcatggaatgttattcccacctgtccccattcttgcggtaagtgttggcgtagtgccgtccttttgtatgcgcacaacatcgcgtcgatctgaaatatcgaacaaaacattttcctgcccattattgcgccccaggcagtgggcagttgatgtggaaataatcgggtcttgcgtaccatgtactacaatagtttcagagccaccaccaagcgccccaccactagcttttactagcccccccaatacggattggcgatacgttccaaagcttccctcagcgtagcaggtaaaaccttgttgcgtttttccgcacgattgagaatacccttgcaagcttttgcgctcaaaaagtatttgggcgacgcttctttctctagcacttgccacaaggaacacgcgcttgcgtcgttgggcgagtccgaagtattgagcatcgaggattcgccacgcgatagttcgggacgaatgcacataaccagcgtttgaccatttagcccctgttggttgcagtggctcacgctcttgaaccaatccagccaaaaggtgtccgaatgcgttgtcttttgtggatagtacacccggaacgttttcccacaacaaaacgcacggctgcttaccgtcttggtatctaacataatcaatagcctctaatatgtgtattaaagttaacgtgagatttccgcgctcgtcatctaacgagtttcgcaaaccagcgacagaaaatgcttgacaaggagtaccaccaacaagcacatcaggcgcaggaatttcacggtttaagattttttcgggtaaggtggtcatatcaccaagatttgggatgttgggataatgataagcaagcacggcgcaaggaaaaggctcaatttcgctaaaccacagcggtttacttaagcctttccatgccacgcttaccgcttcaatccctgaacagattgaaccgtaggtaaacatagtgcggttattttttcctctgttttggattaatcacaggcaacacaggcacaatcggttttgctgttgtagctgttgttgatgggctactgcggttttcatttatccagtcaaatagttcctcccacgaatcgtagtcaagtttgtggaatgcgttatttcggtcgcttgcccagcgtttcagatgctcattaatatcgcgagtaattacctctcgagtattactgcttatcacgctccatttggttttaacattgtgaattgtttttgttttgttgtattgttgtggtggctctgttgtatccgccttgaccaaccctaccattttcgaccttttgcacggttacttccattatcatttctcttgttttgcgccgcatactgttttcacacccacttacagtgccatattgttccctccgctcttccctcgtctgacagctctcttcggttctcttccatccctcttgactctcgctttctcaggcccatctatttttccatgttttgcacccccatcttctcaatcactttattctcaattgttgatgaaccgctactcgtatcgagcacttatatcgtctttcgcctcatgctttcttctctccctcgaacttcctcccagacggcgactgtttctttcgccttttagcgtttttgtactgttctgatagagtgccaggtcgttttcgtgactttttccgctcctggttatccgctcctttcccccgctttgtgctcctcgtgtactgtcgtgtgcgccatgcctgactcttggcgccctctcctttagcttcctgtcttccgtatccttatacgtcctaacgtcctgattgcccgttcttcctacatacgtttcactttatttctctctccnccctccgatcttctntgctattgacgtcctggtcgctcgcgcgcgccccg

SEQ ID NO: 495 - DNA, 5007 bp, H. influenzae
  misc_feature (4834)..(4834): n is a, c, g, or t
tggtatcgaaattcggactcggtacccctcgtagtgctttcgccactatttgaatcgcttctccactactaattccttttgccataagttcttgaatttgctcaactgctttttgttgctgttcgtgtgttaagttaatatcaaacattttcccacccaaattgatttattaattgatgccattgttcatctaaacctgctgtaattgttatttgctctttcgttattggatgaataaaagacaaactattagaatgtaaaaataatcgagaacaacctaaatgtgacattaatgcacgattttgatgtaagtcaccatattgcgtatcccctaaaatcggatgaaaaatatgtttcatatggcgacgtaattggtgttttctacctgtatgagggattaatttaactaaagaataacgtgccgtttgataacgcccagcaggataaggcatttcgactatttttaatccttcataatcagtcactgcttcttgaggctctttatcttcttgagaaaatttatctgcgattttatccaattgaatttttagtggataatctatccgctcttttccctgtagataccctcgcactacagccaaataagatttctgaacgcacttttgttcaaactgttcacacattaaattcgcaatttcactgctcaatgcaaataacaacacgccagatgtcggtcgatctaaacgatgaataggaaatacgtgctgaccaatctgatctcgtaaagtttgcatcacaaattgagtttcgtgaggatctaaccaactgcgatgaaccaacataccatcaggcttattcaccgcaacgagaaactcatcttgatataaaatttctagcattggttattgttcagaagttcttctaaagcaactaaaggagttaatagttgttgtaactcatcaaattccttcattgcttcttcaatataaggagaaatagcaattttatgtggcaaggctgaaccactttctaataatgcctgcatgcgtggaataaatacccactgtagccactcttcggcagacatcgtatcaattgaaaaaggttcttcacttaaaaacgcctctgcagcagggggcatcgtttgccataaattaagctgctgcatggtaatttgaagctgttcaagatgctgtttagtttgattacgcatattttatatcctaattaatgaatgttttttgcaaatacacgcacatttgaaaaaccattttctttcaaatataaggcttgtaatttactcatcacaccacgttcacaatacaacacgtaatttttactttgatcaaggctaccaaattgagaagaaagtttgtagaacggcatttgaatgacgtcatgtgtacctgattcaaatggcttttcatccgtttcttctgggctacgaatatccaaaatcacttcattttcacctaatacagaaattgcctcgacttccacgacttctttttctgtttcttctgcaatctggcgaatatctaaatatttcgcattttgcaccgaactttcaagaatctcgaaattaaaatgcccttcttcttctagaatcttttcacgaaccgctttgatcgtaggattttttgaaatcacgccacaaaattcaggcatagattttgcaatatcgtcagtaccaatttctttcgccatcgcgataatttgttctttatcgtgcgtaattaacgggcgtaatactaaggcatcagcggcttcatcaatcaagcgtaaattggttaaagtttggctagaaacttgtcctaatgcctcccctgtcacaatcgcttcaatattgaaacgttgagcgactttacttgcggctcgcaccatcatccgttttaatacaacgcccatttgtccgttatcgactttctctaaaatctcaccgacaactccctcaaagttaatcgtaataaagcgtactttatgtgaagcactatagcgttgccaaatatgataagccatttgtttaacgccaatttcatgggctgcaccgccaagattaaagaaacaataatgaactcgggaaccacgacgaatcaacatataactcgatacgcctgaatcaaatcctcctgaaattaaagaaagcacatcttcttgcgtaccaatcggataaccgccaataccagcgtgacgtgttttaactaacatcattttgtcatcttcaatatcaatacgaacagtcacatctggattttttaaccgcacttttgcgctttcaatatgttgatttaatccaccgccgatataacgttctgcttcaatcgaactaaatttatgtttacccttacgttttactcgaacgcaaaaggttttgccttgaagttgttgcgcgacatccgcaagcgtcaattcaaaaatatgatgtaaatcggtaaacggtttttcttcaacttctaaaaaatgatgaataccaggaatacgttgtaacaaggcgattaattcttcacgattctcttcattttttgaccgcacttcaatgtaatcccagtgacgtacaactgcagtttcttcatcatatttctgtaaaatattgcggatattagaggttaaaatttttgcgaaacgtttacgcacagtttcgcttttaatcatgatttcaggaaaaagtttaacgataaatttcatataaatagcttaggtatttcttgggtatttaaagtggcgagtattttacgcaaagatagtgaaaagtccactggtcctagcttgaaataattttttaacaactcaaataaaatacagtacaatggcaaacaatttttaccgtgaaaaaggataattccatggcgcgtaaacccgcatcttcacaagattttgaaacaacgttagcgcagttagaaaatattgttacacatttagaaaatggcgatctaccgttagaagaagcgttaaaagaatttgaacaaggtgtgcaactcgctaagttagggcaagaacgtttacaacaagcagaacaacgtattcagatcttattgcaaaaaacagaagacgcgccactgaatgattataaagggaatgattatgaagggaatgcttaatgggtcacttttctgaagaattacaacaggttcaaactcgtatcaatcgctttttagaagctcaatttgagggcattgaaagtcataatgcacttttgcttgaggcgatgaaatacgcattattacttggcggtaagcgagttcgccctttcttagtttacgcaacaggtcaaatgcttggtgcagagaaacaaaccttagattacgctgctgctgccattgaagccattcacgcctattccttaattcacgatgatttacctgcaatggatgatgacaatctacgtcgtggacatcctacttgtcatatccaatttgatgaagctacagctattcttgcgggcgatgcgctgcaaagtttcgcatttgaaatattaaccaaaacaccgaatatttctgctgaacaaaaactggctttaattcaaattttagcgcaaggcgctggcgtacaaggaatgtgcttagggcaaagtttagatcttatttctgagcataaacagattagtttaagcgaattagaattaatccatcgtaacaaaacgggtgcattgctaattgccgcattaaaattaggtttcatttgttctccacattttaccgacaaaaggttagaacaatccttaacacaatatgcggaagccattggtttagcctttcaagttcaagatgatattttagatattgaaggcgatagtgcagaaattggcaaacaggtgggtgccgatcttgatttagataaaagtacatatccaaaattacttggattaagtggcgcaaaacaaaaagcgcaagatctatatcaaagtgctttgtctgaattagaaaaaattccttttgatacaaccgcacttcgtgcattagctgaattcgttattaccagaaaaagttaaacactcacaaaagtgcggtcaaaatttatcacgtttttaaaatgactaataatatgaacaattatcctcttttatctttaattaattctccagaagatttgcgtcttttaaataaagatcagctaccacaactctgtcaagaattacgtgcttatcttttagaatctgttagtcaaactagcggacatttagcgtcaggtttaggcactgttgagctaaccgttgcgctgcattatgtatataagacgccatttgatcagttaatttgggatgtgggacatcaagcttatccacataaaatcctaacgggtcgccgagagcaaatgtccacaattcgccaaaaagacggtattcatccttttccttggcgtgaagaaagtgaatttgatgtattaagtgttggtcactcctctacgtctattagtgcgggattaggcattgccgttgccgcagaacgagaaaatgcaggtagaaaaacagtatgcgtcatcggtgatggcgcaattactgcgggaatggcatttgaggcattaaatcacgcgggggcattgcatacagatatgttagttattttaaatgataacgaaatgtctatttcagaaaacgttggtgcattaaataatcatcttgcgcgtattttctctggctctctttactctacgcttcgtgatggcagtaaaaaaatccttgataaagttccgccaatcaaaaactttatgaaaaaaaccgaagaacatatgaaaggtgtaatgttttcgccagaaagtacattatttgaagaactcggttttaactatattggcccagtggatgggcataacattgatgaattagtggcaatgcttacgaatatgcgtaatctgaaaggccacaatttttgcatantaaaacgaaaaaaggtaaaggatacgcacccgcagaaaaagatcccgattggtttccacggtgtacctaaatttgatccaatcagtggcgaattgcccaaaacatagtaaaccactattcgaaaattttggcgattggctattgaaaggcagaaaagatgcaaattattgttt

SEQ ID NO: 496 - DNA, 4891 bp, H. influenzae
cggagagagaagaagagcggacgagaggaagcgaagggagggatataaaggggataatcaaagaaagacaaaaggaaaggaggaaagacgttaaaaaggggtaaaagaaggatggaaatgacagatttctggaagataaagagagttcataagaagaaaggcaaaagaaaatcaaccgcaaagagaaaagaagtaagtctaaaaaaaggattaaaaacaaacaaaagagtagtattgaatagaatgaggggaccaaaaagcaggattttatgtggacgagggtcaaaaatataagtaattaaaggaatcccgggaaggaggtttaagttgttccctgaaagagttaaaaccagggttacatttattagtgtttgggattgggcataaagagaaaataaaatttactccgcatattattcactacattggtagcaacaaaccttggttaaaggaacattcagctaactctcctcgtttttataatgaagaatacttgttttatcatcatctttcttgggataatcttagacagacagacagacagacagacagacagacagacagacagacagacagacagacagaaaaatataacccaattgccttgtatgtcaaagtgcggttaattttgaccgcattttttcttttggaaggaaaattacattgagtttattttatatttaatccatatcttacctagcattttgtgatctacatcataaaaccaacataaaattatcgcttgaacaaaacaaaatcgctactatataccctaaattttgttattccaccttttcaaaactaacggagtattttatggcatttcgtattgaaaaagacacaatgggtgaagttcaagttccagcagataaatactgggctgcacaaactgaacgttcacgcaataactttaaaattggcccagccgcatcaatgccacatgaaattatcgaagcttttggctatttgaaaaaagcagccgcatttgctaatcatgatttaggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgcgcacatgtgataaacggtggaaaattaggtgaaaaatctattattcacccaaatgacgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaatacgctgccacatttaagccaattagcattgggtggaactgcggttggcacaggtttgaatacgccgaaaggctatgatgttaaagtggcagattacattgcaaaattcaccacacttccgtttgtcactgcagataataaatttgaagcattagccgctcatgatgcgattgttgaaactcacggtgcattacgtcaattagcaatgagtttatttaaaattgcgaacgatattcgtctattagcatcaggccctcgttcgggaattggcgaaattttaattcctgaaaatgaaccaggttcttcaattatgccaggtaaagtaaacccaactcaatgcgaagcgatgacaatggtctgtgcacaagtatttggtaatgacactacaatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgctggtgaccgcacttaatacgaatatcggttatgaaaatgcagctaaaattgcaaaaaccgcacacaaaaatggcaccacattacgtgaagaagcgattaatttaggtttagtgtctgccgaagattttgataaatgggttcgcccagaagatatggtgggtagcttaaaataattcatcgcacaaattaacattacaacgatcaaaggcgagtaaaattactcgcctttttactgatttctaatttgctttttgatgcggtttgttataatcaacaaaattttattcacggctatttattatgaaaatgaaatccctttttgtggcaatgataacgtttttttctgccgcaccttttgctcattggcaacccatcggaaatgccgaatacacttgggggccgttccatgtttataccattggtttgttttctgaaactggcacttatcaagaaaatgaacgtccattaatgctctctttcaaatatgaaaaacccattgaaggaaaaaatttgcgattacgctcattaaagaaatcgaaaccttaaaacttaatgatggcgatactcaaagctggcttaaagaaatgcaagcgacctttcctgatttctcaccaaacgatattttgaactatattgccttacccgatagaggctacttcgtcttaaatgatacagttttagaacacgattttgatgctaaatttaatcaagcatttatcggcatttggcttgcaccgaatagtacttttgtaaaacttcagccacaattattaggcaaaacgaaaagcaatcatgaagcgacagagttttatctcaaacctgaaattgaatcctttgatgaacaagattctacacctgaattaccgccaaattatttattagatagtcagaaaaaatctcaaggataaattcagttttttatattttgtgccataaaaaatacctgtttcccaataaattattatcaaggaaaccggtatttattatttgaacattctctatctgactaaaatttttcccaaactgggataacgctatcaactaaatctaaattttttcctaactcaatccagccacaagggaaatgaaaatcggagccaacggatcccagcagattaaattcttttgcccaacgagcaagcatttgacgctgatcttttgtttgaccacaatccgccatttccattccatcaccgccccaagccttaaaatcgactatcagcttacgcacccatttccccgtcatgttataacgtaatggatgtgcaataatagctataccgcctgcggcatggattgtctcaatcgccgtgggaatatcagcccattcagctttaacaaatgctgattttccttgccctaaatagcgtttaaaggcctgaccatcattagataccttaccaatctgcaccaaataacgtgcataatgagcacgcgtcacttcgccatcggctaaggcttttgccccgtcataagcatgaggaatccctgctttttctaatttatcgccaatttccaccgctcttttttcccgtaatgctttttgactttgcaaaagtgcggtcatttttggatgagttttatcgaagtttaatcctacaatatggatccctcgcccttcccaatttgtcgaaatttctactccagtaatcaattcaatgcctacttctttcgctgtaatctcagcttcatcaatacccacaatcgtatcgtgatcgcataatgccagcacgttcacaccttgcgcataagcacgatgcactaattcagttggactcaacactccatctgatgcggtactatgacaatgtaaatcgtatttttttgtcattatttaatattttttactaattcttttactaattttggaccgtgataaatcaatcctgaataaacttgcaacaactctgcaccagcctcaattttctcttgtgcattttgcaacccatcaatgccgccgctaccaataatcggaatctgacctttcagttcttgatgtaatcgcttaataatctccgtgcttttatgctgcaacggctttccacttaatccgccttgctgttcggcatttttcatccccataaccgtatcacgagaaaccgtggtattcgttgcaataacgccatccattttatgacgaaccaatgtatccgcaatttgcactaattcactttccgttaaatctggtgcaatttttaccgcaatcggcacatatttattgtattggtttgccaaaatagcctgacgatccttaatgcttcgcaataaatcatcgaaataatcaccatattgtaattgacgcaaatctggtgtattgggagatgaaatattcaccgtaatataacctgcgtagttataggctttgttcaaacagaaaatataatcatctttgccttgttccaaagatgtaaatttattcttaccaatattgatgcctatcacacctttataacgggcgtttttcacattttctataagatagtcaataccattattattaaaaccattacggttaataatgccttcagcttcaatcaaacgaaactgacgtggctttgcattcccatcttgtgcaacgggcgtgactgttcctacctcgagaaaaccgaaacccaatgtaccaaagccgtcaatcgcatcgccatttttgtctgcccctgccgccaatccaatgggattaggaaaatttacacccattaccgttttcggaaagcctttgggagcatgaataagagattttaagatcggttgaaataaaggattactggctaatttcaagcattgaatcgtgaaatcatgagcctttcagcatccatttggaaaatgccgtgacggaataattgatacatactg

SEQ ID NO: 497 - DNA, 5002 bp, H. influenzae
  misc_feature (4906)..(4906): n is a, c, g, or t
  misc_feature (4914)..(4915): n is a, c, g, or t
tataagcccaaccaggcgccaacgcagtaacagtttccttgagagaaaacataacaaaagatggggtatttctggaagagaaaccaatgccaccaaaccagaaatgagggcttttaggtaagtaaaatagtgttaataaatggaaataatagttgccatctaaagttttcgatttaataacgagattctccatactcaagtgcggtagaatttgccaagttttacttagccagtctacgttttctaaacgaaatacccaatttatccgcatattgcttcattgtattcgttccagagctaccgcctgcataccaacgcttttcttgaaaaggaaccaacgagacttcaactaaggcagtttgataacttaaccccccacctatacgcaaagtagcctcattgtattttttattatcccaataatattttccattcccattaaacatagttttactaaaaaaatgatctgcccatggccatttttttctactgataaagaataccctaccccccttcccactttctttttcccaagcggtccaactaccaatttttgtgccactttttggagcgttattcaaattatcatcatttaaaaaatttaagcctacttgccatatccattgattccgctgatttagtgttaaaagatactgatcaataacacctaaaaatttttcatcatctacctctgtacgtaatttttcaaattgaattttggcagattcattttcatagttaaaaaatagggcttgagctaattgataacgcaaaggtagtaaagatgcgtctagagcgaataattcacgataataagcaatagattgagttaaatcaccttgttcacgcgcgtcaatagcctttgcccaagtgagtaagaaattatcgtgctgaggaaattgtttatatagtggtaataacagttgaactgcctgagtgttattttgatataaagcaagaattaacccacgcaaaacaagtcttggatgttgtgctaattggcttttggaaagagaaataatatgcctatttggtatttctttcttaggcatagaggaaaaagaggaggtttttaattccgcactttgaatcgtatttgtcagtgtatcatttttaggacgtgcaacttttgcccaagctatattcgttaatgataagcctattaatgataagcctattaatgataagaaagaaatttgttttacgccatttttcatattttatccatattcttaaaaaactctaacttgacattattacaaaaaaagaacaataatgcgaattattatcaattttgtataagtattaattctatgaaatctgtacctcttatcactggtggactttcctttttattaagcgcttgtagcgggggaggtggttcttttgatgtagatgacgtctctaatccctcctcttctaaaccacgttatcaagacgatacttcaagttcaagaacaaaatctaatttggaaaagttgtccattccttctttaggaggagggatgaagttagtggctcagaatctgagtggtaataaagaacctagtttcttaaatgaaaatggctatatatcatatttttcctcaccttctacgattgaagatgatgttaaaaatgttaaaacagaaaataaaatacatacaaatccaattgggcttgaacctaatagagcattacaagaccccaatttacaaaaatacgtttattctggtttgtactatattgagaattggaaagacttttccaaattagcaacagaaaaaaaagcctatagtggccattatggttatgcgttttattatggtaataaaactgcaacagacttgccagtaagcggtgtagcaacgtataaaggaacttgggatttcatcactgcaactaaatatggccaaaattattctttgttcagtaatgctagaggtcaagcttattttcgacgtagtgctactcgaggagatattgatttagaaaataattcaaagaatggtgatataggcttaataagtgaatttagtgcagattttgggactaaaaaactgacaggacaactgtcttacaccaaaagaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaagtagaaacaaccaacaagtagaaaaaaacaaataatggaatactaaaaatgactaaaaaaccctattttcgcctaagtattatttcttgtcttttaatttcatgctatgtaaaagcagaaactcaaagtataaaagatacaaaagaagctatatcatctgaagtggacactcaaagtacagaagattcagaattagaaactatctcagtcactgcagaaaaagtaagagatcgtaaagataatgaagtaactggacttggcaaaattatcaaaactagtgaaagtatcagccgagaacaagtattaaatattcgtgatctaacacgctatgatccagggatttcagttgtagaacaaggtcgcggtgcaagttctggatattctattcgtggtatggacagaaatagagttgctttattagtagatggtttacctcaaacgcaatcttatgtagtgcaaagccctttagttgctcgttcaggatattctggcactggtgcaattaatgaaattgaatatgaaaatgtaaaggccgtcgaaataagcaagggggggagttcttctgagtatggtaatggagcactagctggttctgtaacatttcaaagcaaatccgcagccgatatcttagaaggagacaaatcatggggaattcaaactaaaaatgcttattcaagcaaaaataaaggctttacccattctttagctgtagcaggaaaacaaggtggatttgaaggacttgctatttacactcaacgaaattcaattgaaacccaagtccataaagatgcattaaaaggcgtgcaaagttataatcgattaatcgccaaagaagatggatctaatgcatactttgtgatggaagatgagtgtccaaaggattataacagttgtataccttcagccaaaccacctgcgaagttatcctcccaaagagaaaccgtaagcgtttcagattatacgggggctaaccgtatcaaacctaatccaatgaaatatgaaagccagtcttggtttttaagaggaggctatcatttttctgaacaacattatattggtggtatttttgaattcacacaacaaaaatttgatatccgtgatatgacatttcccgcttatttaagatcaacagaaaaaccggatttagaaaatagttctttttatccaaagcaagattatggtgcatatcaacgtattgaggatggccgaggcgttaaatatgcaagtgggctttatttcgatgaacaccatagaaaacagcgtgtaggtattgaatatatttacgaaaataagaacaaagcgggaatcattgacaaagcagtgttaagtgctaatcaacaaaacattatacttgacagttatatgcaacatacacattgcagtctttatcctaatccaagtaagaattgccgcccaacacttgataaaccttattcatactatcattctgatagaaatgtttataaagaaaaacataatatgttgcaattgaatttagagaaaaaaattcaacaaaattggcttactcatcaaattgtcttcaatctttgggttttgatgactttacttcagcgcttcagcataaagattatttacctcgacggtgttaccgctacggcaaagagtatttcagagaaacctggtgaaacaccaagaagaaatggtttcaaattacaaccttacttatacccaaaaccaaatgcnatctttgnnaggacgagatcattgtaattatcaaggtagctcctctattatagtgactgtaaaggggcggtaatttaagggaaaaattattattca

SEQ ID NO: 498 - DNA, 6987 bp, H. influenzae
acctgatgaccgaaaccgccttctccacgttcggtttgttgaaaatcttctacaatattaaattcagcttgtactactggcacgaaaacaagttgagcaatacgatcgccgacttcaattttgaatggttcatttccacggttccacattgataccattaatggcccttgataatcggagtcaattaatcccacaaggtttcctaacacaatgccgtgtttatggccaagacccgagcgaggcaaaatcacggcagctaaattgggatccgcaatataaattgatagccctgtcggaattaatttggtttcgcctggttgaatttcaaagctttcatcgatcaacgcacgtaaatcaagacctgctgaaccttcagttgcgtaagttggcagaggaaattcatttccaatgcgagaatctaaaatttttacgtcaatttttttcatttaatactccgtttgaaattcatttttaggtaaaagtgcggttggaattataaggttttttgatagcgttcgatgatttcattgactaaatcagcggcaagttctacttttgattttagcgataattttttatgaccatttttccaaaaaagctgcaaggcattttcatccgcgttaaaaacttgtccgccagatacatcgttggcacaaatcatatcaagatttttgcgttcaagtttatcttttgcataatcatcaatattttgggtttcggctgcaaatccaacagtaaaaggacgatgtgtttttaaatgtcctacatctgagataatatcgggatttttaattaacttgatagatatttcatcgccagattttttgattttttgttctgcaacttcagctactctgtaatcagcaacagccgcacaaccaataaaaatttgattttttaccgcactttcaagagaggcttgccacatttcttgtgctgagatgacattaattcgatttacattttttggtgttgttaaattcactgggcctgaaatcagtgtgacgtttgccccacgtttggcaaatgcttcagcaatcgcaaatcccattttccctgaactatggttagaaatataacgaacgggatcgattgcctcacgcgttgggcctgctgtaatggcgacatttaatccttgtagatcttgtttttgagagaaaaagtcagaaagtgcggtaaaaatttcctctggttctgacatacgccctttccccatatcgccgcaagcttgaaaaccactattggggccgataagctcaatcccacgtgtttgaagagtcgttaaattttgttgagtaatggattggtgatacatctgctgattcattgctggcacaagaaaaattggcgcatcagttgcaagacaaattgttgaaagtaaatcattcgccatgcctacagtaagacgggcaataaagtctgcactagctggcgcaataataatggcatcagcccatttggcaagttcaatatgccccattgccagctctgcttgtggatcaagtaaagattgcgatacagcattgccagaaatggcttgaagtgtcaaaggagtaacaaattctgctgcagctggggttaatactacacgtacttcagcttctgctttgcgtaataaacgaatcaactctattgttttataggctgcaatgccgcccgtaataccgacgacaacacgttttccgtttaaattcattttcttcccttgttagtacttaaccacaatttcgttattttactttaattttattgaatgcccaacgctatttttacgatatgcatcgcagattttgaatcacttgctcgtcaaacctaaaaagtgcggtcaaaatctttcttatttttcttttataaatatatggaaaacaatgatgaattaatgccacgggaaaaattgctggcattcggagcaaaagcattaagtgattatgaactacttgcgatttttttacgtactggtatcaaagattgtcctgttatgtcactttctaaaaatgtattaacgcattttggctccttgcacgctttactttccgcagataaaaaagctttctgttctgtaaaaggcttaggtattacgcaatttattcaactgcaagcgattacggaaatgaccaagcgttatttaaagcaagagatgttaagtacgccgattattaatgatcttgaaacggtaaaactttttttactcactgaattgcaacacgaggaaagagaagtatttatggttttatttttagataatcaacatcgtttgattaaaaaagagcggttatttttaggtacaattaatgtatcagcggtttatccgcgagaaattattaaagaagcactctattgtaatgcggcagctttaattttggcacataatcatccttcaggtataacggagccgagttattcggatcaacttattactaaaaaaattcaagatgcggctgaactaatggaaattcgcgtgcttgatcatttaattgtagggaaaagcgattgttattctttcgcggagaattgtttattataaatttttataatattgaccatttttttaccgattacattcaggaaaatcgcatttacacttgagaaatgaaaacaaagtcagtataatttgcgacctttaatatagtaagcgggtcggattagcgcgacctgacgaggtagcaagctaggtttaaccagctttaaacaatccgaaccgtaagctcgagcttatatttaattattggagattattatgtctagagtttgtcaagtaacaggcaagcgtccagctgtgggtaataaccgctcacacgcaatgaatgcgacacgtcgtcgttttcttccaaaccttcacactcaccgtttctgggttgaaagtgaaaaccgtttcgtaaccttacgtttaactgcgaaaggtatgcgtattattgataaaaaaggcattgatgcagtattagctgaaatccgtgctcgtggcgaaaaaatctaaggagctaaaaaatggcagctaaaggtgctcgtgagaaaatccgtttagtttctactgcagagacaggtcacttctacacaactgataaaaacaaacgtaatatgcctgaaaaaatggaaatcaaaaaatttgatccagtagtgcgtaaacacgttatctataaagaagcaaaaatcaaataatattgatttaattattttaaacccgagtagaaactcgggttttttatttgttcttattagaaacgtttgctttttatttagccgtttgactcgtaagaagctaaatttgcttttcatattgcaaaaagaatatacaattgtccccgttttgacgtaaccctacatcaaaacctgtttccaacctagcccgtccaatgggcaaactagggtaaaaacaaaaaagctgaaacgctttttttaataagtagcgagtcaaatgccctatgtgtctgttttataaacagtaaatttatcgcaaggcacccgacttatttttttcacctcttttagaaggttttaatcaaaaatgacaatgattacccctgtacaagcaattcttgcttcaaaccaacattttttagatcgccaagatgtaatggaatccaacgtacgtagttatcctcgcaaattaccttttgcctatgcaaaagcacaaggctgttgggttactgatgttgaaggtaatgaatacctagactttttagcaggcgcaggaacccttgcattaggacataatcatcctatattaatgcaagccattaaagacgtattagatagcggattgccgttacacactttagatttaaccactccacttaaagatgcgtttagtgaagaattattgtcattcttcccgaaagataaatatatcttacaattcacaggcccttctggtgcagatgcaaatgaagcagccatcaaattagccaaaacttacacagggcgtggcaatatcattgctttctctggcggttttcacggtatgacccaaggggcattagccttaacgggtaatcttggtgcaaaaaatgccgttgaaaatttaatgcctggcgtacaatttatgccatatccacacgaataccgctgcccatttggcattggtggcgaagcaggcgcgaaagcagttgaacattactttgagaacttcatcgaagatgtagaaagtggcgtagtaaaaccagctgcagtaattttagaagcaatccaaggagaaggcggcgttgttccagcaccaataagcttcttacaaaaagtacgtgaagtaacccaaaaacacggcattttaatgatcgtcgatgaagtgcaagcgggtttctgccgttctggaagaatgttcgcctttgaacacgcaggcattgagcctgatattattgtgatgtcaaaagcagttggtggcagcttaccattagctgtattagctattcgtaaagaatttgatgcttggcaacctgcaggacatacaggtacatttcgtggcaatcaattagcgatggcgacaggttacgcttcacttaaaattatgcgtgatgaaaacctcgcacaaaatgcccaagagcgtggtgaatacttaaccaacgcattacgtgaattaagcaaagaatatccgtgcatcggcaacgtacgtggtcgtggcttaatgatggggatcgatattgtagacgaacgccaagcgaaagatgcgataggggcttacccgcgcgattgtgaattagcggcagcaatccaaaaagcttgcttcaaaaacaaactcttgctcgaacgtggcggacgcggtggcaacgtggttcgcgtgctttgtgcggtaaacatcaaccaaagtgaatgtgaagagttcatcaaacgcttcaaacaatctgttgtagacgcattgaaagtggtgcgtagttaattaaaagcggtctgattttgcaaatgttttgcgaattttgaccgcttgtaaattcaaaatggtagggaaatcccaccttttttctactcaactgtataaaactgggatatacttatgctatatacaattaagcataaggaataactatgattgaagcctctgtttttatgactaatcgaagtcaagctgtgcgtttgcccgctgaagttcgcttttctgaagaaatcaaaaaattatcggttcgtgtatcgggcagtgatcggattttatcgcctctcaaccaatcttgggatagttttttcttgaatgatcaagcagttagcgatgattttatgaatgaacgagaaattgcatttcaaccagagcgtgaggctttatagtgttgaaatatatgcttgatactaacattgtgatttacgtgattaagcgtaggccattggaaattctttctcgctttaatcaaaatgcaggaaaaatgtgcgtgagtagcattactgtggctgaactctattatggagctgaaaaaagcgaatatcccgaaagaaacattgcggttattgaagatttcttatcacgcctcaccattttagattaccaaccaaagcatgcagctcatttcggcaatattaaagctgaactctctaaacaagggaaattgattggcgaaaatgatattcatatagctgctcatgctcgtagtgaagggttaattctggttagtaacaatttaagagaatttgagcgagttatagcattacgtacagaaaattgggtgtaattcatatctaggaataattatgtcaaacctcaaacaacacaaacaagctttgttttgcaacgataacgaagccattaacgattatgaaacagcgatgtataatgcggtgcaagcagtctctgcttggctgaaaaatgaaaaaatgtacacaggcggttcaatcaaacaaatgcgagccttaataagcggttttaatccgacgaaagagggtatgggtgtacagaaatcactcgatcatttggtaaaaattttccttaatccaagccttaaagtacatcatccacactcacttgcccatttacattgcccaacgatggtaacaagccaaattgcggaagtactgattaatgcgaccaaccaatcaatggattcatgggatcaaagcccagcaggttcaattatggaggagcatttgatcaactggctacgccaaaaagcaggctatggcgaaggcacatcaggcgtgttcacttctggtggtactcaatctaacttaatgggcgtattgttggcacgcgattgggcgattgcaaaccactggaaaaacgaagacggctctgaatggtcagtacaacgtgatggtattccagcagaagcaatgcaaaaagtgaaagtgatttgttcagaaaacgcacatttctctgtacaaaaaaatatggcaatgatgggcatggggttccaatcggtcgtgaccgtgccatcaaatgccaatgcacaaatggatcttattgcacttaaacaaacacttgcacagcttaaagctgatggcaaaattactgcctgtattgtcgctaccgcaggcacaacagatgctggcgcaattgatgatttaaaagcaatccgcaaacttgccgatgaatatcaagcgtggttacacgttgatgccgcttggggtggcgcattattgctttccaaagattatcgctatttcttagatggtattgaattaactgattccatcacgcttgatttccacaaacacttcttccaaacgatctcgtgtggggcgttcttgttgaaagatcctgagaactatcgctttatcaattacaaagcggattatctcaattcggaatatgatgaagctcacggcgtgccaaacttagtggcaaaatcgctacaaacaactcgtcgtttcgacgcattaaaattatggtttacccttgaagcattgggcgaagatctttacgcttcaatgatcgatcacggcgtaaaactgaccaaagaagtcgagcaatacatcaacgatactcctgccttagaaatgcttgtgccaagtcagtttgcatcggtgttattccgtgtcgtaccaaaaggggtaccgagtcgatattcgaaaaca

SEQ ID NO: 499 - DNA, 5826 bp, H. influenzae
  misc_feature (5802)..(5802): n is a, c, g, or t
cctttattttgagtattattatcattagtattgactaataatatttgctattcttttatctgatatttgatattttgtccccaactgctgggcaaataaactcacacgcaattcctcgatcatatagcgaatttccgcaatttcatcagaaatcggtttagattttggcagtttagccagtaattgttggtaagcctgttgcacttgttccacgcgtagcatcgcagcacgatcacggtttacatcttgagccaacttatcaatacgtttatcaatggcttgcagataacgttgtaaatctggtaggcgatcataaccgctcttttgcacaaaaccttgatacaccaaacctgcaagttgcgatttgatgtcggataatgcaaatgccatcgtgaaatccattttgcctttaaggcgttggttaagttggtaagtgagagtaagaatctgctccactttctgcgcaatatccacggtcacttcgttaaggttttctcgaacgaaatcacgcaatttttcaaatcctgcttcatcccacacaaaaccgccaaaattggcaattagcttatctacggcacaagcaatacagtcatcgatcaaatccaatacgcgaccgaacggagtaaaatacagacccaatttagccttattcggcaatttttcatgaagatatttaattggtgatggcacattgagcaataacaaacgacgtaaaccttgttgcatcgccaccgattgctcaaactctgtttcaaacagtttgatacccaccgcatctttttcatctacaatagctgggaacgctttgacgctgaaaccacgttgtttttgttcataacattgtggtaaatctgcaaagctccaaatatgcagcctgctttgctcaatgccatcatctgccacagcagaaatactttcctgcacacgatcttttaagttgaatttcagctcatccaaattcatggattctgcgattttcttaccgttttcatccaccacacggaacgtcattttcagatggcttggaatttgttcccaattccaatgttccgcttctacggtgacgccagtcatacgacgcaattcataaatcagcgtatctaataatggcttttccaacggcaccgcacgacttaaaaaagcaggagtataattaggtgcaggcacgaagttacggcgataagatttcggcagcgatttaatcagcgcaatcaccaactcttcacgcaagcctggaatttgccagtcaaagcctgtcatttccacttggttgagcaatggcaatggaatatgtactgtcacgccgaccggcatcggtacctggttcaaattgataagtcaatttgagttttaaattgccttgataccagaaattcgggaaatccagtttgctcacttgttccgcatcatcattgatcaaaaatgaacgttcaaaattaagcaattcaggatctttttgctgcacctttttccaccacgtatcaaaatgcttctgggaaaccacttccgtgccaatacgctgatcgtaaaattcaaacaatgtgcgatcatccaccaaaatatcgcggcggcggcttttgtgttccaattcttctacttcttgaacgagcctttgattttctttgaagaatttatgcttggtattccaacccccttccaccaaggcagattgaataaaaatctcacggcttaccgttggatcaatagcaccgtaattcactggtctcgcagccacaatcggcacaccgtaaagtgtgactttttcatctgcaatcacggcgccacgggatttcgaccaacgcggttctgaataggattttttaatgagatgctcggcaagtggctcaatccattctggctcgatttctgccaccatacgcccccaaagtttggaggtttccactaactctgccgccatcacccatttcggttgttttttgaaaagcacagaattggggaaaatcgcaaaatgggcattacgtgcgccaagatattgttgtttctccgcttcttttaaaccgatatgagaaagcaaaccgcttaaaagtgcggtatgaatttgctgatattctgctttttcagaattaatcggtaagcccatttcacgcacggttaaacgaatttgatgataaatatcctgccattcacgaatgcgtaaataatttaagaaatccttttggcactgacgacggaattggtttttactcaattctttttgttgttcttgtagataataccaaagattgaggaaagccaagaaatctgattttttatcggcaaaacgacgatgtttttcatcagaagcttgctgtttttcttgtggacgctcgcgcggatcttgaatggataacgcagagacgatgatcatcatttcataaacgcagccaaaattgaccgcacttaggatcattttggcaaggcgcggatcgactggaagttgagcgagttggcgaccaactctagttaataggcgtttttcacccgatttagtttgaacagtttcaaacgcgcccaattcttccaacagttttatcccatcttgaatatggcgtttatctggcgcatcaacaaatgggaacgcttcaatatcatccaaacccaatgccgtcatttgcaaaataacggaggctaaattggtgcgtagaatttcaggatcggtaaactctggacgagaattaaaatcctcttccgaatataaacgaatacaaatcccttcacttacacgaccacatcgacctttacgctgattagcagatgcctgtgaaataggttcaatcggtaaacgttgtactttggtgcgatagctataacgggaaatgcgcgctgtacctgggtcaatcacatatttaatgccaggtacggtcaatgaggtttctgcgacgttggtcgccaatacaatgcgatttaaaccgcttggatggaaaattttattttgttcttgcgcagacaagcgtgcaaagagcggtagaatttccgtgtattttagattttgtttttgtaaagcttcggcggtatcacgaatttcacgctctccattcataaagatcaagatatcgcctcgaccttctgcttgcaattcatccaccgcattgagaatgccttgtagctgatcttgatcgtcctccactacgggacgataacgcacttcaacaggataggttctgcctgagacttcaatgatcggtgcattattaaagtgtttggaaaagcgttccacatcaatggttgcagaagtgataataagttttaaatcacgacgacgtggcaacaactgtttcagataaccgagaataaaatcgttatttaggctacgttcgtgggcttcatcgataatcaaacaagaatattgattgagaaaacgatcgttttgaatttctgctagcagaatcccgtcagtcatcaatttgatttgggtgttatcgctgatttgatcgttaaaacggactttataccccactaaatcgccaagttctgtttccagttcttccgcaatacgtgccgccaccgaacgagcagcaatacggcgtggttgagtatgaccaatcatgcctaaattgccgaaacctaattccaaacacattttcggcaattgggtggttttacctgaaccagtttcccctgccaccacgatgacctgatgttcagaaagcagtttttgaatttcgactttgcgttggctaacgggcaaactctctggaaaaaaatcggattttgtaccgcacttttccgttgttctacacgtaatctagcttgttcaatttgctgttggatttcagcggcaacggcttgttgagcctcttggcttttaatttttccaataccatgaatgcgggcggataagcgacgttgatccacccgcatgatgtcatttaattgagaaaaaagagattgttgtaagggagttaatgtgtgttttaccgagctgtttttcatagcgatttacttttgaaacttccgtaagctaagctaatccatccgattaaaaataaagtgccgccaataggcgtaatccatacaattacattgcttgcttcgaaagcaagtgcgtataaacttccactaaataataagattccaattaaccaagaagacatagataatcgggcgaatttattgtcacgtaaagcagataatgcaacggcaagtactgcaatggtatggaacatttgatattctaaccccgtatcaatccatgataatgctttggcttctaatatatggcttaggccatgagctgcaaatgcgcctagtgcgacacagaagaatccgcttaaagtggcaatagtaaggtatttgtttttcatttaaattttccctaaaagtaaagctaatatacctgcagcaataagtgggccaacgggaattccacctaaaaatgctacaccaataattgtgccgataagcaagccagtgactaaaatcggttgttcgcccattaaaggcacacctttacctgcaagccatgccacaagcactccaactgcaatagaaagagccattttccaactaagaaaacctgataaatcaggcaactgaatttttcctgaaactaaggggcttaaaaccccaatggttaaaataatgataccaattttaacgccatatttttcgagcaaaggaatatgagaagataaaaaagtttgctgcatgataagtaatacggcagcagaaatggtaattgcgctgttgttgcttaatacgccaagaataagaagtatcactagtaatagagcaatggtattgagttgtaatgtcataaagtgcggttaaaaaaatggaaattttggtaaatattctagcatagaaattcgtaaaattattttccattgttgttgagaaaaagataaatgagaaaagttaaaaagggttcattatgaacccttttatttagtcggtaaaattcttaaatcatttattcttcaaatttaccttttttttctttattgatggtgcattttgcactagcccaaattgcaaacaatacacccactacccaaatcgcatataacattctatttctccttagtataatgagtgtttatttttatcaatgaaattagcatctaaacgaccaaacatttttgagtaagaccaaatagtataagctaaagcaatgaccacaaaaacaactgcaaaaatcagcattaatgttaatgttaattcacttgaagtcgaatcccacattaataaactttgttcaggatgtgaacttgaaggcatcacaaatgggaacattgatactgctgcagtaataatcacaccagccattgttaatgcagagaagaaaaatgcaaaaccacaacgattcgctttagaaaatgcagcatttaataatgcagcaactacagctaaagcagggaaaatccaaagaattggcatttcattgaaatttctaaaccacgcgccagtttctacagcaacttctttattcattggagacgatggagcgaaatgatcgatagtgctagtaactacataaccatctttagaatataaccatacgccagctaatacgaatgtaattaaagtcacaatagaaccaatttgacttactgaacgagcacgatcacgtaagacttcagtggttttcatttgtaaccagtttgcgccgtgagtgacaagcattgataagctaataacaccacataataatgcgaatggatttaatagctcaaaaaatgaacctgtataagtcacttgagttaattcgttaaaatggaatggaacgccttgtaataaattaccaaaagccacgccaaatactaatgctggtacaaaaccactggggtactcttcagaagngactcgcaggcagacaagtctggc

SEQ ID NO: 500 - DNA, 4160 bp, H. influenzae
tcagcaaatattgaaattgggctttgacgtgatcgtggaacacgatgcaggttttaaagctagttttgaagatcaagcatttttagaggcaggcgcgaagatcggtacgtcggctgaaatttggcaatcggatattatcttcaaagtaaatgcaccgacagatgaagaaatcgctcaaatgaaggaaggagcaactctcgtgagctttatttggcgcatgcaaaatcctgagttaatgaaaaaactcaccgcgaaaaaaattaatgtgttagcaatggatgcggtgcctcgtatttctcgtgcgcaagcattggatgcgctttcttctatggcgaatatttctggttatcgtgctgtcattgaagctgcgcatgaattcggtagcttctttactgggcaaattactgcagcaggtaaagttccaccagcaaaagtgttggttattggtgcgggtgtggctggtttggcggcaattggtgcagcaaatagccttggggcgattgttcgtgcttttgactctcgtcctgaagtgaaagagcaagttcaaagtatgggtgcgagcttcttagaaattgatttcaaagaagaaggtggcagtggcgatggttatgcgaaagtgatgtcggaagaatttaaccgtcgtgcgatggagctttatgcagaacaagctaaagaagtcgatattattattactacggcagccattccaggtaaaccagcgcctcgtttaatcaccaaagaaatggtagattcaatgaaaccaggttcggtgattgtggatttagccgctgcaactggcggtaactgtgaatatacgcaagcagggaaagttgttacaactgaaaaccaagtgaaagtgattggttatacagatttcccaagccgtttaccaacgcaatcttctcaactttatggcacaaacttagtcaatttattaaaacttttgtgcaaagagaaagatggcaatatcaatattgattttgaagatgtggttcttcgtggtgtaaccgttgttcgtgatggggaagaaattccaccagcacaaattcaagtgtctgcacaaccaaaacaagaaaccaaagctgcaccagtggcagagaaaaaagaatctaaaccaacagatcctcgtgtgaaatacggtgtgatggctggtgttggcgtgttattcctttggttagcttctgtggcgccagctgcatttttatcacatttcaccgtatttgttttagcttgtgtggtgggttattacgtggtttggaatgttagccatgcacttcacacaccattaatggcagtaacaaatgcaatttcaggcattattattgtaggtgcgttattacaaattcgtcagccaacaggcaatctatttatcgatgcgttagcttttgtggcgattttggtggcaagcatcaatatttttggtggtttccgtgtcacacaacgtatgttagcaatgtttagaaaaggttaaggagcgcacaatgtctgaaggtttagtacaggctgcgtatattttagcagcattacttttcattatgagcttggcaggactttctaaacatgaaactgctaaagcaggttgttggttcggtattgttggtatgacaattgcccttatcgcaaccatttttggccctcattctgaaggaacattttggatcattattgcgatgatcattggtggagcaatcggtgttcaacgtgcattaaaagtagaaatgactgaaatgccagaactggtggcgattcttcacagttttgtcggtttagcagctgtactcgttggctttaatagctatggtttacaccatgaggcgttaatgccagaaggattagatgcagcagcacaagccgcatttgtagcagagcaagtagtattaacgaatattcataatgttgaagtatttttaggtatttttatcggtgcagtaactttcactggttctgttgttgcatttggtaaattaagcggaaaaattaattcaaaagcattaatgttaccgcatcgccataaattaaatttagccgcacttgtggtatctgcattattgatggttgcattcttgaataatccagaaagcattttccctgtgttattaatgacagcgattgcgcttgcatttggatggcacttagtggcatcaatcggtggggcagatatgccagttgtggtatcaatgcttaactcttattcaggttgggcagcagctgcggcaggttttatgttgaataatgatttgctgatcgttacaggtgcgcttgttggttcttctggtgcaattctttcttacattatgtgtaaagcgatgaaccgttcatttgtgagcgtcattgcgggtggttttggtaacgatgttcaagtttcttcaagcgaagaacaaggcgaacaccgtgaaactacagcagaagaagtagctgagttgttgaaaaatgcaagttctgtgattatcacgccgggatatggtatggctgttgcacaagcacaatatccagtcgctgatattacggcaaaattgcgtgaacgtggtgtgaacgttcgttttggtattcaccctgttgcaggacgtttaccgggccacatgaacgtgcttttagctgaagcgaaagtaccttacgatgtcgtacttgaaatggatgaaatcaatgatgattttgctgataccgatgtggtattggttataggtgcgaacgatacggtaaacccagcggcgatggaagatccaaatagcccaatcgcgggaatgcctgtgttagaagtatggaaagcacaaaatgtgattgtgttcaaacgttcaatggcagtgggttacgctggcgtacaaaatccattattcttcaaagagaatacgcaaatgctctttggtgatgcaaaagatcgcgttgaagatatcttaaaagcattataaaaaacacgtataaaaataaccgcacttggggttgcttaagtgcggtatttttatttatagcatttaaatattatcttcatgattttccaaaatttctgaacacaagcctaagccagataaaaattcaataaatgcccgtacttttattggtaaatgtcttctgtttggatagaccacatgaatttctaatttttgttgtttatattctggtaatatttcaataagctcgcctttttcaaaggctctacctaaaataaattttggtaaattagcaatacctagtcccgcttttgccatatttaataaggcaaaaccgctattgcttaccactttggattggattttgaaacgttgggtttgatttatacgtgaaccaacccaatttacctgattcattgcatttttataaagtaagccattgtgatgttctaaatcatcaggcgtttgtggaataccattcgtttcaagataattaggcgacgctgcaaaatgaacagtagtagttcctattttacgtgaaactaacgagctatcttccatataaccaatacgaagagcaagatcatagccttcggataataaatcgattttcttatcattaaattcaacttcaatatgcaaatgaggatgcttagccataaaagtgggtaaatttggtgcaataaaaagtaaaccaaaatcacgaggaacggaaatcagtaaatttccttgtaatgaactggtaaggtgggtgatgctggaatctgcttcatctaaatcaagtaaaattccttggcagcgttgataatacattattccagcttcagtaggcataatttttctggtggtacgttgtaacaatcgtgtttttaaatgttcttctaattgtgaaactaatttgcttgccatcgccacagaaatattttgttgctttgctgccaatgtaaaactttgagtttcaatgactttgcagaaaatagaaatcgcgttgagtttatccatttatagaccttttttgaaaaaatgcttgattttgccaacataactttgcactataccgccaattttacaaaattctagtgatattaggtaatcaaatgagtaaatccttggtgattgtggagtcgccagcaaaagcaaaaactattaataagtatttaggtagccaatatgtcgtgaaatcgagcgttggacatattcgtgatttgccgacggttggttctagtacaggtgaaaaagctaaaccaatttcaaccaaaggtatggatgccgaag

SEQ ID NO: 501 - DNA, 5873 bp, H. influenzae
  misc_feature (1441)..(1441): n is a, c, g, or t
gagacccctttgtcaaaaggaacgatcattaactccatgaccctaaaagacgtgccaacccagatattatcaaaggatctcgccgtcgtcgtattgcattaggttctggcactcaagtgcaagatgtcaataaattacttaaacaattcgatgaaatgcaacgtatgatgaagaaaatgcgtaaaggcggcatggctaaaatgatgcgtggaatgcaaggcttaatgggcggaggcttaggcggtttaggcggaatgtttaaacgataatttcagaagataaaagtgcggttaaaaaagaaatatttttaccgcacttttgtgttttatgaattatagctaatttataaattattctaattaacgacgttgctgttatggaaactatatttaattttctcttttaagtatgtgaaaaaattaattaatgtttacgatgatattaatttagatagaaaaggagagccgaacgttaatttttcaggcaatcttttctatccagccaaagcccgttgcaaactttgcgtccaagcggttctaaatgcggcatctttggcaaaaagtttgtatagctctaattcatccctatggcgttcgctcatcacatcgcgcaaaatggcttggaaagccaattcacgggtatgaatatccgggttattttgatatttctgctcaaagtctttatggctgcggatgcgctcggtaatattgataaattttacccgttgctcatccggcgttgcgctccaatcttgaaaccatctttcgttaaatacacgaataatttcatcaatcggatctttttctttatcttcaccatgcgtaccgcgcggattggggttttgcgggtcaagctctgtttcttcatcatctaatttaatgctgtaattcagcttggtgcgcgccaagccgtaagagcttaaatccactgcatctaaaatttcatcaaattcatccatcgggtcttgtacttttaatttgggtactaagaatttgaggaaccaatagagcttttcccaagcgatattttcaaaattgatgatggaggccatttgcccgtaaatttttaaaaactgttttgccttgattttaaaatcaactttttcatttcgatccaaatccaattccaattcatcatcaaaacgttggacagccacatcaatcatactgcttaattgctgtgcgtctttattggcaaaatagccttcagtaaaatcgttgacctccgcttgttcgtacacgccggtttcatccaaccggtctttcaaatcatgcaagacattgacatcggttgcctgcgacaacgaagtagaagtataaaacggctcaatgcctgctgaatatcttcaacgctgttaaaaaagtccaatacaaacaaatcttccgtgcgtttactcaacttattcgcactgcgattcaaacgagataaagcctgcacgcanagcacgccggagagtttcttatccacatacatggcacacaatttcggctgatcgaaaccggtcagatatttattggcgaccaccagcaaacgatattcatcttgatcgaaaactctttggtttcgctttctgcaaagccgttcatttccgcttcggtgtattcgacaccgtcaaccactttactgcctgaaaacgcaatcgcaattttaaacggattaccccgcccggccagcaaatgttttaacgcctgaaaatagcggatggcggtttcaatattttgcgttaccaccattcccttggctttgcctttgagttttttacggttgaaaacttggtaaataaaatgatccagcattatctccgctttagtatcaatcgtttgttgcgaacgctccacataggctttcagacggctttgagcctttttactatcaaactccggattatcttcaatcgacttagtgatctcataaaaacttttataggtggtgtaattggcgattacatccaaaataaagccttcttcaatcgcctgcttcatagaataaaggtggaacggcttaaacttgccatccgcctgtttttcgccgaatttttccaaagtgctgtttttcggtgtggcggtgaaagcaaaatacgacgcattgccgtgcattttgcgggattgcatggtttgtaaaatcaaatcttgcacatcttcagcatcaaggtcttccgttttgccgatggcccggttcatattgtcgtgtgccgaacctgattgtgagctgtgtgcctcatcaataatcaccgcaaattgtttgtcgcctaaatcagcaatgccatcgacaataaacgggaatttttgaatcgtggtaataatgatttttttgccctgctcaagcgattggcgcaactctgccgaactcaacgccggcgcaacaatgtttttaacttctgaaaaatctttgatattgtcgcgcagttgcttatccaacaaacgacggtcggttacgacaatcaccgaatcaaaaatcgggcggtctgcctctctaccgtttgccgccttttcattgcgcggatatgcctcaatcaactgatacgccagccaagtaatggaattagacttgcccgaaccggcagaatgttgaatcaaataacgtttacccacgccatgttcactgacatcagcaatcaaacggcggaccacatctaattggtgatagcgagggaaaaagagggtacgtttatccaacggatctttggttgaaccgtctaagcgcataaaatgctgaataatgttggcaaggcttgctttgccgaacacctcttgccataaatacgccgtgcggtgtccattgggattgggcggattacccttaccgcagttgttgcccaagttaaacggcaagaaaaacgtagcaggccccgccaatttggtggtcatataagcttcttccgtatctaaggcaaaatgcgccaaacaacgcccgaaatggaacaacgtttggcttaaatcacggttgaggtattgtttttgcgcatcaatggctgtctgacctgtccaatggtttttcagctcaagggcaataatcggcaagccattggcaaacagcaccatatccaccgtttcattgcttgaggcagaataaggcacttgacgcatacagctaaacaaattctgttcaaaacgctgcttgaccttttcgccgctgctggcaagcggaacggggtagagcaaatcaaaatgggcgctatcaatatccaagccttttttcagcaggtgcaacacgccgtttttctttatttggcggtctaatcgctccaaaattttacgctgccagtcgtttgggttgagttgttgaaaacgggcaagttctgcctcttggctggtttgcaggaattgccaaaacagacgtgtgtcgatggcaaactgcgcatcaaaatcctgtgaaaatgccagtttaaaaccatgatggcgcggcaggtattcagccttcggctcgcccagcttattttccatgttttcacgccaagtgcccagttaaggctttttcgatggcaatttctaaatctttttccttagttcctgaaaccatttttcacccttttgtgaattttttaaatttattcattacgcccaagttgtcgcgccgatattcaaaatccatcggattttttgaccgcacttttcacacctatacccgcaccttgccggtcaccacatcgttaatcaacacgcttttatattctttcagcttttcaatatgggctgtttttaatgcgattgctcgatcaattttagaggtttgtttatctaggtagtcggcaattttttgctgttctaaatatggaggaataggtagtaataattctgcaaaatcagaatagcgaaaatctgttgaacgctctctaattcctttagctaaggagctaataaatcctgataatgcaagatttcttaagtaataagcgtaaaaatagacatcgattttttgtttatcatgaggcaaacaaacggaataaactggtgttgctttaccatctgaatcagaaataccaattgcccctgcaaaagcatccatagcgtgaataactaaatcaccttttctaattccttggtagccgtgttcttttagcgcatttgtaaatccttcagttcttcgattagctctcagagttacttgcccatccctaaaacaagtaacaatttggtcttcctcattcacttttctttctattttcttgaaaatgaattttgaacgttgcacatcccaatgctccggcacttgccctatccattccacgccggaatcttttaacggcacatcagggtttaagcctcgggttacggcattttgaatcaggatctgcttgtgctctttcaacagggcaatctgcttttccgccaaatccaccgcctgatcgattttagcggttttatcgtctaggaattgcgcgattttttgttgttcggagagaggtggaataaccaaaatactgtctgaaatatgcccatagttaatcgtttgtcttacacctgaacctaataatttcatatatgcaacatcgtatctatgtaataaatacgaaaagtattttttattaattatttgtttttcttttaaaacaatgtaaccggcacttacaacaacgtctatttctgataaagcaattctcaaactaattaggtcataatttaagtttaaaggatttattaaaaactcgccttttaacacctcttgatatgaacgttttgttgcctctgttactttatcatccgatttttcaataactttaccaaaactaatggctccacaattaagagacaggctttgcttatgttttttttcaacaaataattgtttcaagcgttttaactcccaatggctcggtacctcccctagccaatccacacctgaatctttgtaacgctcgtatcgtctcatttgcaaaaaatccttaaaatatgaccgctcttattgatgcaatttgttgtccgtttaactataaaaaaacttgcttatttcatgccaaatcttgcttaaaagataaaaatcattatttttcagcaagttaagcattgtcaatttccttgcttagcaagcgataaaccttgcttaatcttttctaaaagcatatttggcattggggtcacgctgttttacactttgtctttcaataataccttgctgaataaaggcatttaaatacgctcggatcgaattctgattgatttttgtatagtcaactaattctgacaatatcgccgtaccatttgtaaatagataaagcaaaatggctttttgggtgtcgttgtagtttgtccattctttttcaatctgcagcatagtggctgtagataccgttttttcatgtgcggtaacacggttgcgcaatgttagataaacattgttgttttgttctctatattcaggctttgccaataatgatttttccattgactcataaatacgggaaacgccttcattaagctgacggacatacccaagatcctctaaaactcgtgctatacgtggattccgagcgaatcgttccgttttaatattttcaatggtgacttgagcagggagagggccactattactaatttcaagacgatcgtcgaaatgtttaatataaataacattaccttgaacattgtaagaacgatgacaaagcgcatttacaacaccttctaaccaagcttcttcaggatattccggtactttgataaattttccctgattgacatcaagaaagtaataatcccttaaagaggctcttaaaaaataggtcagctcctcaattagctttggaatattattttcaaaacgttggtcttttatcacattatgctcagtaccgactttcgctactgtaccttcataacgaacatagcggactgatgctgaaggaatgtaacggggaaccgagtccgaattcgaaaaca

SEQ ID NO: 502 - DNA, 5556 bp, H. influenzae
  misc_feature (3223)..(3223): n is a, c, g, or t
tttctggtaacacggtaagcgttaaagcaaccaatgatttaattaccaaagcaaattcaaaaattgaagcaaaaacaggcgaggctaatgtaacaagtgcaacaggtataattggcggcacaatctctggcaatacagtaaatgttacagcaaatactggtagtttaactattaaaggcggtgcaaaagttgatgcgacaaatggagctgcaaccttaactgcagaatcaggcaaattaaccactcaagcaggctctactattacctcaaacaatggccagacaactcttacagccaaggatggcagtatcgcaggaagtattgatgccgctaatgtgacattaaataccacaggcactttaactaccgtagtgggttcaagcattaacgcaaacgaaggcaccttagttattaacgcacaagacgccacactaaatggtgatgcatcaggcgaccgtacagaagtgaatgcagtcaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtagtcagtaattgacgaggtagatttcatcctgcaatgaagtcattttattttcgtattatttactgtgtgggttaaagttcagtacgggctttcacccaccttgtaaaaaattacgaaaaatacaataaagtatttttaacaggttattattatgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtctactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaaccctgaaatttaatcaactggtaagcgttccgcctaccagtttataactatatgctttacccgccaatttacagtctatacgcaaccctgttttcacccctgtatatcaaataaataaaccaagcaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaactaagaaaaccaagtaaagtaaactaagcaatgctaaaaaacaatttatatgataaactaaaatatactccacaccatggcgatacaagggatttaataatatgacaaaagaaaatttgcaaaacgctccacaaaatacgaccgtttcacttgtggaatcaaacaacaaccaaacttccccgcaaatgcttcaacaatcacccaaacctagcctattgcgcttggaacaacatatcgaanaaaaagattatgagtttgcttgtcgtgaattaatggtgattctggaaaaaatggatgctaattttggaggcgttcacgatattgaatttgacgcacccgctcagctagcatatctacccgaaaactactcatttattttgccactcgtctcgctaatgcaattacaacactcttttccgaccccgaattggcaatttctgaagaaggggcgttaaagatgattagcctgcaacgctggttgacgctgatttttgcctcttccccctacgttaacgcagaccatattctcaataaatataatatcaacccagattccgaaggtggctttcatttagcaacagacaactcttctattgctaaattctgtattttttacttacccgaatccaatgtcaatatgagtttagatgcgttatgggcagggaatcaacaactttgtgcttcattgtgttttgcgttgcaatcttcacgttttattggtaccgcatctgcgtttcataaaagagcggtagttttacagtggtttcctaaaaaactcgccgaaattgctaatttagatgaattgcctgcaaatatccttcatgatgtatatatgcactgcagttatgatttagcaaaaaacaagcacgatgttaagcgtccattaaacgaacttgtccgcaagcatatcctcacgcaaggatggcaagaccgctacctttacaccttaggtaaaaaggacggtaagcctgtgatgatggtactgcttgaacattttaattcgggacattcgatttatcgcacgcattcaacttcaatgattgctgctcgagaaaaattctatttagtcggcttaggccatgagggcgttgataaaataggtcgagaagtgtttgacgagttctttgaaatcagtagcaataatataatggagagactgttttttatccgtaaacagtgcgaaaccttccaacccgcagtgttctatatgccaagcattggcatggatattaccacgatttttgtgagcaacactcggcttgcccctattcaagctgtagccctgggtcatcctgccactacgcattctgaatttattgattatgtcatcgtagaagatgattatgtgggcagtgaagattgtttcagcgaaacccttttacgcttacccaaagatgccctaccttatgtaccttctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatgcattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgtcttgaactccgtcgttacatcatagaaaacaacggcttacaaaagctttttacaggcgaccctcgtccattgggcaaaatactgcttaagaaaacaaatgaatggaagcggaagcacttgagtaaaaaataacggttttttaaagtaaaagtgcggttaattttcaacgagttttaaaatctctcaaaaatcaaccgcacttttatatttataacgctcccgcgcgctcacagtttatctctttcttaaaatacccataaaattgtggcaatagttgggtaatcaaatttaattgctgatacggtaaactaaagacggcgcgttcttcggcagtcatgtcttgtttttccaattcttttaaatgtgtttcgatactttcttgctgttggttaaaaatagcttcgggtatttcttcaatgtgttctaaggtataaataattttctttgcccaggataaaaccagataaaacctgtgcgggctgttgaaatttttcattctgcttcgatagcctcccgtgctgaatatagctattagagacaattcggttgagtgagcacacctttttggatgttgccgtgagtttcctggtccttattataggggaatggcgctgcgtcgggggcttttttgcatcggctttctgtcccttct

SEQ ID NO: 503 - DNA, 7347 bp, H. influenzae
  misc_feature (6850)..(6850): n is a, c, g, or t
  misc_feature (7186)..(7186): n is a, c, g, or t
aacattatgatgctaatcaagtaattttaggtaaaactatggctgaacatttacgcttggcggtgtgttattggcataccttttgctggaatgggaatgatatgtttgggctaggttctttggagcgaagttggcagaaaaatccaaatgtgcttgctggcgcagaacaaaaagccgatattgcttttgagtttttgaataagttaggcgtgccttattattgttttcatgatgttgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgaggggtatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaatacgttagttatgtatgaaattttaaaacatggcggttttactactggaggctttaattttgatgcgaaaattcgccgacaaagtattgatccttatgatttattttacgctcatatcggtgcaattgatgtattggcattatccttaaaacgtgcagcaaaaatgttacaagagaaaaccttacaaaaaattgttaatgcacgctatgcaggttggaatagtgaacttggtcagcatattttgcaaggtaaaacttcacttgaaacacttgcgcaacttgtccaacaaaaagatttagcaccaaaaccagtttcaggtcagcaagaatatttggaaaatttggtaaaccaagttatttatagctaaaaatgaagcaaagtgcggttgtatttcaccgcacttttttattttaggagacattatgtatataggaattgattgtggcacacaaggaacaaaggcaatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgcaccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattgcttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatgcaaaagcgagcattttaggattagattcaagtaatttcacacgagaaaatctttgtcgagcaatgatggaaagtgctacttttacgcttcgctatggcttagatttatttcgtcaagctggcctcgaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaagtgcttatgagcgttatttaatacatttatcacaattatattaaataaaatcccctatgccgataagctataggggatttactacattaataatttattttctattcaaccacgccatatattcagtcacgccttccgcgactgttttgaatggtttatcgtagcctgttgagcgaagtttagttaaatctgcttgagtatattcttgataacgagatttcaaatgctctgggaatggaatggtttcaatctcgccttttccgtggaatttcactaccgcatcagccaccgcacggaaactttctgcatttcctgtaccaaggttgtaaatacccgaaataccattttgccaacaccaaatattcactgcagccacatcgcctacataaacaaaatcacggcggaatccttcgctgcctgcaaataattttggattttcgccttttaagatttggttattcaagtggaatgccacactcgccattgaacctttatgattttcacgcggcccgtaaacattgaaataacggaaaccacatactggcgattttgcttctggcaaaatgttacgcacatattgatcgaacaagaatttagaatagccatacacatttaatgggccttcaaattcacgttcttcacggaatactttggtgtctccataagttgctgcgcttgaggcatagaaaaaaggaatttcacggtcaaggcaataatgcaacaactctttagaatattcgtagttgttgtgcataatgtatttaccatcccattccgtagtcgcagaacatgccccctcgtggaataccgcatcaatatcgccaaattcatcgcccgcaataatagaagcaatgaaatcttctttatcgcaataatctgcgatgtctaaatcaactaaatttgcaaatttcgtgccatcttttaagttatccaccactaaaatatctttgcgccctaaatcattcaatgctttgacaatattactgccaataaaaccagcgccgcctgttacaataatcataattctgtcctctttaaaataagtttgcgtattgtaatagattttctaccgcttagccaaaaaactctgcgaaaaacaaccgcacttttaatccccaataactcgtaaggcctgtcgtaacaagatccattttgcctttactcaacaacacaattgtgggtgtcacattaatttgccatcgttctgcaaattcccctttaggatcattaaccgtagtgaagtggtagtcatgcttacttaaataatcatttacgtccgcctcattgcctgagcgtaatgccaccgatacaacttgatagccttcgtttgctaaagaattaattgctggcgaagtataacgacaataaccacaccaagttccccaaaaataaagtaatgtgggtttgttttgatcaagactatcaagagagaacgtactcccttgaagatcttgtaacgtgattttatttatttcctttggcactacagggcgacgaacaaaatccagtatgctagttatcacaataaaagttaaaaagagggataatccattcttgagtaattttttaatcttcattttatttattccttatcttgttgagatgattgtaattgagcgtacaaccatagtcaaaaataaagaatttttgctacaataggtaaaacataaataaaaggaggaaaataatgacatcaaatcaacttgctcaatatatcgaccacaccgcacttaccgcagaaaaaaatgaacaagatatttcgacactctgtaatgaagcgattgaacatggattttattctgtatgtatcaattctggttatattccactcgctaaagaaaaacttgctggctcaaatgtaaaaatttgtaccgtagttggcttccctttgggggcgaatttaacctctgtcaaagcatttgaaacgcaagaagctattaaagcgggtgcaaatgagattgatatggtaattaatgtaggttggataaaatcgcaaaaatgggatgcagtaaaacaagatattcaagctgtatttaatgcttgtaatggcacgccattaaaagtaattttagaaacttgtttgctcactaaagatgaaatagtgaaagcctgcgaaatttgtaaagaaatcggtgtagcttttgttaaaacatcaacgggtttcaataaaggcggcgcaactgtagaagatgttgcattgatgaaacaaacggtcggcaatattggtgttaaagcatcaggtggtgtgcgtgatactgaaactgcacttgcaatgattaaggcgggtgcgactcgcattggtgcaagcgctggcattgcaattattagcggtacgcaagacactcaaagcacttactaatcctttcacgcgtggtattctttccacgcgtttttacatattcgacaatttctgcagcaaacgatccattgctcgatagcccaaggcctccgccaagtgcggttgagaaatttgttgttctccttgtagatcggcaatggttcgagaaactttcaaaatacgatgataagcccgtacagaaagcccaagtttattcagtgctttttcaaggaaaaaggcatctttatcatttaacttgcaatcacgctcaatctctttactgttcaaataagcgttgattttccccgctctttccatttgaatctcacgtacttttaacactttttcacgaacttgcacgctggtttcgccacgatcgcccgtattttgcaagctaccttgtggcagtaaaggcacttcaatagataaatcaaaacgatctaaaaatggccctgaaagtcgattcaaataacgcataatttgctgtggtgaagtgcggttatgtgtcccagtataatggcctgtagggcttggattcatcgctgccactaattgaaaacgagctgggaattgaatttttgcattggcacgagaaataataatctcaccactttccaaaggctggcgtagtgcatctaacacttttcgctcaaattctggaagttcatcaagaaaaagcgccccatttgttgctaaggatatttcgccaggtttagggatcgttccgccaccaactaaagccggcattgatgcactatggtgtggtgcgcgaaaaggacgttgcttccaattatgaaaatttaactcgttttgaactaaactcgttacagatgctgtttctatcgcttctaaatctgtcatttcaggtaaaatccctgtcaaacggctggctaacatggttttccctgtacccggtgggccaagaaagagcaaattatgctgccccgctgcggcaatggtcaatgctcgtttagcgtgctgttgtccgataatatccgttaaatctaacgtatttttacctgaaaaatttaccgcactttctttcacaatttcagtggcgaggggtaatttttcctgaccattgagaaattgcactacatctaaaagcgtttgagcaaaataagtattttgatcagacacgagcgaggcttcattagcattttgtttcgcgataattaactctcgctttgacttttgcgctgcaagaatagcgggaatcacaccatgtacgccacgcaattggcccgtcagcgcaagctctgccacaaattcaaattgctttaaacggcttgcatcaagctgatctgatgcagctaaaatcccgatagcaataggcaaatcaaatcttccgccttctttcggtaaatccgcaggggcgagattcactgtgatacgcttggctgggtatttaaattgtgcattcatcaacgcactacgcacccgatcttgtgcctctttcacggttttttctggcaaaccaacaagtgtaaatcctggttttccgttgcttaaatgcacctcaatggtgactagcggtgcttgcacacccatagaagcacggctgtaaacaatagcaagggacatgataatccttaaagtgcggtaaaaatgaagatagtttttgcactataaaaaaagcacgtaatgaaatcattcattccgtgctttttttgcgatctagatcgcaaaattcatattttatttcgcaaaaagtggcgaaaaccaaaaatctaatttcgccgcccatttatcaataccaattttatttttgngcagtaaaaagcctcaacttgtatatcgcctttgaaacggaagaattgcttcacgcaccatttttactcgtttactacgggcgcttttgcttaaattaatcggctatagttcgcactaaaaccaccatgtaaatttgctgaaaccgcccattacatcattggtgtgcccacactctttcagcactggcaccaactgtccatcgagcattactttcttctgcctttatttcccactactcgtattactttacctctctatccatctcactcatttctctctgctccccgagttctttatgtgtcccacattcttaattctttcactcgacttcgtcngagttcgtatttctatatcctcgctctatgttctattctgtccttaatgcccatcctctggctatggtcgttttcctttccctcggtgtatctatatcttaattccttcatccccctctgtatattcatcgtcatatgttcaccatctttcacttcctgtt

SEQ ID NO: 504 - DNA, 5019 bp, H. influenzae
gcgttttagaaaaatgatgaaaaagcgaccgcacttgtcgagcgttctgcgaaagccattgctaatttaattgctgatttagtgattagtttagatattcaaaaaatcgcgattggtggcagtgtgggattagctgagggatatttatctttggttgaaaaatatttacaagattttccttcgatatattgttgtgaaattgaaaccgctaaatttggacaagatgcaggtttaattggcgcagcttattgggtaaaagatgttttactggataagcctgaaggaacaatttatggctaaattgggaaatgtgttaaacaaaattggctcactttaccagagtttaactaaatcagagaaaaaaattgccgatacgattttgcgttcgcctgatttagtctctcaatgctccctttcagaaatcgctaaacatttgcaagttggagaagctacgctcgtccgtttttgtcgaaccattggttttaaaggtttcagcgagttcaaactagagctttctattgaacttgcgacgaaagataatcaagatgaaagcatacttgaaacagaaattatgccaagtgatgattcgctcactattgcacaaaaattgcaaacggcggttgctaatgtaatggaagaaacgattaatttacttgatttaaaacagcttgaagaagtcgttaaagtacttaaaaaagcacgccgtatttttttatttggtgtgggttcatctggcgtaacggctgaagatgctaaaaataagctgatgcgtattggttttcaagtggatgcttcaggtaataatcattttatgtatatgcaggcggcattattgacctcttctgatgtggcaattggtttaagccattctggttattctgctgaaacggcacataccatcaaaatcgcaaaacaaaatggtgcaacaacagtggcattgacgcatagtttgcgttcccccgtgacagaatatgctgattatgttttggtaaatggtaataaacaaggcaagttacaaggcgattctattggcaccaaaattgcacagctttttgtattagatttaatttatgctttgttagtgcagggcgaagaagaaattgccgctcaaactaaacaaaaaactctcaatgtaattcttgaacaacgtataaaataggagaaaacttatgcgtgatttaaaaggtattttcagtgcattattagtgtcatttaatgaagatggcaccattaatgaaaaaggtttacgccaaattatccgccataatatcgacaaaatgaaagttgatggcttatatgtgggcggttcaacaggcgaaaactttatgctttcaacggaagagaaaaaagaaatcttccgcattgcaaaagatgaagcaaaagatcaaatcgcactaattgctcaagtgggcagcgtaaacttaaaagaagcagtggaattaggtaaatatgcaacagaattaggctacgactgcttatctgcagtgacgccattctattacaaatttagcttccctgaaattaaacattattacgacaccatcatcgctgaaacgggcaacaatatgattgtgtactcaatcccgttcttaactggcgtgaatatgggcattgaacaattcggtgaactttacaaaaacccgaaagtattaggggtaaaattcacagcaggtgatttctacttattagaacgtttgaaaaaagcttatccaaaccacttaatttgggcaggttttgatgaaatgatgttaccggcagcctcacttggtgtggatggtgcaatcggttcaactttcaacgtaaacggcgttcgtgctcgtcaaatttttgaattaaccaaagcgggtaaattagccgaagcgttagaaatccaacacgtaaccaacgatttaatcgaaggcattttagcgaacggtttatatttaaccatcaaagaattgcttaaattagaaggggtggatgcaggttattgccgtgaaccaatgacatcaaaagcaacagcagaacaggttgcaaaagcaaaagacttgaaagcgaaatttttgtcataaatatttaaattagaaaaaacttaccttcctctgtttattccgttacaaacagaacaacaagtcagcaagcacttgctttcctctgttattccgttacaaacagaacagcaagtcagcaagcactttccttcccctgtttacgggggaaggtgcccgaagggcggaagggggcaacttctattgctttgtcgtaaattattggagcaaaagaatttctttttaaaaacaagatagaaaattaccgcacttataatgatcctttggtgaatggtgggctaaagtccagcctacgatatgaataggatcattacggtcaataataaaggaaggctaatatgcgttttattccattacaaacagaacaacaagtcagttgttgggctgcacaacatatcatcaatcgtatcaacgattttaaacctaccgccgagcgtccttttgtattggggttacctactggtggtacaccactaaaaacttatcaagaactgattcgactttatcaagcaggcaaagtgagtttcaaacacgtagtgactttcaatatggatgaatatgtggctttaccagaggaacaccctgaaagttaccacagctttatgtataacaattttttcaatcatatcgatattttacctgaaaatatcaatattcttaacggcaataccgatgaccataatgcagaatgccatcgttatgaagaaaaaattaaatcctacggcaaaattcatctgtttatggggggggttggcgtagatggacatatcgcatttaatgaacctgcttcttcattaagttctcgcacccgtattaaaacgctaacgcaagatacattaattgcaaattcacgcttctttaataacgatgttactcaagtgccgaaatatgctttaaccattggtgtcggtacattattagatgcagaagaagtgatgattttagcaacaggacatcaaaaagcactggcagtgcaagctgccgttgaaggcagtattaaccatttatggacagtcagtgcattacaaatgcaccgtcatttcgtgcttgtttgtgatgaagctgctcaacaagagttaaaagtgaaaaccgtgaaatattttactgaattagaaggctcggttgctggtacggattatcaggataaatagagatctattcttcatctttatgtaggggcgaattacattcgccctataatcacaaacaatcatagggcaaattgtccttacgtttaagagcaatatagttgctatgttaaactgatgttgatattaggaacagaatatgaaatacgcattaaccaacagtgtgatctacactaaatacgaaattctacgagattatgcggtagtaattgatagcgaaactattgaagcagtgatcccccaagctgaattagaaacaggtatcaaaaccattgatttacaaggtaataatttaacggctggttttattgatctgcaattaaatggctgtggtggcgtgatgtttaacgaccaaactagcgttgaaaccttggaaattatgcaggaaactaacttaaaatcaggttgtacaagtttccttcccacttttattaccgcgcctgatgaaaatataaaaagtgcggtaaaaattatgcgtgaatatttaaacaagcataaaaaccaagcacttggtttacatattgaagggccttatctcagcattgagaaaaaaggcgtacaccgccccgaatatattcgtgaaattacgcctgaaatgaaagattttctctgtgaaaatggcgatgtgattacaaaaataaccattgccgcagaaaacccaaccattaactatacgcctgattttgtgaaagcgggcattattgtctctgtaggtcattctaatgccacttatgaagtggctaaagccgcattccacaaaggcgcaacatttgcaacccacttacataatgcaatgtcgccaattagttctggacgtgaaatgggcgtagtgggcgcagtattagattctgatgtttacactggcattatcgtggatggtgtgcatatcaattatggcaatgttcgcattgataaaaaaatcaaaggcgacaaactttgtattgtgactgactctattgcagcggcaggcgcaccgccagaactagaaaattttacctttgtgggaaaaacaatttatatcaaagatgggcgttgctatgatgctaatggcacgattgcaggggcatcaatcacaatgatggaatccattaaaaatgcggtagaatatgttgaaattcctcttgctgaagccattagaatgagtaacctttatcctgcacgagcaattggtatagatgatcgtttaggttcggtagaaaaaggtaagatagcaaacttagcagtgtttacgccaaattaccaagtaatcggcacagtagtaaacggaaagtggaaagagaattaatagtaaatacttaaatagctaattgatttaaaaatctgtgatatatgtcacagattttttattaatattttgttacttataaaatagcctaaatatttatacacttttaacttaatcattttttaacttgattttaagcaaaaaaagcgaatctttcgattcgccttgcttttaataatgtatttctaacaaatgattagaagtaaacgcgtaaacctacacccactgatttttctttttcagtttttacgcctttagcttgctcagttgttctagttctagcgtaagcaccttcaatataggttaatacttgtttgtgaagtttatgatctacaccgaataacactgcttgttcacgtgtttttttaccttgatctacagaatcgcgttcatatttgaagttgccatagacattagtatcttccattaattcatattggaaacctggagatacgaaatagctttttatcgtgtttatctttatagtttttagtttttgcatagccactaatagagacactatagagggtaccgagct

SEQ ID NO: 505 - DNA, 4598 bp, H. influenzae
  misc_feature (2555)..(2555): n is a, c, g, or t
  misc_feature (2564)..(2564): n is a, c, g, or t
  misc_feature (2567)..(2567): n is a, c, g, or t
  misc_feature (2576)..(2576): n is a, c, g, or t
  misc_feature (4424)..(4424): n is a, c, g, or t
  misc_feature (4442)..(4442): n is a, c, g, or t
  misc_feature (4446)..(4447): n is a, c, g, or t
aatcagctttaatcagcacagcatgatgccccaacccttcgtcaaaggtttgagcaatttgatgataaattggcattagccaagggtaaagtgcggtcatttttcctgaaatttttgtaaataacgagggcaattatacacattttcaaactggcttgacaaaatagcaaaaagcaaacgtttacttttaataaataagaaataaatagaaaaaatttgaaccaaatggtatttttttgttcagttttatactagaattcacgccccatttatttttacttgacaaaggaaaatttattatgaaactcgaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaagtttagtagtaacaaaaaatcggcaggaaaattttctgccgatttttttattctgaaagtgcggtcatttttcgtttgatttccaccaattttttaccgaattttcaattccagccaatgtagggtgggcgtaagcccacgggtattattaataccattctttttttngtgggcttncgnccccccttncccgactaaccttacaagctacattcaatcgccaaacaggcaaacatcatcacgctaaacaaggtgcgctgaatttacagtggacgttttaagttaagttgtaacaaaaaaatcggcaggaaattttctgccgattttttattttaaaagtgcggtcatttttcgtttgatttccaccaattttttaccgctctttcgatatcagcttgaacaagttcaatactctgctcagcattaattacgactgcttttggattctcttttactaacgctaaatagcgtgctcgagtgcgatggaaaaaatctaaatccatttgctcaatacgatctaattcaccacgtccacgagctcgcgctaaaccgacaattggatctatatccaaataaattgtgagatctggctcaaaatcacctaatacggtttctttcaaagtaagcataaaatgcggatctaattgacgtccgccaccttgatacgcctgagatgacatatcgtgacgatcgcccaccacccatttcccttgcattaacgcaggtttaattatgttatccaccaactgaatacgagccgcataaagcattaataactctgctttatctgtcacgggttcttcggtttcatgtttgatgagatgacgtaatttctcagccagtggcgttccacccggttcgcgtgtaaacacgacatcttgaataccaagttcatgcaagacttgcacaacagactgatgagcggagcttttccccgcaccttctaagccctcaatgacaataaactttcctttcatattttcttccgcacttttatttggcatttttctggctgcgataccagcgtaaatattcttgcaccgctttgttatgttcattcaaatttcgggtaaatttatgcccaccagaaccatctgccacaaaataatagaaatctgttttttcaggttttgcaacagcctgtaacgaactttcacttggcatagcaataggcgttggcggcaatccatcaatcacataagtattataaggcgttggggtttctaaatcttttttacgaatattaccgctgtaattctcacccataccataaattaccgttggatccgtttgtaatttcatttttgcttttaagcggttgataaatacagaggctacttttgccctctcattagcaatacccgtttctttttccacgatagaagccaaaatcaacatttcataagggttcgccaaaggtaaatcctcgtcgcgctcgttccaagccttatttaacgcctttttcattcgctcagccgatcgcttaagtagctctaagtctgtggatttaggcgtataattataagtatcaggataaagccaaccttccacattttttagttcaagattttgaccaatatcaggcaagtcaagtaatgtgaaaatttcttcgttactcttatctttcaaggtttgcaccaagtgcggtgcattttcaagatcttttcgccaatctttaaaggtttttccttcaatccattttacattgaactgcacttctttaccggaattgagcaaatccagtaaatcttgcacagttttaacattctcaagagaataagtccctgcttttattttatttagctcaggtttcaacttaagcaaataaggcaataatttcccatcatcaattaacttttcttgctcaaaaagtgcggctaattttaaacctgttgtgccacgttcaatagttaaaagttgatctgcctgcacatttactggtgtttttacaaattcagtcattttgtaataagcaaaactcgccacgcccgctaaaataaaattaaaagtaaaatcgcaattaaaaaattcttcatnagctataagaaagagaanatannaaacaccaaaggggcaattaagcccctttatttttgatactttggtatttattaaaatactgaatattcgctcttttacgcaatgcttttacccaatcgttcgtcgcatcttggaatttgagaatttactaaacgttcatatgcttttggg

SEQ ID NO: 506 - DNA, 5070 bp, H. influenzae
caggtatacgaatatcggactcggtacccctcatttcttatgaaatggttttgactattaaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtgcctgtggcattaaatggcaaacattttgataatgctgttgatcttattctagaagccaatcgtattggtgggcgtcacggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccagttgatcgtatcggtcaattaacaatgcgtaatttagatgtatcagacacccgaggtaaacttggcatctatgcacaaacaggtttattaagcgcaattaaagattccgtattgccacaattaggcaaaaaataaataataaaatctgcatttcaatgactgatatttaacatcatgaaatgcagatcctttcacaaaatattagttagctaaaaaaactagaaatataagaaataatcgtttttccacttaatattgccataataatcacaacaaaccagcctgaaaaagctaaaaaaacagggtgtttataagtgccaacaatatcacttctgtaagcagctaacaaaattaatgccaatgcaatcggcaatattaagccatttaatgttcccacaaagactaataccgcagcaggcttttccacagtgactaaaacaacagtagaaatcacaataaaagcataatccaacgattacgattgcgttcaatggttggacaaagggtcgttaagaaagaaactgaagtataagccgcaccaataacagatgtgacagacgctgcccaaataaccactccaaataacacttgaccaaaattgcctgctacatattcaaaaggcgtttcagctggatttttaggattaagagacacaccttttgacaccacgccaagcaccgcaagaaataatacaacacgcattgttgaagcaattaaaatggctgatacagaactacggctcacttcagccattgctttttcgccttgaatgcccgcatctaataaacgatgcgcgcctgcaaaagtaatataaccgcctacggttccccccactaatgtaacaatagcaataggatcaattttttctggaataaaggaatgatacgctgcttcagccacaggtggttcagttttaaacattacataaaatgtgagcgcaaccataataaagcccattaattgcgcaaaacgatccattaataagcctgcttctttacgcaaaaaaatcaaaatagcaataataccactaatcactgcgcccatttctggtgctataccaaaaatagaatttaaaccaagccccgcgccgccaacattgccaatgttaaaagccagcccgcccatcacaatcagcgcagcaagaaaataccctgctttcggaaaaaccgcattagaaatatcttgcgcgcgtttgccagacacaataacaattcgccaaatattaagttgagccccaatatctaacaaaattgataataaaataacaaagccaaaactcgctaataaagtatttgtaaaggttgcggtttgagttaaaaatccagggcctatggcggatgtcgccattaagaaagctgcccctaaaaccgcatttcgtctgtgagtaattgatgccataaagcacctccattgttaagttgatgttatgtgtttattcggcttatgccgttattttgatatgatttttttctaattcttccacaatgcgtttagcaaattgtaaagaatgttgattatcgccgtgtaagcaaatactttctgcttttacaggcacaaggcttccatcaatggcattgacttgcccctttgttaccatttgtaacacttgttgaatggcttccttatcagattccaccattgcatttggttgagaacgaggcaccaaactcccatcaggcatataatgtcgatcggcaaaaacttcagaaatcgtttgcaatttttcttcctctgcgatgcgcaacattaaactgcctgctaaccccattaatttcaaattcggatcaaattgataaacggtttgtgcaattacacgcgctattttttcatcttttgctgcttggttatataacgcaccgtgaggtttaacataactaattaccgccccctcgccatcacaaatcgcttttaatgcccccaattgataacgcaaatgtgcgattaattcctgtgaagacaacgccattgccgtacgaccaaaattttcgcgatcaggaaaactaggatgtgcaccaatacgcaccttattttctttcgcaaatttgaccgcactttgcatttcctttgcgcccccagcgtgtaagccacaagcaatatttgcagaagaaagcaactgcaataaactttcatcaaaaggaaaaccctctgcaatatctgcatttaaatcaatttttttcatcaacaattctcctaatttgatcaaggtatatttcatttttacggcgtaatttagcagcctcttgtaagctaaccgcttcaaatttaatcgttgaacctaaacgtacctgtgccaaagccccaagatcagcatcaatcacattagcgattttaggataaccgcctgtggtttgcgcatcagccatcaaaataataggctgaccacttggtggaacttgcacactaccaaactgaatggcgtgagatagcatttccaacggctgctttaattctaatgtctgaccttgaaaacgataacccatacgatcactgttactttgcaacgtccattcatttcgccaccaataatattgggattttcgtttaaacgcctgatattcagaagatggcaaagcacgaataacatctcgaagcggaatcggtgcaataccaatttcgctacgcaaaatatgatcatttgccgtttgtagttgatcgcccgcctgcaaacaacgcccctcaatgccccctatttccgctctcaaatccgtgctgcaagaattcaatgcttgaggcaaaacaaaaccaccttgaacacataaataaccatacattccaatttttgcacgtgtcatttttaatatttgacctgctcgcacttgataacgccaataagcaaaaacgggcttatcatctaacatcatttcataaaaagcaccagtcacacaaaaattcatatcttgctgaaattgcaatgtaataccgcctaaaggcacttcaatggcaggaacattctctgcattgcccaataaaatattgcctgcgcgtaatgctaatttatccattgccccacaatggctaatgccaaatcggcgtaaaccaaaacgccctaaatcttgaatggtggcgcgggatttcacatcaagaatatcaatcatagttcaatcccatccacaataaatttcacagtatcgccagcttgtaataaggttggttgtgcttgatttttatcaaaaagtgcttgtttagtataaccgatcaactgccacccacctggcgaagaaaaaggataaatccccgtttgcgcacccccaataccaacagaaccagcaggaacaaccgttcttggcgtggcgcgacgcggcgtgtgtaaattttcaggtaaaccacccaaataaggaaagcccgcttggaagccaatcatatacacagtataaataggctcactgtgcatctgaataatccgctttggtgttgtctgatgaaatttcgctacatcagataaatcctgacctcgctctcccccataaataacaggaatttcaatatgacgcccttgaaaatccgatactttcaactcagcccaaagttgttctaaacgttgcacaagcggcttaaaatccacgaaaaaatcggtaaaaaccgtaagattattcattcccaagacaacttctacaatatcttgttctgattgcaattgacgagcaaacgcccataattggcgttgttgttgaatggaagctgggggtggcaaagagcaaaccaccgccgattcactgatcggaacgatattcataagataccctttatatgatgttatgtgatttgttatttttttgttacagctcttttaaaggatatttataggttttgtcaagtctttattttttatttaaaataaggtttaggtttgtttatcttttatttctttttagcaagaaaaaagattaatcttgacccattttaggtgttttttgttgaaaagtgcggtaaaaattaaaagaaaaacctgctttctggcattgaaagcaggttttaggcaaaagggaacggcaatttattgaagtatttcgcccacaatactgcgagttgcttctttcacttctgtgagtttcactttcacaatgtcgcctattttgtaagtgcgttcgcctttaatataaagggcaatctcatctgaattcacctgcatttcttctttattattatgtaaagtggacgcaggtataaacattgaggcgccattttctaataattgcacacgtaatccaccacgcattacatcttgcacttctgcattaaattccacattttcagccacttcggtgcaagataacggcaatatagccaatctgcaatatcacgttctacgaggcgattttggcggcgagcctcttgcaaacgtgccaacacgtcatttgtgttt

SEQ ID NO: 507 - DNA, 5360 bp, H. influenzae
ctggtatacgaatatcagactcggtaccccccattctacctgagtgcatatcacgataacgcgcacctggagtaggcatatcgaccgtaaacactaaagtagaacagcctgctgctttcgcacgctcaagtgcgtttttcataaaaccacgatcttttaacacataaagctgaaaccacattggacgcttaatcgcaggggcgacttcttcaattggacaaattgatactgttgaaagggtaaacggcacacctttattatctgccgcttgtgctgcttgtacttctccacgacgtgcatacattccgcacgccccaactggtgcaagaatagttggcattgaaagtttttcaccaaataattctatactagtatccaattcagacatatcttttaagacacgttgtcttaaagcaatattttccaaatcactcacattacgcgcaagtgtttgctcggcataagaaccgccatcggcataatggaacataaagggaggaacacggcggcgcgccgcttcacgataatcgctagctgatgaaataatcatttttacctcttattcaataaaatagtgagaaacctgagaggcattataacactattttaacaaattcaataaaaatcataattattttgagaactagatcacaatttattttaaaaaagtgacatatagaaatgatataagtagaaaaatcacctataaaattaggaaaaattgtgaatttatcaatatcacacaattaatctattaacttttaatctattttgattacttccaaagattcaaatccccatagatgtaaagcttttttaaattgagattcttcgggaaaatgtgcggtgcaaaacatttgattatatttttcattttgcacttgtagatttttatcatcaagtaaatatttgatccgtttagcaattgctgcgctcggatccataaaatatttaacttgtggcaagcataactgaatttcatctttgatgagaggaaagtgagtacaacctaaaactaatgtatccaaatctgccatgcctgcccacgaagataactcatcttttaaactaatgagatcaacggaatgaccacgaattttttgctccgcaatttcgactaattttgtcgttcccagtctctcaacaatacaatcttgcgcaaatttatcaatcaactcatcgatataatgacgctttactgtaccctttgtagctaataaaccaatatgttttgtctttgttatttctgatgcaggtttaatagcgggaacagtcccaatgataggaatctcaaaagcagctcgcaaaggcggaagcacaacagtactcgctgtattgcaagctatcacgattgcatctaatggataacgttgattaataagctgacacgccgctaaagtgcggtgaataatactttcttcttcgcgttctgaataagggaatcccgcattatcaaagcaatagagataatgccaattgggtaataattttttagcttcacggtatacgctaaacccacccactccagagtcaaaaaaaagtacagttgggcgtttttcttttttatccatttaaaactctttgaaaattgaccgcacttttaagcgttcgagtaaatttctttattattgagccagcgacagattaggctttctgccacatcagggtatttttggataagtgatttcgcataatgttgcaccgttggtatcatttttctatctcgcattaaatttgctattcgcaattcagcaattcccgtttgtttcgttccaagtacttcacctggcccacgaatttctaaatctttttccgaaataacaaacccatcttggctatctcttagcacttgcaaacgcttttgcgaaactttacctagcggaggtttatacattagtacacaaaaagaagccgtgctgcctcgaccgacgcgccctcgtaactgatgaagctgcgataaacctaaacgttctgcattttcgataatcatcaaacttgcattcggaacatcaacccccacttcgatgactgtcgtcgccaccaataaatccaattctgcatttttaaaacgcatcatgacatcttgtttttcttggggtttcatgcgcccgtgcactaaaccaatatttaacatcggtaacgctttcgttaaatcttcccaaatcgcttcagctgcttgagcttctaacacctctgattcatcaattaacgtacacacccaataggcttgacgtttttcattaacacaagcgttttttacacgcatcacaatttcagcgcgacgttcttcagaaaccactacggttgttatcggcgtacgacctggaggcaattcatcaataattgatgtatccaaatctgcatatacggtcattgccaacgttctcggaatcggtgtggccgtcataattaactgatggggatgaaatcccgctttttcgcctttttcacgcaacattaatcgttgatgcaccccaaaacgatgttgttcatcaataatcactaatgctaagtcggaaaactcgacttcttcttggaataaagcatgcgtccccaccaccatttgcacggcaccagttttgattttttcaagctctgcttgtcttgattttccttttactttacctgccaaccagccaacttcaataccgaaaggctcaaaccaccgtctaaaattattcgcatgctgttctgcaagaatttctgttggcgccattaaggcgacttgtttgccattatcaattgcagttaaagcagccaatgcggcaaccaatgtttttcccgagcctacatccccttgcactaagcgcatcatcggataatctttgataagatcttgttcaatatcggacactactcgcttttgcgcattagttggttgaaatggcaaggtggctaaaaatcgctgtttcaaatctgtttgataatgtagcggtaaggcagaaaattgttgcgttcctaaccgcactttttgcatagctaaattatgtgccagaagctcttcaaaaattaatcgttgttgtgcaggatgcttaccttgctctaacatttctaatgaaatatctggcggcggacgatgcaataatcgcaatgcctcttttaagctatattgatgtggattaaattcattaggcaaaatttctgcaatctgaaccttgtcgagtaatgtcaaagcctgatccgttaattttcgtaatgaattttgttttaacccctccgttgtggaataaatcggcgttagggtttcttccaatactatgggcgcattatctcgcacaatttgatattctggatgatgaatttctggcatatggcgaccacgtttcacttcgccaaaggcctttactcgcacacctgcttgaaaactattacgcattcccgcattaaaattgaaaaaacgtaacataattttcgatgtgccgtctgacaaacttaccgataaaatcgggcgacggccaaaagcgacttcacaggtttgtacaattccctctatagtaaaatattgttcagggcgaagattagcgattggcgtaattcgcgtacgatcttcatagcgaataggtaaatgaaagagtaaatcttgcagattctgaatgccgattttagccagtttattagaaatggcagcccccacaccagaaaggctggtcaaaggcacggcatcgagaagttcaaggctcatagctcattaatattgcgtttgacattaacgacgccagtgatgcctttaatacgatgaacgatattggcaaggtgtttgatatcttttacacaaacctgcaaaatcacaagcaataaattgttctctaattcttccgtccaaatattttggagactgctttcgctcgctgaaattgcggtcattaaactaagcaaggcattctgctcattcaatatttctatttgtaattcagcctcaaaattcaccgcactttgaacgttatcccatttagccaacgattgacgacaagcatttttcaaacttgcacaatgttgatggtgtaccacaactgtatttttttctgtacaacatcccacaataggatcacctaggattggatggcaacattgcgcaaattgtgttttacccacttgcattggtgcaatagtgagtatttttgattcaaattcgagattcttagtattagcagattctaacggcacgcccacaaattgatgcgcaatcatggaggctgactgattacctaaaccaatttctcgtaataattcatctaaagaagaaagggctaaagcatctaatacagtgctaatttgttgaatagaaaaatcacctaaattatgcggctgcaatgctacattaagctcaacttcgcctaatttcaccgcatcctcttcacaacgctgtttgagataatggcgaatccgtgttttcgcacgagccgttaccacaaaatttaaccatgcgacttcaggatgcgcatttggatcagtaataatattgactgtttgccctgattcaagggcttttgaaagtggataaggtttatgctcaacagtcacgccaacacaagtattccccacatctgaatgcacagcataagcgaaatctactgctgttgcgcccattggtaattcaacaattcgaccttttggcgtaaaaacataaatttctttcgggaaaaactctgattttacattctcaataaactcaaacgaattacctacactttgttgaatttcgaccaaactttgcaaccagcgttgtacgcggatttgtgcggttgtactatcgtttttaccattttctttataaacccaatgcgcagtaatgcccatttcagcgacttgttccatatcctcagtatggatatgaacttctacgggaactcctttcggcccaatcattgaagtttgcaaagattgatagccatttgctttaggtacggcgatataatccttaactcggcctggacgtggcttataaagattatgcatttgccccaaaatgcgataacaatcatcaacatttttcacaatcacacggaacgcataaatatccataatagagtggaattcttgatcctttatacgcattttttgatagatcttataaagatgtttttcacgtccccacactcgggcaaaaatgcctgcgttttctaaccgcactttaatctcttgtgaaatacgttcgattaaatcttgtcgattactccgtgccacatcaacgagtttttttaacacctcataacgatgtggatgcattgcttgaaaagataagtcttctaattcatttttgatatgctcaatacctaaacgatgagcaagcggacaatagatttcaagcgttctttcgcaatacggcgacgtttatctggtcgtaacgaaccaagcgtgcg

SEQ ID NO: 508 - DNA, 5365 bp, H. influenzae
atccccaccgctgttaatcaaatcataacgacgaattggtgctttcatatacactttatttgaccaagtaatatcgtaatttggtatcgtcatatcaatacctaaacgagcaatccaatcttcagtgttactattaacttgtcgtaacatttcacgataagtcattaatttaccatctaaagaaacaagtttatttagatcaaattcttcgccatcagctcgttttgtatttaaccaatcaaaaccaagtgacgtagtccaataagttttacctaatttccaaggttctatattgttaagttggaaagtataaatatcaacaccgaatggacgtccattgatataactagtttttatgttttcccttatagtctctcgtttcaatatgatacgatttttattatcacgatgaatataaccgagtttcagtgctaaattacccatattttggtcaaaacttaaacttaattcatctgcataagggctttttagggatgaaaagttctgatgctgacgtgttggattattattaagctttaaaataccattcgctaattttaacgaagcaaaagaacgaccgtaataacgatttaaacctagtgtaaatcctgtattatcccaaggtcggtaacgtgcaacaaaacgcggggcaatattattgttttttaaataatcattacgttcaatgcgaatgccaggtcgaaattcaaatttacgccatttaattaaatcttcagcataaatagcgatattttgatagctggttttaacacgacttttggtgttgtacttttatctgatctgaaaatattcatactcccatcactttgcaaagtagataatgttatttttgaatgaacatcttgtggacgatagaattgatatttagttgcctgataaattccaccaatagaaacagaatgctccgtagaagctaaataaaaaggatccattacatattcagtagaaaaatgtaaattatcttgggttaaacggctattaccatgcccgcctttttcaaaattataaagcgcttcataatattcatctaacacagatgttgtttcaacactatttgaggatgatttacgcttatctttaaaacgatcgtatgctaaggtatttgtccaaacgccagagttgaatgaatgcacccaagctagtgttgtccccaatgcttgatgataatcgcttacgttgttatttatattttcctggaaatatttcaattctttataatttgaataacgtaaaccgagttcaatacgttctttttcttgcggtgtccaattgaaatttaataaaagattatcggaaagtcgttgatgattttgtttgtctaactgtgctttattattggcattttgatcaaagccaattaaacgattttgttcaatagatgatgttctacggctatagccaaaaaccattcctaaattatcatttagccttttttcagccaaaatattgaatgtttgtttatcatatttaggttgtagctctgccactccgacaagatctggtcttacttgtttaagtattttttgtactgagtctccagcttccatttttgcccaagaggaatttgtcgtgcgatatttaagttttatgctatcagtgccgctatattgttttgttttggctataacggcaccccccataaatccccctaagctagcagaaatattactatcttgtacctccactttagaaagcatagtcgcatcaaagaaataagcttgagtgtgactaattccgggtacaacttgcatagaaccatcaaaaatatcgctatcagcagtaagttcattatttatattgacattatcaacaaaataagcagtttgatttggatcggcaccgttaattgaaatattttcaggcttgatttctccacgttgaaaaccatcttggtcgctattttcataacgaatatggggattagaacgaagataatcagtgatattaccgtttgatgtaggcgttttacttatctcgtcagaagagagtgttttaacggaagaaagtgatttattattgtcgccatacacaacaatttcgggcaatatatttttgttggttgttggttgttggttgttggttgttggttgttggttgtttcaatagttttccccataacaaatggactaacaaatgttgtgcagaataacaacattaatggctttttttgatacatagtatagttccctaaaataaaagatataaataagaatgattatcattatatttttaaaatttataaatgcaaggggaattcgacttaaaagaggtatcaaagaaataaaaaaaccgcacttttaaaagtgcggttatattcaattctgttttatggaagaaattattctacgccaaccattacagaagttgctttgatgattgcgtatgcttctttaccaacttctaagtttaattctttaactgcagctaaagacacagtagaagaaagcacgttaccgccaccgatatcaatgtgaacgattgcatttactgaaccgttttcgattgaaacaactttaccttttagttggtttcttgcactaattttcataacatttccttgttagttagggtttaaaagagcctgtgttttatcttacaaaaaacaagtcgttaataaactaagcgtttaaaacttttaaaaaattgaccgcacttttataggcattttgcaggtttcggcaaacctgctaattttgtagcttgttttgcagggccttcaggaaataagcgttgcaaatagcggctattacctttatctgcaccaagcttttcagccatggcttttaccaacatacggatggctggagaggtgttatattcttgataaaagtctcgtacaaagtaaatcacttcccaatgggcatctgttaattcgatactttctaaccgagcaatagcacgagcgacatcttcgttccattgttggctgtggagcaaataaccatctttatcagtttcaacttcaattccattgatattcaacatattaatttacttctttaaagttaatcatttcgttgtttgaaaaatcagtttgatcttcgtcttcaaattgcattggtgtgattttttcttcatcaaatgctgtatcgccttcaatgccatcaattagttgtccatgtttgattcctttgaaatcaaataatttcggatcacacatatgtgacaatgtaatgttttgcattgcactgaacatggtttctaagcgtcccggatattggcgatcccaagtattaagcatttcttttacaacttggcgttgaagatttggttgtgagccacataggttacaaggaataatcggaaattccttcgcgatggcatatttctcaatgtctttttctttgcaataagcaagcggacgaatcacaatttgtttaccatcgtcagaaatcaatttaggtggcatggatttcattttgccgccataaaacatatttaaaaatagggtcgctaacatatcgtctcggtgatgtcctaaagcgattttggttgcaccaagttctgtggcagtacgatataaaattccacggcgtaggcgagagcagagcgaacaagtggtttttccttctggaattttttctttcacaattccgtaagtattttcttgtacaattttgtaatctacgccaatgctttctaaatattcaggcaatacgtgttctggaaaccctggttgtttttgatcgagattcactgccacaatatcaaatttaatcggtgcattttgctgtaaattcaacaaaatatcgagaagcgtataactgtctttgcctccggataaacacaccatgactttatcgccatcttcgatcattccaaaatctgtaatggcgttgcctacgttacggcgaagacgtttttgtaatttattaaaattataggtttgttttttttcttgttgggctaactgggtcattctgttatctttagttattcatgaaagtcgcacattatacgtgaaaaataggaaaagtgcggtcaattcaaaagaagatttttaagatccgcaaaaaatcctgtataatctttccaattttttgttcaattttaacgctttgcaattcaatgattgaaacatcccaaactattcctgaactcgtctcttgggcaaaagatcgcgagttttctttgaatttacctaccgaacgcttggttttcctgctggcgattgcaatttataacaacgaacgtttagacggcgaaatgttagaagccgatcttgtggatattttccgccacacgatgaatgcttttgagcaatccaccgatgccattgcaacacgagcgaataatgcaattaatgaattagtgaaacaacgtttgttaaatcgttttagtagcgaatttactgagggcttggcgatttatcgtttaacaccattaggtgttggtgtgtctgattattacattcgtcagcgtgaattttccgcattgcgtctttcagtgcaactttccattgtggcagatgaaattcaacgtgcttctgattctgcggaagagggtgtggagaataatgaaagtgaacattattggcgtcgtaatgtgtttgcgccattaaaatattccgttgcagagatttttgatagcatcgatctttcacaacgtattatggatgaaaatcagcaaagtattaaagatgaaattgcagagcttcttactaaagattggcaagcggcaatttcaagctgtgaacgtttattagatgaaacatctgggaatttgcgtgaattgcaagatacgctaaatgccgcaggggataaacttcaagcgcaattattgcgtattcaagattgtgtgattgggcgagatgatttgtattttatcgatcagttgattacggatttgcaatccaaactagaccgtattattagctggggacaacaagccattgatttatggattggttatgaccgccatgtacataaatttatccgaactgccattgatatggataaaaatcgtgtgttctcacaacgtttacgtaattctattcatcattattttgagcatccttggttcttatggacagcgcaagctgagcgtttagtcgatctgcgtgatgaagaaatggtgctgcgtgaagatgatgctttaggggaattaccagaagaattgcataccaatccctttctgatttacaccatcaaattgtagagcatatggcaggctttactgtatgtttatcgttgaaataaccggcccaatgattcgagtttaccgtcacaagaacaccggcaaaattatccctttctttgtattctgaagcggcccaataattgttgatcaaaccacacccttggtaggcgtaagatatttatccgcttttttcccattggcagcc

SEQ ID NO: 509 - DNA, 5458 bp, H. influenzae
tggtatcgaatatcggactcggtacccaagtatgcacaaaccaagctgaaatcgaccaaatcatgatcgatttagacggaaccgaaaacaaatctaactttggtgcaaatgcaatcttggcggtatctttagcaaacgcaaaagcagctgcagcatctaaaggtttaccactttacgcttacattgcagaattaaatggcactgctggtgtttattctatgccattaccaatgatgaacatcattaacggtggcgaacatgcagataacaacgttgatatccaagaattcatgattcaaccagttggtgcgaaaacattacgtgaagcacttcgtatcggtgctgaagtattccacaaccttgcaaaagtattaaaatctaaaggcatgagcactgcagttggtgacgaaggtggtttcgcaccaaacttagcctctaacgcagacgctttagcctgtatcaaagaagcagtagaaaaagcaggttatgtattaggtaaagacgttactttagcgatggactgcgcatcttctgagttctataacaaagaaaatggtatgtacgaaatgaaaggtgaaggtaaatcattcacttctcaagagttcacacactatcttgaagaattaactaaacaatacccaatcgtgtctatcgaagatggtcaagatgaatctgactgggaaggttttgcataccaaactaaagtgttaggcgaccgtgttcaattagtgggcgatgatttattcgtaactaacaccaaaatcttaaaagaaggtatcgaaaaaggtatcgcaaactctatcttaatcaaattcaatcaaatcggttctttaactgaaactttagcagcaattaaaatggcgaaagatgcaggttacaccgctgtaatctctcaccgttcaggcgaaactgaagatgcaactatcgctgatttagcggtgggtacagcagcaggtcaaatcaaaactggttctatgagccgttctgaccgtattgcgaaatacaaccaattaatccgtatcgaagaagcattagaacgcgctggtactccagcagcattcccaggcttaaaagcggttaaaggtcaagcgtaattcacgctgaatttactgtaaaatctcaccgcactttgtataaaagtgcggtgtttttatatctaatatttaaaggaaagagaatgttacatttaactttagaggacgaactctttttaggaacgccaaagcaagtgggaacacattcgacagtatttgagcattttgccgtaatgtttgaagatgacggcgaaactggctatttttatgcgctcgatatgcgtcaaaatgctcaaccgatagtggatatgttgcacgtgtataatgttgattcaacctctaatcatcatgaagcacgcaaacttgaaatttgttgggatgagagtggttatttagccttgttgcttattaatggctatcctcatgctgtatttgattttgcccgtttagtcggctataacagcaataaatatccacaaccagatttaatgagtatgtggactcgtgaagaaattactaataaacaggctgagcaatggctaggcgtgaaaaccattcgataaaaattgagaacaatgaaaaagaaaaatcagattttagttagtttatctattgtggccttattaggaggctgttcagaagagcaagtacaacgtgatgtgtatcagtctttagacgattgtttagcggattggaaaaaaattgagctttgtgaggcagataaaaatactgaaagtactcagaaaactgaaactacaccacagcaggggcttggtttaaatattcgtgataatggtaatgcagaaagtgcggtaaaaaatccagctgaaaataatgtacaagctaatcaaagcgagaacaatgctgaatcaactgcaaaagctgaaagtaccgatccttctttaggagccgcaattgctggtggcgttatagggtatatggcggctcgtgcaattagtagtttccttggcccaagctatcatcctggaaatcgagctgtcaccacaccaacagggcaagttgtgcaacctcaaacgaatcgttctgttggaaaaccaatgctcgtgaaaggaaatgcaggaagcatgaatagcaaacctgtatctcgtggtggttttagtagcccaaataatactcatcgtagcagtgggggctaaatgaaacgtgtaactgggtttcctactcgaccaaatatggtgcaacagctacttaatgttggatttgattattataacttgccttccagtgatggatctcattattggtctgataatgttgcctatgaatttaccttagcggaaattgatcgcattgaggatacaactaatgaattgcattcaatatgtttagattttgcggcggatgaaattaaaaaaggcgattatgaaaattatcattttacggagttgcaaaaacagcttgttgaaacctcttggcgtaatcaagatccttatttatatggacgctttgattttggctatgatggcaacaacctaaaaatgtttgaatataacgccgatacaccaacatctttgttggaggcagcgattgtccaatggcagtggttggagcaaattgagggcttgaaacatcgtgatcaatttaactggattcatgaagaattaataaaacatttccaatttttgaaacaacaaagtggcaaaacagatttccatttgagtgccatgcaggatgctggccgtgaagattggggcaatgtggattatttagctgatgtggcttataacgcaggttggaatattcatcaattagcggtggaagatattggctataacagcgaaacaaaaaaatttgtagatttaaatgatcaacctattgaaatgttatttaaattgtatccgctagaatggctaagccacgctgagtttgctcgccatattacaacggctgaaacacgatttattgaaccagcgtggaaaatgttgttaagtaataaagcactattggcaaaactttgggcgcgttatcctaatcatccgaatttattgcctgcttattttacgccttttgaattaccaaaagatttattgatgtgggtgaaaaaaccattgttaggtcgagaaggtgccaatgttttctattatgagaaaaataatggtgtagaatttgcagcgaaaggaagcgaacactcaacgttttatgctaattcaggttatgtttatcaacaaaaatttgaattgccaagttttgatggaatgtatccaattatcggctcttgggttgtgggggatgtggcttgcggtatgggattacgcgaagattttactgcagtgacggggaatgatagccattttatacctcattattttgtgccatgatatatatttagcattacttaaatacaatatttaccataaaaaatggaagctattataggttatttttacattcaaatttttgaacgattacaaaatcgttcaagtattatgtaatgaattagtaatatttcattgaaaaaaatctgcaccctaatcagttaaaccttagcctaacttttgggtgcagattcattactactattatttatttaaaataattaactcgaaagattataacaatccaccttgacctaatgcaggatcagtatcacgagcttttaatgcatcttcaacggttaaacctaatgctttcgcaacgccttcaccgtatgcggcatcacaccagtggcagttacgaatatgacgatatttgatgaaatcaggcgcatcgcccattgctgctgccgtgttgttgaataatgattgtttttgatctgcattcattaagttaaataatgcacgaggttggctgaagtaatcgttatcatcgttacgataatcccagtgtgctgcatctccgttgatacgaagtggtggttcagcaaagtctggttgttgttgccattggctgaagctgtttggctcgtagtgtggcaagctaccgtagttaccatctacacgaccttgaccatcacgttggttgctatgaacagggcaacgtggacggtttactggaatttgacggtagttcacacctaaacggtaacgttgtgcatccgcatagttaaataaacgagcttgtaacattctgtcagggcttgcgccaatacccggaaccaagttacttggtgcaaatgcagattgttctacatcagcgaagaagttttctgggttacggtttaattcaaactcgccgacttcaattaacggataatcttttttcggccacactttggttaggtcgaacgggtggtaaggcactttttccgcatctgcttctggcataatttgtacaaataatgtccatttagggaaatcaccacgttcaatcgcttcatataaatcacgttgatggctttcacgatcacttgcgatgactgcagccgcttctgcatcagttaagtttttgatgccttgttgtgtatggaagtggaattttacccaaaaacgttcgcccgcttcgttccagaaactataagtgtgagaaccgaaaccgtgcatatgacgataacttgctggaataccacgatcactcattacaacagtgacttggtgtaatgcttctggtaataatgtccagaaatcccagttattagttgctgaacgcatattagtgcgaggatcacgttttactgctttatttaaatctgggaatttacgtggatcacgtaagaagaatactggcgtattgttacctactaaatcccagttaccttcttcagtatagaattttaatgcaaaaccacgaatatcacgctcagcatctgctgcaccacgttcgcctgccacggtagtaaaacgtgcgaacatttccgtttttttacccacttcactaaaaatttttgcacgagtatatttagtaatatcgtgtgtgacagtaaaagtaccaaatgcaccagaacctttagcgtgcatacgacgctctgggatcacttcacgtacgaaatcagctaatttttcattaagccataaatcttgtgcaagtaatggaccacgcggaccagctgttaagctgttttggttatcagcaacgggtgcaccgttacccattgttaagtttgttgcagctaagtgcgagaaaggacattgagaactcattgtagactccttgtgaagttaataaatttagtttagggtgaaatgaatttcttgcgtatcatatagaaaggtttaaacaatcgaaatctattaaattaatcaaaaaaaactattattaaagaaagtttaaaatctaccctaatattccaaattaccttacttgatttcttttaaaagacctgattttcaaccgccttttgtcgcctttatcccttttacgggtgcaaggttaatacccaccttttgtaatcctattgattaccgatattgagcaccaaatcttacggtaaaaccttccacggtatgatcttagccctcgcggaaaat

SEQ ID NO: 510 - DNA, 6306 bp, H. influenzae
  misc_feature (6298)..(6298): n is a, c, g, or t
tggtaccgaatatcggactcggtaccccgtggattcttctgcatagttgggctaactgccgtgcttgcatcagaatagaacaaacctgatttcaagtaagaaatctgcccaaataattccaagccttctacgtggaacatccctgtcggcaagccgatttcatacaaatgatgataagaaaactgcccttgatatgccaagttgtgaatggtgaacaccgatttcgcagggcgacctttgttgaacagatatgctgcacacaaacctgcgtgccaatcatgagcgtgtaccacttctgcacgccaccagctatctaaacctgtggctaattctgcccccacccaaccgagcaaagcaaaacgtttgtagttgtcgccgtagtcgttgtaataggcatcgtgataaggattgccttcgcgaccgtataagtgcggtgcgtcaatcaaatagatcccgacaccattatattctccataacgcaacaccacgtgcccagcgaagttgtcaaattcggcaaccacttgagtattctgaatgcctgctataattgcgggataagcaggcaataaaacgcgagcatctagcccaatttggttctgtgcttggggtaatgcccctaaaacatcggcaagcccgcctgtttttaagagcggatagagttccgaacaaacgtgtagtattttcattgagttttttattttccctataaatatgaataatgctcgatcagccccccctctttgctaaagagggattcagaaagtgcggttaattttgaccgcacttttcctaactaatctaaatgaccttcttcgccaatctcgtgtccctcaagtatctttagcattttcggggttacaagaatgactttgcctgttgagctaatacggaagcgatttttatcttcttccatatccacaccaatttgcataccatcaggaatttcgcattcgcggtcgataatacaatttttcaacacgcaatttttaccgattttaacttgtggtaacaccacgcagtgatcgacttttgaaaaggaatcaattttaatgcgatcaaaaagcacggaattgctgatcgatgcatcggtaatcacacagcccccgccaatcaatgagttatctactgggtgcacgttagagtgtttatagaagaatttagacggataagcctgaaccggattaccacgaattggccagctttggtcgtaaatatctaattgtggattttcagagactaagtcgatattagattgccagaagctatcaagtgtccctacatcacgccagtaaatttcgccctcggtgttgcgtcccatgcaagaacggctaaatgggtgagcataaagcgcgcctcttctaaacattttggcaatacatctttaccgaaatcgtggctggtgttcggggtgccaacttcacgatctaacattttgtaaagataatccgcatcaaacacataaatccccattgaagtaagcgaaacatcaggtttacccaccattgctggcggatcttttggtttttccacgaaagcttttactttcaagttttcgtttacagccattacgccaaattcgtgtgcttcagaacggggcacttcaatgcaaccaatagtacattttgccccactattgacgtgatccattaacatcacgctgtaatcttgtttgtaaatatggtcgcccgctaagatcaaaatatatttcgggcgatagtgatttttaataatagccatattttgatataccgcatccgccgtgccacgataccaagtagaatcgtcaatttgctgacgagctggcaacatatcgacaaattcccctctctcttgtggtaaaaaagaccatcctgtttgcaaatgacgaagcaaggagtgtgccgcatattgagtcacgaccccaattcggtttaaacctgagttaatacaattagaaagtgcgaaatcaataatgcgacgattaccaccaaaataaagcgctggttttgcacgtttatctgtcaattcgtgtaaacgtgaaccacgtccacctgcaagtacaagcaccaaagtgtttttaactaaatcatatttgttaaggtcgccagatttcataaggatctccatagtcttattgttattcgtcattcagcatacaaaagcccattgaactaagttcggcttgttcttcaagggttacattatgtgtgccgatttggggcttccatttcccattaggcaagtgaaacacctgaccttcggctttggcattaatcaacaaaagccaacgattgtctaaaaccacctgtaatgctttggtttgttgattttgccaatcttcaactgtcatcggttcgcctgcaatgttaagccattgcacattctcatccgaccaccattgatcttggtttaaactgcccattcttttgcggagtgcgatcgtttgcttggtcagttcaaataattcttcgttaaaatttgcccatttcagccaagtaatctcgttatcttggcaataagcattattgttaccatattgagtgttgccgaactcatcgcccgccaaaagcataggtgcgccattcgccagcaataaactcattaataatccactttgtgcaaaagtgcggttattttccaccgcacttttttgcggttcagaaagggattctgtagaaccttctactccgtggttgtaactgtaattttcgtttctgccgtcgtgattttcttcgccgttcgcttcattatgtttttggttgtaactcactaaatctttaagcgtaaaaccatcgtgagcggtaataaaattaagtgtagtatgtggcaagcggtcatttttcttaaataaatcgatagagcctgcaaaacgttctgcaaatgcaccgatttcgccacttttccatagccagaaacggcagagatcatcacggaatcggtcgttccattcggcaaaataacttgggaaattgccgacttgataaccgtaatgtccaatatcccaaggctcggcaatcaatttaatattttgtaaacttggctcattttttatgtcagtaaaaagctgagctgacgaattaaaatctggtgtatcacgaccaagcacggaggctaaatcaaaacggaaaccatcaatgtggcattgctccacccaataacgcaggcaatccaccacccactttcgccctacatcagaggataaattgagcatattgccgcagcctgtccaattgatataacgcccttgatcgttgcgccaatagtaagtttgatcatcaataccacgctggcagaatgttgggtaagtttgctctgattctgcagaatggttaaacaccacatctaagataacttcaataccctcattgtgaaacgcctttaccatcgctttaaattcagctaatggattatttgttgccgcatatttaggttccaccgcaaacatcgctaaggggattgtatccccaataattttgtaagcctcgtgcctgtaagtgcggttcatttatatggaaatttacaggcagcaactccaccacagttacgcctaattctttcaaatacgccaaattcacaggatgtgctaatccagtataagtaccacgcaacgccgcagggattttctcgttaaactggctaaaccctttaacgtgtaattcatacacaatggtttcagcccaaggcgtattgggtaaagtatcattttcccaattaaaatcttccgaaatcacaaccgctcttggggcaagatgcgcgttgtcgcgattatccgaaagcaagaaccaagaacaactttcttcgctacttaaatcaggtttaccatttacggctttcgcatagggatcgagcattaatttattcgggttggcaaattcgccgtgaatacgaaatccatattccgtaccagttttcacgccagttaccgccaaatgccacacattttcagtacgcaccatcggcaagcgtgtttcttgattttgttcgtcaaaaaggcaaagttctacgcctattgccgcagcggaaaacagggcgaaattggtaatttgcacgttgttttcgaccgcttgtgagtatcccattggaataggattgccgttgttgtagattttgaacatatttttatcgcttttgtaggggcaaatgacatttgcccaaaaacatcggtggtttatcagggcgaatgtaattcgcccctacaatttatctattcggattatttcgccttcaatctcaaataaactgttgctaacggcggaatggacactgaaatcgaattttctcgtccgtggctttcgattttttcacttgcgacacaaccaaaattgcccacgtttgaaccttcgtaatacatcgaatcggtatttaaaatttcttcgtattttcctgcaacattcacgccgatgcggtaattgtggcgaggcacaggggtaaagttactgacgacaataatacgttctccgtttgaactgcgacgttcaaaggcgaacacagaatttgccgcatcatcaacgacaagccaatcgaaaccctctggggagttgtcgagctcaaagagcggtcgatttttttgataaatttgattgaggtctttaaccagcttcaatacgcctttgtgccaacctccgccaatattttcatcaagcaagaaccagtccaaactttcttcataattccactcacgaccttgggcaaattcattccccataaagagcaattttttgcctgggtagccccacatataaccgtaatatgcacgcaagttagcgaatttttgccacgtatcgcctggcatcttgccaagaagtgaatatttaccgtgaaccacttcatcgtgagaaagtggtagaacaaaattttcgctgtattgatataccattccaaaggtcattttgttgtgatgatattggcggtaaatggggtcaagcttcatataagccagtgtatcgttcatccagcccatattccatttgaaattgaagcccaagccgccgtcttcgcttgggtgggttacgcctgcaaaagaggtagattcctccgcaatagaaattgctcccgccatttcgctgtgaattttccagttggtgtgttttaaaaactcaatggcttctaaattttcacgtccgccgtattggtttggaatccactcgccctccgcacggctgtaatcgcggtagatcattgaagccacagcatccatgcgaataccatctacgccaaagcgttcaagccagtaaagggcattgctggacaggaaatttttcacttcgttgcgtccatagttataaatcaaggtattccaatcttgatgatagccttcgcgagggtcttcatgttcatacaaggctgtgccatcaaatgcgactaaaccatgggtatcacttgggaaatgccctggcacccaatctaaaatcacgttgatgcctgcttcgtgagcacgttttactaaacggcgaaatgcctcaggtgagccaaaacgactggttggcgaataaagcccaagtggttgatagccccaagaaccatcaaacggaaattcagaaagcggtaaaaattctatatgggtaaagcccatctcttttacataaggaattaattcatcagcaatttgatcgtaatctagccaaaaattgttttctaaattacgacgccaagatcctaaatgcacttcataaatagaaatcggttgatttgcttgatttgcttgacgacgttgttccgtcatttccaccacatttggtaatgcactaatttgtgaagctgtatcagggcgaagttgcgaactaaaggcataaggatccgctttcaaacgaagattgccatagcaatcaatcaattcaaatttatagagctgaccaaggctggctttcggcaggaataattcccacacaccgcttttcgggtggaaacgcatcgggtggcggcgaccatcccaatagttgaaatcgcctacaatagaaactcgtcttgcattaggtgcccacaagcggaaattcaccccgctcacaccatcacattccataaaatgtgcaccaagcacttcatatgggcgaagcatagatccttcagaaagtagccattgttctaaatcgtcaatcattggatgaaaacgataaggatcttcgataatttgtgcttcattaccccaaaaaacctgtaattgataagcaaaaaattgacgacaatttggaataacaccaacaaaaaatccacgctcatcgacacaatccagttccgttatttctttaccactttcacgctcaatcaccaccattcgattggcatctgggcataacgtacggatttcaattccttgctcggnttcgtgct

SEQ ID NO: 511 - DNA, 8069 bp, H. influenzae
ctgttatacgaatatcggactcggtaccctaacctcttaattaacctaggctgatctgcacgtccacgccggcagccaaatctaaacgcattaatgcatcaacagttttttctgttggctctacgatatctactaaacgtttgtgagtacgaatttcgtattggtcacgtgcgtctttgtttacgtgtggagaaatcaacacggtgaaacgctctttacgagttggtaaaggaattggaccacgaacttgtgcgccagtacgtttagctgtttctacgatctccgcagtagattgatcgatcaaacggtgatcgaaagcttttaagcggatacggattctttggttctgcattagaccagagctccaataaaatttagctaataaaaaaactaacaccaatcacaattctaacttcaaatatagaaaaggaggtgcaagttacctgttatatagtctccaaatcggaaacattgttagcctgacatatcgtcatgcccgttcaataaatgattacattaaacggctctcatattgagagtccgtgtattctatagaaagacaaccctatttgcaagcttttattttaactattttgttggcctaaaagcctctaataatttatcaaaaatatattcttcaaggtgtgtgtaaaccgtttttctttgacgacatagtgtcactttccacggaacaggactttcgattttacgacacaaaaattcttttgaatgataaagctcagccataggtaacggtagaatagttaataattctttgtttgttttgaccgcacttagcagaaaatcccaacaactcgaatccaaaacaatatctggataacaattattgcgctcaaaagcttccttcaaatgatgatgaatcataaatgtttgatcaaaaattgccattttctgctgatgtaaatcagcccatgtgatttgttgtttttttgctaagacatgctttggtgaaagaaataaggctaattcagaactatgaatttcaattgaatcaataatattttttgatattcgctcgggatataacaacacggctaaatcaactttatctaaaagaagttcactctttagagcataagctccaatttctttaataataaaattaatatctggattcttaagaataagatgaggcaatacagaagagaacacggctgataaaactaagggaggaataccaattgttatcgtgcctttcttacaatcttttgatttataaagatttgttctcatatcattgtaacgcttgatcacttcttttgcatcacgataataattttcccccgcaaaggttagtccaataatttttcctgatgcccgtttaaatatctgaatattttcacgattctcaaactccgtaatcatcatacttaatgcaggttgagacacatataaattttgagacgctcggcttaaattaaaatcattatctacgattgaaacaaaatatcttagatgcctaatatccatcattttcacccccctaaggactgccatttttacaaaatatagcacaaggattgtttaaaacactatcaaaataacttatacccgcctaagaaagatgtatttcttttacgaaattttttttgctatttttaatatcaatctagttcctttattgcctatcaaggatcatccacagaaacatatccatttgaaatataagatacttatttgttgatattctttcttttaatctcgttattaggaggtctctatgacacaaaaacatcttaagcttaataatctaaatcaacacctacatgatggtatgagcatcatgtttggtggatttatgggtatcggcactccagccaaacttgtccaacaaatcttagattctggcgtaaaggatctcacactcataggcaatgacacagcctttattgacactggcgtagggcctttaattgtaaataatcgagtcaaacgtttaattacatcccatattggtacaaatccagaaactggcaaaaaaatgattgctggtgaaatagatgtagaactcgttccacagggtaccttagctgaacggattcgtgcaggtggcgccggattaggtggtattttaacaccaacgggtgtcggcactgttgttgaagaaggaaaacaaaaaattcaaattgatggcaaagaatatttacttgaactcccactaaaagctgatattgccattatccatgctcaaaaaggtgacatgaatggcaatttagcttatgaattatctgctaggaactttaatccactagttgctttagcagccaaaactgtcattgcccaagttgataatctactagaggtcggtcagttacccccagatgaagtcatcacgccagccgcattaattgattacattgtttgttcagaataaggagaacgccatgaatgcaaaagaattaatcgctcgccgaattgcgatggaattacatgatggagatattgttaatctcggtattggtttaccaacacaggttgttaattatttacctgataatgtcaatattacacttcaatcagaaaatggctttcttggtttaactgcatttgacccagaaaatgctaattcaaacttagtaaatgctggtggtcagccttgtggaattaaaaaaggcggcgctacttttgatagtgctttttctttcgctttaattcgtggcggtcatgttgatgcctgtgtgctaggtggacttgaagttgatcaagaagcaaatctcgctaactggatggtgcctggcaaaatggtaccaggaatgggcggagcaatggacttagtgactggtgcaaaaaaagtgattattggcatggaacattgtgccaagtcaggttcctcaaaaattctaaagaaatgtacattaccgctcacagcaagtaaaaaagttgccatggtggttaccgaattggcagtatttaacttcattgaaggcagattagttctaaaagaacatgctcctcatgtggatttagaaacaattaaagccaaaacagaagccgatttcattgttgccgatgatttcaaagaaatgcaaatcagccagaaaggactttaattatgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaatttctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatagaaaaggagttaaaaatggaaaatgttgttattgttagtgcagttagaacaccgatcggcagctttaatggtgcattatcttccgtaagtgcggttgatttaggcgcaattgtgatacaagaagccatcaaacgtgccaacattgaaagtgcattagttaatgaagtcatcatggggaacgtattacaagcaggactagggcaaaatccagcccgtcaagcagcattaaaagcaggaatagagaaagaaatcccttctttaacaatcaataaagtatgtggatctggtctaaaaagtgtcgcattaggtgcacagtctattatcagtggtgatgctgatattgttgttgtgggtggcatggaaaatatgagccaagcaccttatcttttagatagcaaagtacgacaaggcgtcaaaatgggtaatctcacattaagggacacaatgattgaagacggactaacttgtgctagcaatcactatcatatggggattactgccgaaaatattgcagaacaatatggtattagccgccaagcacaagatgaactcgcattacgttcacaaaccttagcatctcaagccgtgcaattaggtgtatttgataaggaaattatccctgttatggtaaaaactcgcaaaggtgacattattgtttcacgagacgagtatcctaaagcagatactacagctgaaggtttagctaaattaaaacctgctttcaaaaaagagggtactgtcaccgcaggtaacgcttctggcattaatgatggtgctgcagcacttattttagttagcgaaagcaaagctcatgcacttggattaaaagccattgcaaaaattagaagctatgccagcggtggggtagatccatctgttatgggattaggtccagttccagcaacgcaaaaagcattgaaaaaagcaggaataaatcttgatgatatcgatctgatagaagcaaatgaagcctttgcctcacagttcttaggtgttggcaaagatctcaatttggatatgaataaaaccaatattcatggtggagctatcgcacttgggcatccaatcggtgcgagtggtgcaaggattttagtaacgttattgcacaatcttatcgaaaaagataaaaaacttggacttgctacactttgtattggcggtggtcaaggtatttctatgattgtagaacgcttataactatttacttcctaaactacaacagcgaaatatttcacttctaactaaaaaagcgaatttcttttaagaaattcgcttttcttttgatatccaattattctttcctctccatcatcgcaatatgccttgtcgcggcaatccacgccccaacatagcccataattaaacagcacactaataagaatacaaactcgccaacgcctaatccattcaaactgaattggacggcaaaaatatccgttacgtatttcactgcagaagtaaaatagctgataataaaactactaaaaattgctgcaactaacccacctaacacggcataaatcatccccgtataaagataaggacgaaggataaactgatctgttgcaccaagcaatttcatcacatcaatacttgagcggctactgtacacatcagagcgaatactgttaccaataactaaaaataccgctatcgtcattaataccgtacagaaaattgccacatgggcggttaaccaagaaagtgcggttaatttttccatccaatcattatccaagcgaacttcttgtacccctttgattttatttaaattggtacgtaactcatcacgtttttctgacacattaaattcgctcgtcggttttactatcacgaccgcaggcaatggattatcatctaaaatttccaattcttcgccaaagccagaccagcttttaaattcctttaaactttcttgacgagaaacataattcagtgattctacgcctttttgctggcggattttttctaccactaaattcgcgttttcctcacttaaatttttatgaagataaatagtcaattcactgtcaggataaaattgagtggtggctaaatgcaaatttttccacattaaatagctcacagtcgggatcgtaagcgaaacggcaatcactaaaatcgtgagcagcgtgccaaatttacgttgccataaatccgcccatactgcacgcaaagtataggctgtttgaacaaaaacagatgcatccgttgatcggctcatgattattccttaataacgtaaataaccttgttcaagcacaagacaaggttttggtttttgttgaattaaattaatgtcgtgagtagcgattaacacagtcattcctagacgattaaattcttcaaacaaattaaaaatgcctaaagaaagttcatcgtctaaattacccgttggttcatctgctagtaagagctgaggtttatgcacaatcgcacgcgcgatatcaacgcgttgctgctcaccgccagaaatttgtggtggcaaatagtgggctttattacgcaatcctacacgatctaaagatgccatcgcacgtgtatgcgcatcttttggatgcatacctgcaataatcaatggcaatggccacattttccgccactgtacgatctgttaataaacgataatcttggtgaaccatgccaatttggcgacgcaaaaatggaatttcatattttgacaagcgagtaatatcgtgtccgttaaaccaaatctgaccagcattggctttttccatccccataataagcttgagtaatgtacttttccctgcgcctgaatgcccaactaagtaagtcatacttcccactggaagatgaaaattcaagccttgtaaggctggctgcgttgcaccatgataggctttagaaacatttgagaacttaatcacaatttttccttattctttttattcttcttcatgaacgaataatgcctcaataaattctttcgcattaaactcacgtaaatcttcaattttctcgcctacaccgatatagcgaataggcaacttaaactgatcggctatggcaaaaatcacgccaccttttgccgtgccatctaatttagttagagagatccctgttaaacccacagcctcattaaataatttcgcttggctaatagcattttgtcccgtgccagcatccagcgtaagcataatttcatgtggtgcagtttcgtcatattttttcataacacgaacaatttttttcagttcgtccattaagttatttttattttgtaaacgacccgccgtatccgcaataagaatatcaatattgcgtgcagccgctgattgcatcgcatcaaaaatcacagacgcagaatcagaacccgtgctttgcgcaacaactggaatatgattgcgttctccccaaacttgaagctgctcaacagccgctgcgcggaaagtatcacctgctgcgagcatcaccgattttccttcagcctgaaatttacgtgcaagtttaccaattgtcggtcgttttacccacgccttttacgcccaccattaaatcacataaggttttttggggctatcaatctctaacgggcgggctactggctcaagatatccgccattctacttttaattgttgaataaaagctcggcatctgtaattcttagacatgcctgttcagtcaaat

SEQ ID NO: 512 - DNA, 6125 bp, H. influenzae
  misc_feature (6098)..(6098): n is a, c, g, or t
  misc_feature (6110)..(6110): n is a, c, g, or t
  misc_feature (6115)..(6115): n is a, c, g, or t
tgcagattccggtatttgccccccaataaaggcactgaaattttgatcgccccattcactaatacttttaatatcgttactcgtaagtaaaattgttgttccctgatttggttcatactggaaagtaaccaaaacctgtgacggcaggggtgattccaaaggtattgttgggtcatccgcgaatataaacgtgggcggattagcgacagccattgcgatcaaacctttttgtccttcgccttctgtcagttcgttaggatagcttgccataatatcacgatgatctttaattcctacgcgatgtaacaattcaatagcacgtctttttttccacccaaaccatttccaccatttatttttaaatgtccaattaggaatattttggatgagttgtttccctatttttcgacttggatcaaggcaagataagggattttggaaaatcatggatatttctttgccgacaatcttacgtcgtttattaggactgagttttagtaattcgatatcgtgaaaacgaaagcgatcggcagtaataatccaattttctttgattgcattacaaatgactttagcgattaagctttttcctgagcctgattcgccaactaatccactgatttccccttcgttaagggaaagattgacgccatctacaatttttatacgtccattggaggtttgaatttcaatattgaggttacaaatgtctaaaagtgccataggctattcttgatgttgattgatggctttagttaagccattactgaaaataatacttaataaaatagtaaaaataatagcgaaaccgggtaaaagtactgtccaaggtgcaagataaagtagttccaaagagtcttttatcattgccccccattctggtgtaggtcgttgtgcaccaagagaaataaaacttaatgcgctaatatccaacacggctataacaaaagcatgagccacttcttgaatataaataacagtaatattcggtaaaatagtgctttttaataaggtttgattggaaatgccttcaagttttagcattacaacataatccttttctaattctttttgaatagcgcgatagatagtgtgaaatgaaataaggcaaaattgctaatagcgtagcaaacattgcattccataaacttggttccattaatggttgaaataacaacggcaattaatagaataggtaacgataaaaaagcatcaaaaatatgcccgacaaaacgagctttaatacctttcagtagtcctgcaataattcctagtgcgccgcctattattgccactgaaaagacaaccagtaaagcagaacctaaggtataacgagtacccataattaaacgacttaatatgtcgcgacctatatcatcagtaccaaagaaaaaagcaatttttcctctatctacccaagaaggaggcattaattcttgcccaataaattgtcgattatcagcataaggtgcaagataactagcaaaaagtgcggtaaaaattaatgcgattaataaataaaagctaaaaagtgcgatggtattttgacgaaagcgtaaccaaatttgaaagattgaggtgctttcgcggaattcatcaggttctttatcttgcataccaacctttctttttaaatggatcgagtataaaagtgaatattttagtgaatgtatcaatcaaaataatacatacaccaataacaattacacctgcggcaatgctgttgtaatcttgttcatttacggcattaattaaccaacgaccaatgccaggccaacctaaagccgtttctaccaacatacattgcgttaatactaatgtgaatacacgtggtacttgtggaacaagcaggggaaaagtattacggaatacatattgatggagaattttccattttgaccaaccccgtgttgtcgctactttagaaaaattttgattcaaaatatattctgctcgttgatgaataatacggataatttccattgttggcaaaatacacaataccaatgttggtaaggctaaatgttgcaatatgttttgtacgatttttgtacgataaggtacttccataaaccacatatcaataacaggaaatcccgtaatgggtttaatttcgtaaagcaaattatattgtccaatagcggcaatttcccaatgtgagagcgcggcaacatacagtaaaatgggggctaaccaaaatattggaatagatagccctacataagataggatttgtaaactttttgcaaaaacttgttcagaattgaccgcacttataatgccaagtggcaaaccaaaaataaatgccaaaaacaatgtaatgaaacaaagttccaatgtgggaggaagaaccgtaagaataaggttcattaatgattttccaccgttataggtaatgccaaaatcaccttgtaacaaggtgcctaaataatggaaatagccgatataaatgttttgtgtaacaagattcgcattaagaggatcgcgcaataaaataacaaagcctaatagcgataatacgagtaataataatgccacccacagaatatggcgaagaaccgaccagaacattagtgtttctcctgaataaaataaaaggtggaaaaatctaagctaccaaaaggcgtcatttttactcctttcacacgactatttgcgactaaaattcgttttacattggcaataggaataatgggtaattcacgtagaacgagttcttgggcttcattataggcttttgcgcgtgaacttaaatgtgaggtggtaatggcacgatccataaattgatcaaattcttcattacaccaattagataaattagtgagttcattttttgttccacagcttaaaattggacgcataaaaccatcaggatcaagattaccagctaaccaaccagatagaatcaaatcataattttccgattgattgcgtaattgtgcagttaaaaatggacgagttacggcacgcactttaactttcacacccgcttgagctaaatcccatttgatcatttcagccattttaaaaggtgctggattatagacttgttcttcattaattacccataaatttaacaaaaggtttttatctgctaatttatttttggcgattttgggatggtaatcaaactcaaattctggcgtattgacagttgaagcccaagacacttcaggaataatgttattagcaacagttgctgtgttatggtaaatgctatgaatgattcgagctcggtttaaactttgtgaaatagcagcacggatttcgtgatctcgcattaatggcttatcaaaattaaacgctaaataggctaaattcataccatcagtagattgcatataataatgtttgtcatcattttttaataagccaatttggcttacttcaggataagaggcgatttgacattcattattgaaaaatttgactaaacgtccgctgcgatcagtagaaagatccacaataatatgttctatcttggcttcttttttccaatagttttcgttacgcactaagcgaacatattggttatatacataatcttttacttgataaggccctgtgcctactgggtgggtatctaattgagcaaggttgtcatctgcgcttaattgataggcatattcttgtgaaaaaataatggcatactggctggcaagatgcgacaaaatggaggaatctggtgcaaataattcaatttttacttgataaggcgaaagtgcggtcacagatttgattttttcgttaagtttaatgctatcaaaataaggaaaacgcacttttcttgcttgttcgtgaaacactctatattgtggattactataggtaacattcgcctctgctaaggttggtaaataagtattatgccctaatacacgattaatcgaaaatactacgtcttcagcgttaaaatcacgtgttggggtaaaccaaggggtttggtgaaattttacgccgtgacgtaaatttaataaaatttctttaccatcagctgaaatggaataagattgtgccagcattggtgttaatgttgcactgtgattttttatatcaaataatttgttataaatttgttccgtgaccacattcatactggttcctgcatctgctgtttgcggattaaatgaaaaacctgaagcgtgggtgcaataagttaagccattttcagttaaaaatgttggaacacttggcgcagcctgtaattctacactttggcttatacagagcagaaaagataaaaatctcagatttagacgtaacataacaaatgcattgtgataaattatgtgtcaaattgtaaggcatattagtaaaaatggctaggatattgaatgtttaatcgggttcaaaaggaaatcaatcaaattattaatcgtggttttgatcgcactttgcgtttagcggtaacagggttaagtcggagtggaaaaacggcgtttattacaagtttaatcaatcaacttctctccattaatcaacattcatcacagaatttgcccttgtttgaagcagcgagaaatggtgcgatcttggcagtcaaacgagtatcccaacaagatctcagcgtgccacgttttgattatgaaagtaatttaaatgatttgtcacaaaatccgcctcaatggattcaatctactcgtggcgtgagtgaaacgcgtttagccattcgttttcaacgccaatctggcttgctacgccatttgaaagaacgaggcacgctttatctagatatttttgattatccaggggaatggctgatcgatttgccgttattaaatctagattttcaacaatggtcacaagagcaaattaaggtaacaacaggcattcgtgaagaattggcggagaattggctcgctatgttgcaggatttggatttaagtgcggtcgcaaatgaagatgttttagccaagatagcgaaaagttatacggattatttacatcaatgcaaagtgcaaggcatgcaatttattcagcctgggcgatttgtattgccgagtgatttagagggcacgcccgcattacaatttttcccattaattcatctttcagaagaacagtggcgaaccttgaaaaaaacagcaaaatcaaatagctattttgctgtgctgacaaaacgttatgattattatcgcaataaaattgtgaaaggtttttacgaaaattatttttctacctttgatcgtcaagttattttggcggattgtttaacgcctttaaatcacagtcagcaagcctttttagatatgcaaatgggcttaaatcagttatttaataatttccattatggcagcagaaattttcttcatcgtttgttttctccgcgaattgatcgattaatgtttgttgcgacaaaggcggatcatattactcgtgatcaaattcctaatttagtaagtttaatgcgccaaattgtgcaagagggtggtcgccatgtggaatttgaaggaatcgatacggaatataccgccattgcggctgttcgtaccacaaagcaagtgattgtgaatcagcaaggaaaagaaattaaagcaattcaaggggttcgttctattgataaacagctgattacactttatccgggaacggtgccgagcaaattaccaagagcagaattttggcaaaaacaaccgcactttgattttgatagttttgaacctcagcctttagaacaaggggagagcattcctcatttgagaatggatgcggttttacaatttttattaagtgatcgatttgaataaaaagtgcggaaaattttccgcacttttttcatctttctagcctgtattgcgcatcccagccgcgatacctgtgatggtaatcatcaatgcttgttccacatcgggattgacttgctctggattttcacggaaacggtgaagcaattccacttgcagtagattgagtggatccgtgtagatattacgtaatgcaattgaatctgcaatccaaggtaaatcagacatcaattcactttggtgagaaagtgaaagcacagtttgaatatcatcttcaagttgcttacgtaaattttcacctaaataccaaagctctttttcactaatcgttgatcatattgtgggaaaagggtnaccgaggcccgnaattncggataccat

SEQ ID NO: 513 - DNA, 7004 bp, H. influenzae
  misc_feature (5214)..(5214): n is a, c, g, or t
  misc_feature (5218)..(5218): n is a, c, g, or t
  misc_feature (5245)..(5245): n is a, c, g, or t
  misc_feature (5281)..(5281): n is a, c, g, or t
  misc_feature (5291)..(5291): n is a, c, g, or t
  misc_feature (5293)..(5293): n is a, c, g, or t
  misc_feature (6749)..(6749): n is a, c, g, or t
  misc_feature (6816)..(6817): n is a, c, g, or t
  misc_feature (6828)..(6828): n is a, c, g, or t
  misc_feature (6868)..(6868): n is a, c, g, or t
  misc_feature (6904)..(6904): n is a, c, g, or t
  misc_feature (6933)..(6933): n is a, c, g, or t
gagacccctacgagggtttgaatttgcctcattgctaccttttgacaaattcaattcctttgtttacgccaaaggaacgttcaaaagtgcgcttattatcctataaaaattgaaaagatcaaattcttttgaattttttgtttatttttcatccaaacaacacacttttcttgactcatttactccataaaacactccttaaaaatgctcaaaatctaattcgacatcattaacgccttaagatattatcaataacctgccatttttacctttaaatgagttaaatactatgttgccaagtctaaatcgcattcctcaaattgaacaatatgtacttgattatcttgatgatcttcaacaccaacattttgagggggatattgcgacaaattattcggatagattaagtctggctacggataacagcgtttaccaacagcttccacaggcgattctttttccgaaaactattgctgatatagtgcgtataaccaaattggcaaatttatctgaatatcaatcaatcagctttacgcctcgcggtggaggcactggcactaatggtcaatccatcaataacaatataatagtggatctttctcgtcatatgactgccatcttagaactcaatgtaaaagaacgttgggttaaagtacaagcaggtgtcgtaaaagatcaacttaatcaatttttaaaaccacatggtttattctttgccccagagctatccaccagcaatcgagcgactttaggcggaatgattaacacagatgcctcggggcaaggttcattgcaatacggtaaaacctctaatcatgttttggcattacgtgccgtattaatgaacggtgaaattttagatacaagtgcggtcaattctgttgatgttttagaaaacattgatgcgcttgaattaagtgagagcagcaaaagactccatcaaacaatcgcgcaacactgtaaagaaaaaagagcggcaatcattaaagatttaccacaacttaaccgttttttaacgggatacgatctcaaaaatgtattcaatgaagatgaaagtgaatttaatctcacgagaattctcactggttctgaaggttctctcgcatttatttgcgaagccaaactcaatcttctgcctattccgcagtatcgcacgctcatcaatattaaatatcgttcttttgacgcggcattacgcaatgcaccttttatggtgaaagccaatgcgctttctgtggaaaccgttgattccaaagtcttaaacctcgccaaacaagaatattatttggcattctgtgaatgaacttcttacagaagatgaaaaagatccaattctcggtttaaaatattgtgggaattttgctgggtaaataataaagaaaaaataggccgccaagtcaccgcacttttgtcacttacttgatgaaaaaatcgaacataaccaagatcacattattggctatcaagtttgttctgatttaccctctatcgaacgtatttatgcaatgcgaaaaaaagcagtgggcttacttggtaatgcaaaaggtgcagccaaaccgattcctttcgtggaagatacttgtgtccccccagaaaatcttgcggattacatcagtgaatttcgcgctttattagaccagcaccatttacaatatggcatgtttggtcacgtggatgctggtgtgttacacgttcgccctgcacttgatttatgcgataaagaacaagtgaaattatttaaacaaatttcagatgaagtggcagaacttacgattaaatatggtggattactctggggagaacatggaaaaggcgtgcgatcccattacggcgaaaaattctttaccccagaactctggtacgaacttcgttatatcaaaaccttgtttgatccgaacaatcgcttaaatcccggcaaaatctgtacacctttggattcccaagaggaactttattctattctttcgccaatgcgagctgataaggatcgccaaattcctatccaagtgcgtgatgaatttaagggtgcgatgaactgcaatggaaacggattatgtttcaattttgatgaacacagcattatgtgcccatcgatgaaagtcagtaaaaaccgtgtattttcgccgaaaggtcgcgcagcaatggttcgagaatggcttcgattgatggcgaatgaaaatgtttcgcccgcacaattagacttccgtaaaacagaaataaaactaaccgcacttgtgaaaagactaagcaatacggttaaaaaatggcgaggcgattatgatttttctcacgaagtaaaagtcgcaatggatacttgccttgcttgtaaagcctgtgcgagccaatgcccgattaaaatcgatgtaccaagtttccgtgcgaaattctttcatttctatcacagccgctacttacgccccgcaaaagatcacattgtggcaaatttagaaatcgctgcgccttatatggcaaaacaggcaaaattctttaattattttaccaagctaaaagtcacgcaaacattagtggaaaaaacgctaggcatgaccgatttgcccttgctttctgaacccaatttgcaacaacagctggtagaaattcattatcaaggcaaatccttggaagaattggaaggcctaagtgcggtagaaaaaaacgatattttatttattgtgcaagatccttatacctcttactatgatgcgaaagtggtacgagattttgttatgcttacgcagaaattaggcttcacaccaattctgttgccatttaaaccaaacggcaaagcaatgcacattaaaggtttcttaaaacgctttagcaaaacagcagaaaaccaagccgagtttttaaatcgaatggcaaaattaggcattcctcttgtgggcgttgatccagccatcgtgctgtcttatcgagatgaatacaaagaagcactacaagaaaaacgtggcgattttcacgttctcaccgcacacgaatggttaaaacaaagattacaaaatgcggatttacaagagaagttaaaaaacatcgccaaaactgaccgcactttcgattggtatttattccagcattgtacggaatctacctttatgccaaacagcccaaaagaatggcaagaaatttttggaagatttggacaacaacttaatgtagaaaaagtaggatgttgcggtatggctggtgtatttggacatgaagtgcaaaatcaaaaaatgagccgagaaatctacgatgtatcctggcacaaaaaactgcatgaaaaagatccgcacttttgtttagcaactggttattcttgccgcagtcaggtaaaacgttatgaacatgtggtgttaaaacaccctgtgcaggcattattagaaattttagcgtaatgaaaggaacatcatgatttggcaaaaaaacttcacgctcgaaaacttaaatcaactttgctccaacagtgcagttagccatcttggcattgaaatttctgcttttggcgaggattggattgaagcgacaatgccggtggattatcgtactatgcagccgtttggtgtattgcatggaggggtttctgttgctttagctgaaacaattggttcccttgcgggttcgctttgtttagaagaaggcaaaactgcggtgggattggatattaacgccaatcatcttcgcccggttagttcaggtaaagtgaccgcgagagccacgccaattaatttgggcagaaatatccaagtttggcaaattgacatccgcacagaagagaataaactttgttgtgtttctagattaaccctttccgtaatcaatttatgacaaaatccgcaaaaatcggcgtattacttgccaatctaggcacgccagatagcccaacaccgaagtcaatcagccgttatttatggcaatttttaacggatcctcgcgtggtagatttaccccgttgcaaatggtatccactgcttaaagccattattttaccattgcgttcaaaacgtatcgccaaaaattatcaagcaatctggacagaacaaggttcgcctttacttgccatttcacgacaacaaaaagacgcattacaagcctatttagatacgcaaaatatcaatgctcaagtagaaattgccatgacgtacggcaatccatcaatacaaagtacggtaaaaaatttgcttaaaaatcaagttgaacgaattattgttttgccactttatccgcaatactctagctcaaccacgggcgcagtatttgatgctttcgctaatgcccttaaagaagaacgaggattagtgccttttgatttcatccattcttatcatattgatgaaaattacattaacgccttagcaaactccataaaagtgcggttaaaatccgatgaatttttactattttcttatcacggtattcctctgcgttatgaaaaaatgggcgattattatcgtgaacattgtaaacaaacgactattgcagttgttaataagctgggcttaacagaaaaccaatggggaatgacgtttcaatcgcgctttgggcgtgaagaatggctacagccttacaccgataaatttttagaatcagctgcaacacagaacattcaaaaaattgccgttatttgcccgggtttctccgtagattgtttagaaaccattgaagaaattgataaagaaaatcgagaaaatttcttaaccaatggcgggcaatcttatcaatatattcccgcactaaatgtagagcatacacatattgaaatgatgggaaaattgatcctagaaaaacttgcttaataatagaaatggtaaaacgtttctaaaatcttccgcactttgctaaaatcagccattattttttcacaaggataaaacatggctgattttccttttatcgttgagatcaacgaacaaaatcttactgaaatactgcaacaatccttagaaaaaccacttgtcatcaatttttacgcgccaacccataaagaatcggcggattttttggtgctacttgagcaagttgcagaacaatatcaaggacaatttattcttggaaaagtagattgtgaaaagagcaaatgattgccgcacaattccgcatccaagcattgccaaccacctattttgttaaagaagcacaggcattagagggcattccaggcatgcttgataaagcatcattaattccacgatttaagctttattttacctaaagaggaaagatttaaatttnccancaagcattagatttcttgcaagtaganaattacgaagccgcattgccattgttgaaagacgcnatgggaactntnccgataagaaaaaccagtgatgttgccctgctctatgcggaaacctatattgcaatgaagaaaacggagccagcacaagaaattttaaatcaaattccattgcaagatcgagatagccgttggcacggattacaagcacaaattgagctacaaattcaagcagccgatacacctgaaatccaacaattacaggctgattatgctaaaaacccaacagctgaaattgcaataaaacttgccgtacaacttcatcaagctggacgaaatgaagaagcattaacactacttttcggcattttaaaaacagatttaagcgcgcagaatggcgaagttaaacaacaatttttatctattttaagcgcaatgggcaatgctgatccgctgacaaataaatttcgtcgattgctttattcgctgctttattaagcaaaaagtttataatcagtaaaatgcaacttattgcattatattattacttaactacaaacaaggattctttatgtcagatatcaaacacgcaaaacttttaattttaggctcaggccctgctggttatacagcagccatttatgcggcacgtgcaaacttaaaacccgtactggtgactggtttacaacaaggtgggcagctgactaccacagatgaaattgagaactggccgggtgattttgagatgactactggttcaggtttaatgcaacgtatgttgcaacatgcagaaaaatttgaaacagaaatcgtcttcgatcatatcaatcgcgtagatttatcttctcgcccattcaaactttttggcgatgtgcaaaatttcacttgtgatgcattaattatcgcaacgggtgcctctgcacgctatattggcttaccttcagaagaaaactacaaaggtcgtggggtttctgcttgtgcaacctgtgatggtttcttttatcgtaataagcctgttggtgtcattggtggaggaaatacagcggtggaagaagccctttacttagccaatattgcaagtacagtgcatttaatccaccgtcgcgatagcttccgtgcggaaaaaatccttatcgaccgtttgtacaaaaaagtggaagaaggaaaaatcgttcttcatactgaccgcactttagatgaagtgttgggtgacaacatgggcgtaaccggattacgtttagccaacacaaaaactggggagaaagaagaactcaaattagatggcttattcgtagcgattggtcactcgccaaatacgaaaattttccaagggcaactagaattaaataatggctatatcgttgtaaaatctggtcttgaaggaaatgcaaccgccacttctgtggaaggcgtgttcgcagcaggcgatgtcatggatcacaattatcgccaagccatcacctccgcgggaactggttgtatggcagccttggatgcagaacgctatttagatgctcaagaagcatanatcttctaaccaattcccctcttttaactcttttaaagaggggaactttttctattatcacgaccannaacatgaatanacttcgccaaaatatttacaaaaatggcttcgcgcacaancagaacctatcaaaaattaatgcgtgcaaacattgncttagctacgctttcttcttcattttagncgcacaacttattttcttgcgacgtgctcgataactgatatgcaaatggcctcgtgatgactattccttat

SEQ ID NO: 514 - DNA, 6785 bp, H. influenzae
  misc_feature (5336)..(5336): n is a, c, g, or t
  misc_feature (5379)..(5379): n is a, c, g, or t
  misc_feature (5452)..(5452): n is a, c, g, or t
agttaaacctgccacgggccagtttgaatatctacgcctaattgtgagtgtaatgcgtggttacggaaagtcgaaactgttttggcattttcaatcccttcagctccacaaaaacgagcttgagcaaagggcaagtctgctgaaatacaaagcacaacagtattacttaattttaccgcttgttggttaaatttacgtactgaagtcgcacacacacctgtgtcgatgcttggaaaaatatttaggactttgcgtttacctgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattatttccaccaattaaagctatccagaatttgattttcgggaaaatttcagccaccacacaataaccaatagcaaagactaatgaaaacagtatgtgcgttaccccaatccagttaaatccgtgaaatcaatagggctgctcggtggaaaaggatgctccgctccccatttaacgaaagcagagataaaacctgcaaaaaattgcaacgccataacgacgtttagatggttctgaaaataagctcattgttgtatccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaattgattgattttttagcggttgtagagcgagtataagctttgtattacttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaacgcctgattttgggctttctgcttataaagataatgctgcagtaatggaaggttcgaaagtcgccgttggtttcctgatcctgatggacaatatcgtgttcatcaagaagatgcgcacattttaatgaaagtgaaacgcataaccatcccacagcaatttcgccatttcctggtgctgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgtgcgttacttttaaaacggaatttacgtatttgtaaaatgaataggtaggggtataattatctaccataactaaacaaatcacatcgtttacgatttgtctttttataaataaatattttatgaaggcggaattatgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgacttaaatagtacatcacaaagcaaacaaattattcttcaagaaataaataaggtaaaagaaaacaatattagaaaaaataataagattgtntactaaacataaaagaattactgctacacaaaaataagcaganatttatcgttccatttaaataactatggagagattatgtttattacacctatcttcattattaatctagaaanatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccattgataaattgatatagtagacaaagcagttgttaatgtttatttttaaatattagcaactgttttattttggaattccacgcaataatcctacaggctcaaaaggttctatagaagttggcgcgggcacttcgctgaataataaaataaatggcttgtgcggaataactttttcatttcgccataaatttcccattccgactaattgaatatcttcgggtaaattacgaagtcctgcttgtaaaactgcaatcgtattttggcgaggatgacctattgcaatggcgggagccgtgttttctagcatagtgaattgctgctttaaattgacgttgaacgtctgcgaattcgttactatcatctaaaaatatatggcgatctaatgaacgcacggccttggtctttttgctattttcccagctacagattttcctattggtcgacatctaaaaaaataaaatgttttcttgaagtgcggcattaaaaagtattaattgtgggatctggcgtagctgactcccataatgattggtcataccgatggcatcagcacaatatttttaggcgatataaccgacattttaattgggctgcagaatttctaaagcggccaacggctttatattactgg

SEQ ID NO: 515 - DNA, 5430 bp, H. influenzae
gagaccccatttttgcgcaatttgctatcaataaatccccaaatcaagccgacaatcaagcctgaaaatgtgcagcatttcccatttcaacaccaaataaggggctaataaaacctaatgcgatccccaccaataacattgtgaaaaaaccttctggcagatcaaataaatgatgattcaatttatcacgtataaatacataacctagaaccgcatatacaacaccagaaagcccaaagaaagcggggccagacacataattttgcacatatcctgttattacagatgctacaacatacaacatcaataatttgactgaaccaaaagtgcgctcaatcattccaccaaaaataaaaaaccaagacagattaaacaaaatatgcaaattagataaatgtaccaatgtatgtgaaatataacgccacgcttcgctatcttgctcttcgtaagcggggtagtgcatcaaatacataatatcgtcttcaaaacccagctgttgagcaatataaataagcgcacaaagtgcggtgagaattagcgtgatttttccttgttgagctaaaaagtttttcattcgtgatctcgtgtttctacggaaatttaaaaatctgacttcgcattaaaagtcattgtttcccctgtaatggggtgggtaatcgtcaattcttctgcgtgcaagcataatcttggcgacatagctttagcctgaggatgtgaataaaatttatcgcctaaaattggatgccctaaagccaacatatgtaatcgtaattgatgagatctgcctgtcacgggcgtcagtttcacgcgagtactgttattgggcaaacgtgctaaaacttcgaattttgtgaccgctcttttccctaaaacgaaatccaaacgttggcgaggacgattttcccaatcacaaatcattggcaaatttacctcgccataatctttctccaaatgcccccaaacaatcgcttgataatgttttttcggttcacgttcgcgaaattgacgttttaattcacgatcagcagccttacttaaagcaaacacaataataccgctcgttgccatatccaaacgatgagctggctcgcaaaagccgaatttttctttcactcggctcattgcactatcgtaatattgtggttgattacccggcacagaaagcaaaccactaggtttattcactacgcacaaatgattatcttgataaataatatctaaataaggttcaaggggcggattgtattcaatcaatgccatttttattccttgttcgtcacaatgacacgcaaacaatctaaacgccaatttgctttagaaagctcatccagtgattgtgttcgttgttgttccaaaatatcaatttcgctttggcgaatattttgatttaccgctcgcaaagcctgcaaacgattaatttctgcgcttaattgttgatctgcctgatttttagcttcggtaataatcggttcagctaaagattttacgagttgatcgcctcgtgtaatcaaggcttcaatattaccccgcgccatttttaccatttgattagcaatatttttaccaagtggttttaatttgctatgcaatgtttcaaaggcaacctgctcaccaatgttatttcctttgttatcaagcagcagacgaataggcgttggcggcaagaaacgattgagctgtaacccttttggcgattgactttccactatataaatcaattcaattaataaggttccagcgggcagttgtttatttacaagcaatgccattgcggctttgccaatatctcccgaagcaacaagatcaataccttgacgaatcataggatgatcccaagtcaaaaattccatttcttcgcgagcaagggcaagttctcgatcaaaggtaaccgtcacaccttcttcttttaaaccagggaaatctggcacaagcattgtccctgttgggctaattacaatactatttgcgccaagatcttcttgctctacgccaataatatcaaataattttaaggcaaaattcacaagctcaggcgaattatcttcatcagcaatttgatccgctaacgcttgtgcttgctttccaccattagaatttagttctaacaagcgatctcgccctttttctaactcaatcttgagtttttctcgcacagttttagtttgttttaataattcagaaaattcattctctgaaagtgcggtagaatttgaccgcactttttccaactcgtcctcaaactgcgaaaataatgccattcccattgggcaggtttgttcaaaagcattcagcccctcattgtaccaacgcgctaaacgaatttgaggcgaatctttcgcacaaggcacataaatttgcacatcacgtttttgtccaatacgatctaatctcccaatacattgttccaataaatcaggatttgtcggtaaatcaaataacactaaatttgctgcgaattggaaatttcgcccttccgagccaatactcgagctcagtaaaacctgtgcgccgttttctaaatccgcaaaataagcggcggctctatcccgttcgataatcgacattttttcgtggaacactgcggcacgaatcgcctcacgttcacgcaaaatttgttctaactgaatcgctgttgccgctgtctggcaaatcacaaaaattttttcatcgcgatgtagtttgaggaaattaatcagccaatcaattttatcattctcttccgagagtgtaatttggtggtaaacacggtgggggaaacctttcacgccttgacgtgtattgcggaataacattcgccccgtgccgtgacgatcaattaaggcttgaatcaattcctgacgggcacgatgctgttcttcatcattatttgatgcaatcgctttaaaaagtggctcaacatcttgttcaagcaacaaatcagaaatatgatttttttctaccgcacttaatgccttatttgccagcaaagattcaatagcattaaccacaggttggtagcgtttctgctctttcacaaaagtttgataatcaaagaaacgttctggatccagtaaacgcaaacgagcaaaatgactttcttgcccaagttgctctggagttgcagtgagtaacaagacagagggaatgatgcgagcaagctgttcaactaataaataagctgcacttggcgcgctttccgaccataccagatgatgtgcctcatccacaattaaacagtcaaattgagcatcaagtgcctgttctactcggtttggatgcgtttctaaccaatttagagaacaaataattaagctttcagtcatgaatggattaacagcatcaagatcaaaatcattgcaacgttcttcatcaaaaagtgaaaaatgcaaattaaaacgacgaagcatttccaccagccattgatgttgcaacgtttctggcacaataataagaacacgttgcactttctcagcaaaaagttgattctgcaaaatcattcctgcttcaatggttttccctaaaccaacctcatcagccaataacacgcgaggattaactcgattaccgacttcagctgcaatatgaagctgatgaggaattaaacccgcacgcgttccgcgtaaaccacgcaatggcgatttaaattgtgcttgctgatgacaaagcgtgcgataacgcaatgcaaaatgactgctgcgatcaatttgcgctgaaaacaaacgatctttcgcttggctaaaagaaataatcggcgaaatatcacgttcttgcacaatgacatcttcatcttgtggggttttaactaaataaaacaacaaaccgttcatattttgaacgtctaaaatctcgccttgccagccagcttgatgggataatgtttcgcctttgctaaacacaattcgacttaaaggtgcttgtgcagcagcatatatcctcgtttcatctgctgcggggaaataaatcgtgacggttcgttgatctaatgcggtaataacacctaatcctaaagcgttttcactttcactcaaccaacgctgaccaatagcaaagggcataataattctctttctgatttacattgataaaattttggggcgtattgtagctcgcatactcttgaaaagaaactcacaaaaaattgaccgcacttttatgaagatatacgtcacccccaatataatttattcttggattttcaacatactcaagcgtaaactagaatctcgactaaatccaccgtgtagggaaaagagatgaattatcgtgatgaattaattttacaatgggtaaatcaacaaggaaaagccagcgtaatagaacttgcacagcattgtgatatttcggtggaaaccattcgtcgcgatttgaacaaattagcgaacaaaggcttattgcaccgaacacacggaggagcagtgagtaataaaaccaaagatttaggttcatttttccaaactcgaaaacatattaatgcaacagctaaacgacatattgcccaaaaagccttggatttgctatatgaaaatgccgttataggtttagatgcaagctcaacaagttggtattttgcttatttaatgcccgatattccttgtacagtagtaaccaactcaatgtttaacattaatgccctagttaataaatccaatgttaaaactattgtcactggcggagtttattcagcaaaatatgaagcattttacggtcccttatctgagtatttattacaacgattacatattaatttttccgtgttttcttgttcaggaattgatcaaaacggtaatatctgggaatcaaatgagctgaatgcctctttgaaacgaaaaatgatagaggcttcagaacgtgcttatttgttaattgattcttctaagtttgaaaagaaaagtttgattcaacttaccgatttaagcaaaattaatacgattttttctgatcaaccacttccagataacttacaaaaatattgtgagctacacgatataatgaccgttttataaaaaaatatgaccattttgaccgaaaattattaaaaatttaaaatatcggtcatatatatttccttaaatatggtcaatttttgtgatctgcttctcagttttgcaacaaaatttcatttcttactattttcctcatcatttttctttcacactctaattcaatgaaagcacaatttgttccgcagtatttcatcattcttactaagcacaaacaaaggagtggtactatgggctcttgctactcaattaaatcgcataaaaatcggtattcgtcccactattgatggtcgtcaatggggaatccagaatctcttgaacccaaacatgcgtatggctcaatctgtgctcattattacaaaccatattcgcatcagatgtactttcgtgaatgggtagtgcagatgcctatcgggggggaactgagcaccgcctgccggataaattaacc

SEQ ID NO: 516 - DNA, 5562 bp, H. influenzae
ccccgctgcagtttgttggcgtaactctgcttccggcgtttttgttccttacgattttgaaccgaattttcattatcgcccactttttccgaaactttattttcagatgtgctattttgttcattcagccatttttgatagtcttctaaatcgcctttaaattcttccacttttttatcgtgaactaaataaaattcttccacggtattgcgtaataaatgacgatcgtgcgacaccaccaccaaagaaccttcgtaatctaccaatgcttccgttaatgcttgacgcatatccaaatccaaatggttagtcggttcatcaagtagtaataaattcgggcgttgccaaacaatcaaagccaacaccaaacgagctttttctcctccagaaaaagatttcactgcttgatttactttatcgccgtgaaacgcaaaactgcctaaataatctcgaacttgttgctccgtttgttctggtgcgagtttttgcatatgccacagagcagattcgtctgcgcgtaaagtatctaattgatgctgagcaaaatagccaagctgcacgccttttgccaactgcactgtgcctgaaagtgcggtcagttctcccgctaaaagtttaatcaaggttgattttcctgcaccatttttcccgagtaaaccaatgcgcgaacctggcactaaattcagtttaattttacttaaaatttctaccgcactttctccgctgccataacctgcacttgcctgttcaatcatcactaagggattcggcaaggattgcggtggacgaaatttaaaagtaaaaggattatccacataagctggtgcaatcagctccattctttctagtgctttcatacggctttgtgcctgtttggctttagtggctttggctttaaagcgatcaatatatttttgtaaatgggaaatcttttgttgttgctgacgatacatcgctgtttgttgtgccaatttagtggctcgttgcacttcaaaggaagaataatcgcccgtgtattcgttgagcttctgattttcgatatggaggatttttgtcacaatcggatcgagaaaatcacgatcgtgagaaattaataccaaggtgccttgatattgtactagccaacgctctaaccaaataaccgcatccaaatccaaatggttggttggctcatccagtaataataaatctgatggacaaagcagagcttgtgccaaattcaaacggatccgccaaccgcccgaaaaggctttcactggctgggttgtttcttcttgactaaatcctaaaccattcaataacgaagcggcacgagattgaattgtccacgcatccaaggtttctaattgcccgtgaatacgtgcaatggcgttaccgtcattgcattcatttgcttgttcaagctcttgttgcaaacggcaatattcacgatccccttgaattacataatcaattgcagaaatatccaatgcaggcgtttcttgattcacccaagatacccgccaatttgctggataatttacctcgccgccctctggcgttaattctttttttaataaggcaaaaagcgaagattttccacaaccatttttccccaccaagccgactttttgcttaggattaatggtagcagaagcattttcgagaagctccgtttgccctcgttttaaggacagattactaaatacaatcatttttctacaataggtcttaatttgaggctattttgcaatattttttcttttctcggaacagtctattccgattttatcgattttctagtcaaaaaagccaggtataataaggtgcaataaaaactatttattgagaaaacttaatgaaaatataacaagtcaatatgaaaataatgggtatatcttaggcattttttacccttagaggcacaatcgacagggttttccctaaaggagcgagcaattttaacaacgtttcaagttgaggattcgtttgtcctttttcaatgcgtgcaatcataggttgcttcacaccgcttaaggtttcaagttgtttttgggaaatcccaagttgctggcgagaagtaatcaattctttaattaaggctacacgtaaattactttcgcggatttcttcttcattgaaaatttgctgttcaaactcattccaatttgaacctaatgggctgattttattcatttttcaatctctcttttaattcacttaagcgttgttgggttgtttggattacataatctcgaattttattcagtttaattcgactatctttgctttcattttgagccagcgatagcagatattctttcactggctcaatgtcattttggtctctgtaaaagagaatctcgtacataatttatcctatttacttatttatttcaataactaataagttattgatttttgatgtgtaagcataaatagaaactaaaaatttggcgagatagtcatttcaatctttcgatcgagatcgcaaaaatagcaaaaagaggttgattttcaaggagattttgcacaaatgccgatgtttgaacattagctttgaaagagagagtaaaaggtagatcctttcttaagaaaaagtgcggtaaaaatttaccgcacttttgattttagacaggtttaaaactcaaattgaactgacatcttataatttctacctggtgcgtagaagcggttaatgccttgacctgtcttttgatctataacattacttgtaccaaatgaacgaattgaacgcgcagaatcccaagtgatgtatttacggtttgtaagattatatacgccggctcttatggttaaatttttaattggttgcacatatccaattaaatctagaatagtataagatttactgcgccattttatgctagtgttggtttggtttttatctttcgcataaatatcataagtatcttctggatttttacttgctacgtgggtagtgtagaaattaaatccaaatttttggcttgggtggtcatagcctaagccatacaccatcgttttaggctgaattgcattcataggaatattgccatccattcttcctttttgataggtatatttatagcttaggttaaatccatccataaattttgccattttaccaaggaatacttttgaattaatttctattccttttactaccgcactatctctattaatattttgataaagagaaaatggtaatgtgctacctccgctaactaatttaaaatctttttctcctttaaatattaggtcgataaagtttttatagttggttttaaatagacttgtggagataaaaccccaatcatcattatgtaatgtaaaagcaatttcttttgtttttgctatctctggttttagattagtatttggcaaaatagtgaaatcagggtgtttaaaggtgaaatacatttcatctgaagttggtgctctaaaaccttttgaatattttagttgtaaacgaagaaaactcgttggatcaatcgttgaaacaaaactgtaagaatgtgctttatattttttgttttgtttagcgatatagtcaatattttgttgtacgtttttcttaacttcaggatcatcattattatttttaccacttggtaatggaataaacaatcctttcacaatatcatcaggtaatttcggtgtaacgccgtgtttatattttggttgataatggatattgtcataacgataacccaaatcaaaagataaataatcagttataacaacattatcaaagagatagactgatttttcttttgttttaatgggtaataagaatgaaaatttaggatcaactcgagggcaaaggttagctttccaccccccataagcggttttacaagtgtgaggtttatcatacaacaaactgtaaccaagtgtaggctctgcccaccattgcacatcagaagcatcattaccagcacgattaaccattcgcttcatcgttgtattatatgagctaccatattgtagattatgttcaacacgccaagttttgaagtctttggttaaatctaaatttaattgttgggtgttggtgtctaaatctcgctcttgccagaggcgttctaaataacctggagatgagggaagaatagagtatgttttattattcgcatcctttactctagcgaaatttttgtcatttaattcttttatttcaagttcaaagtcttttttccacgttccagtagtgccatagccataaagatgttcagtttcaaaaaattttcattttttggttttatctttacaatcaaaatattgaaacaatcataccaagttccagaggatctcctttaggcctagtttaacctctattactcgatcatcagtatcaataaatttatcgaagtcctagatgctggtatcaatattttaacttttttttcaaatgaagttctgaacatctccgcggggttatttcccatctgttatttttagtcccgcaggatttgcagttccctcacaatatcttacacctgcatcacaatagtcatctgtacgtgcgcgagttttaatacgttgatctgaataagtgatttttaatgtatcccaaaatggcgtttgagagaaattttcatagctaaaggaaatattacgtctctttgttttatcattggtgtgtctagaatcaacctcgagtaaattaggatctgttttttgatattttagtgtataggataaatcttgcccacgagaacgatgttcatataaatctgctgcaagggtaaaacgatgattttctgtagggttaaaagataattttaataatgtactatcttgttcaattttgtatgggtctgctttttctctttttttaccttgagtaaggctatttgcatttttgtaatcatagttttcaagttcgtgtccatttctgcttgttgtaaccactaaggcatcaaactttttataacgtcctgcaagagtaagggtattgaatgattgattattttctgtagcgtatccctttttgtagcttacatagtaatccttgttaaggagataatctctcgcatcttttgttttataaattacagatccacctaaggaaccactaccacttttgattgaatttgccccttttgtaatatttacttcttttaaagtttcaatttctgcaccattacgcgtattattgaagttaccataaccctcaaaaagctctttaaagccttgagaagatagggtttcagcttgacgtaatccatcaatattaatcgctacacggttttcatctacaccacgaatggcaaaaccgctttgcccaaaacgcccagcttcaacaacagtaacgcccgtctcgtatttaacgatgcctttaatattggtttgtttgttccttttccatcgttttaacctcgttttaccgtttctttatattctccgtcggctcttttctattctcgtcttcttgccgcaccgctacgtcgatttcctcttatctttctataattcttatttctcttgtcttttcttgtctctcatctatactacttctcatactctttttgctttcttcacctcctctttccaccctttgccttaaagcacccttta

SEQ ID NO: 517 - DNA, 3625 bp, H. influenzae
  misc_feature (3586)..(3586): n is a, c, g, or t
  misc_feature (3589)..(3589): n is a, c, g, or t
  misc_feature (3597)..(3597): n is a, c, g, or t
ctgtatacgatatcgactcggtacccaacgttgccaacaactcgattaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaaaacgaagaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaataataaaagtgcggttaaaaatcttattaaattttaaccgcacttttttgtttattctacttctggtaaatttaccgcacctttatagcctaattgtcgccacgcttcataaaccgttactgcgacagaattggacaagttcatactgcggctattggctgtcattggaatgcggattttttgttccatcggcatttcatttaaaattgacatcggaatgccacgagtttctgggccaaacattaaataatccccaagttcaaatttcacttggctatgggctggactgccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctaggggttcaattaagtgcaagcgaaatcctgtattggcacaaaggcgaataatgttccccgtattttgtgggatttctggttcatataaaacaatatctaacataatttttctctaattctgatataaacgatagctcaccattcccgtcgttttttctttcaataacgtccagttttcaggagtaataagcggtttatctttctctgtttctacgtaaattaacgcattgggttttagccagttattttcacaaagcaaactaattgcttgttctgccaaattaaaatgaaagggtggatctaaaaacaccacatcaaagtgcggttgattttgtggctgttttagaaaatccaaactactttgattaattacttcagcctgttctgatgagcatttgagtgtttgtaaattcttttttaattgattggcaacggttttatccaattctaaaaaagtcacctttttcgcttggcgagaaagtgcttcaaaacctaacgacccactccccgcaaagccatctaaacattcagattgatagatataaggcattaaccaattaaaaagcgtttctttcactctatcgccagttgggcgtaagccttcagaatttaatacaggaagttttcgccctcgccatagtccagcaataatgcgaacttcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacggagttagccggtgcttcttctgtatttaacgtcaatttgatgtgctattaacacatcaacctccctcaatggggatnccntagaagtngaacctgcagggcatgcaagtcataggc

SEQ ID NO: 518 - DNA, 6796 bp, H. influenzae
  misc_feature (4732)..(4732): n is a, c, g, or t
agagacccctcacgtataaaaacacacaaaatttaccgcacttttgactcaaaaaaccaagtgcggtttatatttttattaaaggaatattatgtcatctattaaatatcgtccagaaattgatggactacgcgcaattgctgttatttcagtcattatttatcatcttaatgaaaactggttatcaggcggttttcttggggtggatattttctttgttatttctggttttctgattacgggtattattatcacagaaattcaacagaattctttttcgcttaaacaattttatactcgacgtattaaacgaatttatcctgcttttattacagtgatggcattagtgtctttcattgcgtctgttatttttatttataatgatttcaataaattaagaaaaaccattgaattagctattgcattcctatctaatttctatctaggattaacacaaggttattttgatttaagtgcaaatgaaaaccctgtattacatatttggtcattagccgtagaagaacaatactatcttatttttccactaatcctcattttagcttataaaaagtttagagaaattaaagtattatttattataacgctaattttattttttattttacttgccacctcttttattccagctaatttttacaaagaagtattgcatcagcctaatatttattatctctccaacctaagatttcctgaattacttgtaggatctttgttggcaatttatcataatctttcagcaagcaagcaagcaagcaagcaagcaagcaatgttattgcaatattaagtacattactattattttcctgcttatttttaatgaataatgatattgcatatattccaggtattactttaattctcccttgtatttttacagcattaattattcataccacatcacaaaataacattattaaattatgtttatccaataaagtgatagtatttattggaaaaatctcttattccctttatttataccattggatttttattgcgtttgcttattatataacgggcgaaaaacaaattaataatcaatctatcgctatagtaataatattaacaataattttttcagttctaagttattatttaatcgaacaaccaattagaaaatcgaaactaaactttaaacaaagttttctttatatttattttattccttctcttttactcttaggatttaatctttataaaagacaaacaatacgagctgaaaaagaacacattgaacaatcaattcctgtttctaatgaaaatcattatcctgctaaggtcattattttaggcgattctcattcttcacatttagaagcttttctaaactatgcgggaaataaagaaggctggaaagcagatattttcaaagataaatttgaatgtagctttattgtgaatgaacaatatcaattagatcctaattgccaatctgtatggcagaaagattctcaatataaagcgatatttatttcagcattttatgacttgagaatgggcggacagccagtacctcgctttagacccgaaactttcatagagccagattttaaagcacgttttaaaaacacagtgaaacaactagcgatgcaaaagcccgtatatgtttttgctaataatagctcagtaagccgttctccactgcgtggttacttattagaaaattatggacttgaaaaatatttaacgccaattcatcgtatgggcgatattgatgcgagtaacaaaattattcatgatttagtcaaagatattcctaatgtttattgggtagatgctcaacagtatttaccaaaagatagtgttatggcagaaggaaaatacttgtatggggatcaagatcacttaacaaattttggtgcttactatatggcaaaagaatttagtaaatatcaacgagtgatgacacctgaacaagtgaaaaaactctacgagtaaaaactaaaagcgttgagctatttgctcaacgcttttttatatttatttaagtatatccactaacttttcagcaataggtttacgccatccaatcagcagctcggggagtttgtcttgagaacaatcatatttccaaacccatttaattaattcatccaaagtgcgtttactcgcaaggatttcaggggttaaacctgctggtgttaagctattcactttttcttgtaacaatcgaattgtttttttataacgaggatcttcagaaatacgttcaataggttttgggtaatcattaggcgaaacgcgtcttgcttgagcaagcaattgtaaaatctttttaccacgcacgcgtacttcattttcagttaatcccatttctaacatttcagatgtattacgtggattattttttgccactttccaaagattatcggatttcacaatataagaaagtgctaaatcacgctctattgcgacgttttgtcgccactgagccaaaattcttaaacgagacaattcaaatggatttaatttccaagcatttggaatatctaaataagctttttctgaatctcgctcttgtaatttatgtgttttagcaagagccagttcgcaatcatctcttactgcttgttcccaaggtgttttcgctaactctttttcaagaatatgataaagcggtaacaaataccaaacatcgcctgcggcatattgaagttgaatatcagaaagggggcgtttgatccaattggtgcgagttgcgcctttatcgatttctatatttaaatattgttgtgctaattttgccaatcctgctgatgtgccaagcccaagaaagcgcgccataatttgtgtatcaatcattgggcgtggaagctgatcaaattcttgtaagaaaaccaataaatcttcactacaagaatgtaagatttttaataccttagggttggataacaatgcgacaaaaggagaaaaatccgtaatcgctaaaggatcaattaaagagacgcgctcgtcatcataaagctggattaatcccaacttaggaaaataagtggaaacacgcataaattctgtatctagggcaaccgcacttttcatctgagccaaattacaaatttccaatagtgcagcattatctgaaatgactctaaagtgcggtggattttgacattcttttatcatagtgattttttatttaaaaagaacaaaaatgggatattgctatcccattttgacattaatgttttggacgttttgcgatctcttcatcgcgtaaaacccgacgtaaaatcttgccaacattggtttttggcagttcgtctcggaactcaatttcttttggcactttatagcctgtgagatattgacgacaatggttgcgaagttcatcacgagttaaactatcgtcctttttcaccacaaagatttttatcgtttcgccagaaactgcgtgaggaataccaattgccacagcctcagacactttgtaattcagcataacgacatcttcaatttcatttggatagacattaaagccagaaaccaaaattatatcttttttacgatccacaatgcgtaagctatatgattcatccataatgacaatatcgccagttgccatccaaccgtcttttaacacttcactcgttgcttcaggtcgttgccaataacctcgcattacttgatcgcctttcacccataattcgccagcttcgccaatttttgcatcagagccatcatctttaatgatttttatatccgtatttggcactggcacaccaatagtgccattatgtttcacaacattaattggacaagcggcgattaatggcgaacactccgtcattccataaccttcaatgatgttacagcccgtcaattcgtgccaacgtgttgccactgattgttgaatagccataccgccacccacagaaagtttcaacgcagaaaaatcaacttctttgaaattttcattatttaacaaggcattaaataaggtatttacaccagtgattgcttcaaaacggtattttttcaactctttcacaaatccttcaatatctctcggattagtaattaaaatcgccgtgatacctaactctaaaaataataagcagtttaccgttaaggcaaatacgtgataaagaggcaaggctaaaatagctgaacgagtgcgagaatgatcgccaataaatggctctgcaatccatttagcttggaagacattggttataatatttccgtgtgtcagcattgcacctttcgccacgccagttgtaccgccagtatattgtaaaaaggctaaatcctcacgcgatatttctggacgaacatattggcgatatttaccaatactcaatacttcacggaatgttactgcgtgcggtaatttatatttcggcacgagttttttcacatattttacgacgaaattgactaaagtacgtttaccaaaagaaagttgatcgcccattcgggtaagaataacgtgtttaacattggtattgaaaacgactttttccaaggtagaagcaaaatttgataccacgacaatcgctaccgcaccactatcttgcaactggagctctaattctctcggagtataaagaggattgacatttactgcaattaagccagcccgtaaaataccaaaaagtgcgataggatattgcaataaatttggcatcatcaatgccacgcgatctccacgttgaagtttaaattcattttgcaaatatgcggcaaatgcacgactgcgctcttctaatntacggaaagtaagtacttgccccatattaatgtaagcggggcgatctggatgttcgcgcactgctttgtcgaacatatccaaaatagattcatattttgaggtatctagaaatttttcagaaccttctggataattttgaaaccaaattttttccattttttatcctaatttgttggaaaatctttaagattttatcattaattcaaataatagcgaatttcaggctgaacataccaagggcgatatctccatctaaaaaatccccaatcatcatcttcatcccaatcatctgttggatactcatagatggtactgagtgtccaaatacggtatttatccgcttgaacaacaggataagtataatcagcttgttctattttgcctttctctgttccagctaattgaccacctacagtaatataacgttcttttaaattttcaggctcaacaaaaccgttgaaatacacgataaagcgaccatcggattgcaattcaacaaatggtttacctgaaattgatgatacgggtaaacttaacacttcaatttttgtttgatttgctaaaacggtagtattgataatttttcctccaagtcgaactgttttacaatgacaggtcaaatcctgaggagaaatctcgcgataggaattaattgagaatcgctctttttctaacccttttggtggtgcaatacagcccgttaatcccaagcaaagtgcggtaaaaaataaggtgatttttcctttcattttctatcctccagttatttaaacttattcacgccctggtaattttttccaagtaacctcgtttcgcaaataaatcggttcaatttctaaagctggaattgtgtgtttttgcaaaaattctactcgcgcaagttctaacatatataaggcattaggtaatgctatatctgagccagttagattttttttagtaaattgagaataagcagcccaacctgtcccgactctaaatgcgttatcattttgaagctggttaatcgcttgttctggagaacaaacttgttctctaatgatttctcgccattgaaaaacttctccaaaatctgaccgcactttttctctcactacttgagaaaaatagacttcattcattctcgcatcaattgcggcaacaacattttctgcttgatgtaattcaaatgctgcctgagccattgcggttaaatttgaaattggaatgacaggcaaatccgcaccaaacgctaaaccttgtgcaatcccagcaccaacacgaacaccagtaaaactaccaggcccacgcccaaaagctaaagcattaacttgatttaaacctaaacccgaatttaccaaaatttcatcgatcataggtaaaattcgtttagtgtgtgtacgttgggcaagttcattaatatgtgttttctcaccacgatacaataaagcgacagaacaggcttcagtagaggtgtccaacgccaataaagttaaattttgcattcttattctcgtttacttattttgtaagaattgtatcactttgttgagatcacgggtacgacttgagttaggtaaacttttcaaaaaagtttcgccataattgcgcatcactaatcgattatcacaaataatcacaacgccacgatctgtaacatcacgaattaaacgtccaacgccttgtttcaaggtaattaccgcttcaggaatttgaatatcattgaatggatcgccaccttgtaaacgacaatcctcaatgcgagctttcaacaaaggttcatctggtgcggtaaagggaagtttatcaataatcactaaagaaagtgcatctccgcgtacatctacaccttcccaaaagctagaagttgccaccaaaacgctatgcgtttcttttataaattgttcgagtaatttgccttttgaggtttcgccttgtaataaaatcgaaagatgacttttttcacggaaatattcagctaaaccacgcatcattgaataagaagtgcaaagaacaaagcaacgcccttgtgcttcatccgggtatgaggggatctatagagcgaccggaggcagcaagaaggc

SEQ ID NO: 519 - DNA, 6477 bp, H. influenzae
agaaaaaggaacgacagagggggaaaggaacggagaaaaagaaagaaaagggagacgtctggaggaaagaagaaaagaggcgagataaaacaagagacaagatatagaacaggcgcgcaaggagggagagacaaaaggaaaacgccgagaagatagcccaagaagggcaagaggaaaattgtttaagcgggttaacattggcaaaaaagcggaagaggggtgccgacttcacagctaccagcgggaaaatcacttttaaatccccctcccgttaccgttggaaagcctgccgcatttaaccccgctttcaattgcatgagcccacaaataaaccgcaataccaccccaaccccctaatcatgcttttcatcagataaacagtctgacggttaattatcagccacgcttaacaccttatttaccatatcttcaggcatttgttggcctaatgggtaaaagagattaagtaacgagtatgcgctcatttattactcctgctttttacttttgccgtcttttttcgcatcttccgctttcggcgttacgtcaattaatacgccacgttcaattaaacgatcaagccctaccgcatcatcggcaatttccacctcttgattaggggcgataaactcgccgccaacacgaattaaacgcgcttcaatattacgtacaatcatcgctaaatctccgctttggttgccgataacggataacgtaagaacacgccgcccacacgagccacacagttcacaacaagctctaaattgcgttcttgtgccggtaactgggtaaaatcttgcggagtttcaagagttaagttatcaagggatttttcatagcaaatcgctaagtttttattccctgtacccgctttctctaattcccataagccctgaatagttaagttaggatgtttacgcttgaagaacgtcaatacgtccactttgtcagccgtgttcatatacttactggataacgtctgataatctgttagcgacaacaataagtgtgttggctgatgcacgccttttgattgcaacacgacggtatcgtgtagattgtccaaatccgctagcaccgcatccgccgttgcagttttccagccaccagttaccgaggtttctcctaaattcgggtggttaataaagccgtttaaaccaaattctttatctcctaacaaggcaatttcgttcatctttacttccaccgcacgacgcgctgcacgagctttagaagacggtaaatccgtttgattagctgacgccgctttcaactcttgtagattgtagccataagcagcaccgatgtttttcacttttactgcacgttctgtcatcgccacatccgcacgcggtaaatcatcggcatagttggcaacgactttagccatgccgaccatatcgtaaatgcgttcagtcacggtttctgcccattcaggggattcagaagagactgggacgagcgataagccattcatacccggtaatttttcttcatagattttgttgcgcacaaactctaattggcgttgcgtaaacaagcccgcatcttggttaaatacacccaccgcatttaaacaagtcttaatcgcattcaactcaaatgcatcttgacgaatatctgtcattatttttctccaataaaaaagccccaagttttcacttagggcatcgttaaacattgaataattaagctaactcgactaatgcgagcttgccatatttaccgcaatccactacggcggttttaaaggttgcattcggtaatgccgtaccagtttttgccaccttgcctgaagcggggtcaaaacttaccgcacttcctgccgtaatcgcttcactgtctttcactacacaccacgcaacccctttacgcaatacggaaaccgcatcaaatttcgcataaccgcctactacagcatgggaatgtaacgcaatgccaatgggcttagtgccacctaatttagcttgtgtggcactcgtcccttgcgtaatcactacgccgaatgggatttcattttctgctgcaaaggtttcgactaaatcgtaacggctgtcgcctttcataccagcaaaggctttttgttgtaattgatcgtacatagacatcgtttttatgctcctattggttacgacttgcaatcatcgcagctcgaccagttaatttcgtttggctatcctgcgtgaatgtgggttgatttgtggctgatggtgttaattgctgacgctgcacacctgccgcatccgctcgttgtttggcatcgcttaccgcaatatcaaacgctgcttcaatataaccatcggatttttgcgataaatccgcattgtcttgacgaattgccttaattaccgcttcacgcaacgcacggtcggtactatcagctttcacttccaccttatgcgctttcgctacgttttctaattcaacacgcaccttggcttgacttaccgcatcttgtttaatttgttcaacctgtgcttcaagatctttcactttcgcttctgccgcatctgcgcgcgccgcttctttgtctttcgccgtcacagcatctttggcgtcttgtttgagtttatttaattccacaatcacttcgggcgcggcttgatacgtaatgccgctatctaagcgaatgtcagaaagcgttgtttgagtgttactcatcggattttctccatcttcgttaaattccacggcatctgccgcatctaaattaagtgcggcattgcctgcacgcccaactgtcacaatggctaaatggttaggacgaatattacgctggatcacatcatacggctcgccgtcttctgttataccgctcgtctcgtcaatatctaccttatagccaaccgacaattctttttttccaaaatcaacggctttcgtattgtggatcacaatatctgccgttaaattttgcccatcttgtttaccttccgttaagatagagcccaccaccaaatgcgcattatttttcgtcacaagtccgtgatgatcttctgtaatcggcaatcccttgtaagcgcgtaaactatccgccttaaatacttcatcaggcggacgatattcacgccgagttttgccattaggaagctcataaacaaacaccccacttcttgtcagaataggggtgtcataaataaaaccgttatcatctcgccgtgcctgaatgccacggcggtcgtatcgcattaccatttttcttactccgcataaatcacaccgtttagatcttcaaattcagggaataccgcctccgcatagcaacgacataaaataggctcccccggatgtccgtcatcaggtggattatcccaatcaaattgtttaccctcacgatcaacgtggggcgcccgctcacgctcatcaagcataccgcgccaaatatacgacttcacgccgatattttgctggcgcaacttcgtcaaatgaccgtttaacttgccaatttggtcacgagcaattaatgttgcacgtttctcgttggtgttaaggatagacttcacatcatctaccacgctttcccaacgccaaccaccgcgcaccgcttgagtaaagcgactacgcaatttttctaacgtctgcgtaggaaggctttttattaggcggatattttcccattccgcaatttttaacgcatcatcaagccaaggttcagtcgtgaaaacatcgacgctataaactgatttcagcactttatgaaactgcttgccgttaaaattcgccgtctgatgaatatagccacgcacaaactgcgtaatttctttttcatcaacaaaaatcaatactgcttgcaataattcaataagccaacgttcaagcgtatcagaaaaactatcttgtcgaatatttgcctgaaagtgcggtcgaatttcaacgagtttttgattaaccatcgtattaatgtttctcgccacaccacgtaaataacccacatattcacgctcaattgcgtgaggaaacaaccacacctttggctttctgttcttcttgatacttttcaacatcatcgtcatctacctgtggcaatttgtccgcttgaatgccaaactctccagcaatctgtactcgcaattcttctgtggataacgcacccgaatcaaccaaattaattaagcgatcaagctcgattttcgctgcatccgcattcgttttacgcacatcggctatttctttgtcagttggtgtattaagcgacgggaatttgattttccagttctcaaacggcttaatatgcttttgaaacatcaatagctcaatcagcttttcaagcactggcttgattttatgttgctgaatactttcgaccaaatcgtaatagctttcaaaatcgctctgtcctgtggcgttcatacctttagctgactgcccgaataaaatcgccactggaatattcacatcagccgaaatcgctactttaaattcatcaagcacatcaacaatcccgcctaaatccgcattgagaatgttgtaatcgtcttcgctatcaacagctacgccatttaacagactacgcccacgttcaacaagattgatacgctctcgaataacaggctctaatccattatcaattgccaacgcaagccctttcattttatgaaccgcttgctgtttgcgttcaagaattaacgaagcccacatcaatgatttttgataatcacgaatttttggataaaccgatctaaccgcactacgcccaatccaatgtaagccattttttagacgttctggcaatgaatcgccgcccataaataacaaacggctttcatggatttctacctgactatcaagcgaaccagcaatcgtaccgatatttaaccgataactggaatagcgaccataatttggcttggttggatcggaatagcgattagccgtaggcgaaatttgacttaaatcaaacactcgcacttcatcgatacgtgtaatgcgacttggctctaacggctcacttaatcgcgcaccgtcatcggtcaataaaaccataaccgcaccaccaaaaaaccgcgaccaacgcaccatatctgccaatgcaggcaaaatcttcaaccgttcaatctcattgctaatcgcatcatcttgatcgccttgaatttcaatcgaacgtgaaatcgccgcatctgctggcatatcgaccacccgtgcggctaaaccacctaactcatataacgttaaatcaaaaagtgcggttgaatttgcagaatttcttgcaaaatgattaatccccaaggcttcggcgtagccgtcttgattaaatgccatattaacttcctaacccaatgaaacgcgacaatacatcttctttcggtgcgaaacacattaccaacgcatccgccttattcggtgacggaatgccacgctttttcatatctttcttactttctacttttacacgcccattaccgtcataatccacataagggcgagccaattctgcttttaaatattccaaatcccttatatcggaagaaagactaatcatctcatcaacgggatattgctcttcatacgttatcgcccgataggttttatagaaacgatcgcgtaaacgccaccacgcctgagccttaatattggcgaacatatcgcgattggttttaccataaacatattctgcatcaggttcaaataccgcgcccccagcattaaagccattaatacgaatggatttatcgtctaggcgatgatagtgtgcttttacaccggcacccacgccgatgctatcgtaaacaatttcatttgcgccaaattccaatgcattaagccgagttctgtctgcactaccaatcacatcttccccgcgccattcatcaacacgcaacaccacggatccgtgaacaaacgcattggcgttactatccacgccgtcatctgcaacatcaaagcccacaatcttgcgaccggcaggcaaaaagcccaatttcttatgcgcatcaactgcacattcaatccataccggcttaatgataaccttgtcactatcagcaactggctcacctagccaaatatgccgatacagttcatagtcacgctctttgcattcttccatttcaaggcgtaacgtttcagggaaataagggttttcatcgtagttgattttgcgaacgaacgaatttttaggcggcgcaataacaaaccgctgataggtcggatcaagaatatttttcgggttaaatgtcacccaaatttcagatcgctctttacgaatagtcggaattaaaatatcccaactctcattagagacgttttcggcttcttcaatccataccaaatcaatcccctcaagcgatttaattttgttcggattgttctttatgccataaaacataaactccgagccggttttcaagcagtaaatcgcattgcgctgtacttcaaactcttctagatagccaagatcttctatcgtatccgcaataagtttaatcacactatcgctcatcgagttctgcaattctcgcccgcaaaacacccgcactt

SEQ ID NO: 520 - DNA, 8439 bp, H. influenzae
  misc_feature (8309)..(8309): n is a, c, g, or t
  misc_feature (8427)..(8427): n is a, c, g, or t
gccagacttggctggcctgccaggtcgactcttatagaatcccccgccataactaaagaacgatatttttcttgcactgcatgcttatacgcattcatggtatttttataaccagcaaaagctgaaactaacataatcaaagtgctttcaggtaagtggaaattagtaattaagcaatccaccactcggaattttttccctggataaataaaaatagaggtatcagaaaaataaggctcaattaaatctggattgccaaattcttccgcagaaagtgccgcactttcaatagaacgaacagaagtagttcccactgcaattacacgtttgcccgctttctttgttgcgataatcgcattgcaaacttcttgagaaacttctacgtattctgcatgcatcacatgatcttcaatattttccacacgaacaggctggaatgttcctgcgcctacatgtaatgtaacaaattcaaaattcacaccctttgctttgagtttttcaagtaaatttttatcaaaatgcaaaccagccgttggtgctgctaccgcacctggtactttactataaaccgtttgataacattctttatcggcttcttcatctggacgatcgatataaggcggtaatggcatatgcccaatggtttgcaacacatctaaaagagcggttgatttatcacttaattccacttcaaacaacgagctatgacgagctttcattactgctttaatgccattattttcgcctaatttatcttcccctaaaaataattcagccccttctttaggggatttcgatgaacgaatatgcgctaagaaacgatgttcatctaacattctctcaactaaaacttcaatttttccaccactggctttacgcccaaacattcttgcaggaataacgtgcgtattattaaaaatcaataaatcgccttgatcaattaaatctaatacatcagaaaaagtgcggtgaaaaatttctccgttttcaccatttaactgtaataaacgacaagaaacacgatcagttttaggataacgagcaattaattcatcgggtaaatcaaagttaaagtctgaaacacgcataataaaatttaggttaaataaaataggcggtaagtctagtttgaattgaaaatgatctcaagaaaaaaactttcctcggggaagataaaataaccagcaattatgctggttatttgggattaattataaatttgcttttttagttgcttttacgtttacatcacaatttttaacgatgatgttatcgctagatttacctttttgaattaaatttacaggcacaacagaatcaaatttatctaacgttaagccactatctacattccaaacataatccccagaaacgaaacttgtaaagtcattttgtgatttatcacgagtaaaatctttcgcaataatgccatcgcccacacttaccattgcggcaactggttcttggttttcaaattgatacacagcagtcaccgtttgtttattgcaggaatatacaactgttttatcagttattgttggaagtgtttgcatttcagctatttgcgcagatgattttgtcatttcaggtgcatcctttgcacaagcagataatacgactacagcagcaaatgtgggtaaaattttagttaaattcattattaaatcctcttaattaatccctatatagggtgctacttagatacctttaataaaataaagttccattattggaataaaaaaggtgggatttgatctgccccaccttgtttatcaataaacgataaaattatgttgatttttaccaacgataccccaatttcacgcccacattttgctgtttgccgagttgtgaaccttgagattttgagataaaagcggaaagttggaaatgtaaaatttctgcctttaatcccacttctttttgccaataacgcccaaatgattgttgcaacatcgtgctatttacagtggtttgtacgttagcgtttgaaacatcaacataattaacgaagaaataaggcttaacgctgatattatctgtcggggtaaacgtataatcaactcgaatgccagcattatagcgattaaatgcaaggctcggtgtttgcactttcacgtcttcagattgataattttcacgttcaataaaatatcgattaacacccaaataaggctgaatacccaattgccctaaacggaactgataacttgcattcacaccataatttatcgcttttcgatgaatttttcggctttgttcttcagccattttactcgcactaattcccgcgcccacgtttacaccaaattgtaaatcgccccattgatattgggcgaaacccgacatcatcgttaatgtcgcgtgatttttaacctgttcgtcaaaggtattatctgaacggctatgcgagaaaaccgccccaattcgtccattatctaaggctttttgcaccccaatttgacgcaagttcgttttctgctgataagcacggaacgcatcagaatcatagcgtcttttatcctgtgcgatatttgtccacacagcagattgtgcttgatctacaaaaagacgatccaattcatcttgaacggaaagcatactatttactgttgcagacaactccgataacgcactatttgagtaacggctgatcaagtctttttgtttgccttgtttctcttgagcttgacgttcttttcccacttgcggttgggcattaataacctcaagtgcggcttttaatacgtctaactggctttgatcaggcgggggatcagaaaacaccgctctcaatgctctttttgaccgcgctttttttgtttttgccttacttttttgtgttttagcattcggttcagcttgtttggcttctaatgcgtttaacaggctttgagcaggcagggtatcaggcaacaccgctcttcttaaccgcacttttgccttacttgtttgtgtttcagcagtcggttcaacttgtttggcttctaatgtttgttctgcttgctctgctcttactaaatcattgtgcaattcctgctcttttattggattatgcaagcggaattcgccattattcttcactaatacataacgtaatgcacccgcatcaacgtggtcattttctaacgtgaatgtgagtttgtctgataacggttgattatctttgctttcaaccaaagttaattgctcaagggtttcgggttctttgcctgtgttgcgaacagataatatgtaatcgccctcagcgtcattggataattttaatttatcgcttttatagccaaataaagatgaagtaaattggaatgtgccttgcccgctcaatttaccatttactgtcaatgtgttgaaacgatgttctgccgatgttggcgtcgtttccgtctctaatgaacggcgacgacggcgtggcgtattgtttggactagctgaataagctgaatttaacgtaacagtactgttatttagtgttaaattctgcaatgtggtatcgctaggcattgtccaagtcgcattttccaacgtcactgttgtgcctttgtcgccctgaatttggtgcgaaagatggctgttttttaaataaaattgagcagaattcgttaaatgcacattaccgttcaagtttgcattatccaccgttgcagttgaattgtcggaaagtcggatattgcctatttgggtagcattgttgcttaatgtaaattggctgtgatttgttaaagtgacattgccattaagttttgctaaacctttaacattcgccgttgcattatcagttaaattaatagagccattgatttgtgttgttggtatagaattaataacttttgtgtcggttaaattctctgttttacaagtcgttaagcctgtccaatctgaacgcgtgcaaatggtattttgttgatttggcacaacaccaaatgtggcgttggcgttattgctgattgtccaatttccctcaattgaagaaacattgcgagaaaccaccgcacttccgcctttaatttggaagttttcagctttaaatgtgcggttgatccaatcgtcatcaataaccacttcgccttgaggtcgcccaagctcgtttgggcgatttaaatgattgtaagcgtgtggcgttgggcgaccactaaacactaaagtgccgccttcttgagtaatatcgccttttaagtttgtgccacctgaaagtagtaaagtacgatcttctgtggttggtttataaataaggtttaatcgtccattgtgtttattttcatctgtttcgccaaaccaaccgttgtaggcaatttctttgctgtaattaagtttattaatattatttccattaggtagaacaatgctttcgttcccagtaatagtgacattagcgacttcagttgtattatggttcacaatcatcgccccctcgtccgtattttggatacgtttaaaggttaatgaatgcccattaagatctaagcgaccaccacgaaagccgaaataaaatttatcggtatcaaattgtttatcatcgtttaattggacagtccctctgccgctaaccaatccgatttcactaaaggcttgttttttatgttgatcgtcctcttgttgttctaagattactttaccatcgccaacgctaattgagcctaagtttttaccttttgcttgaatatgtaacgttcctttaccaattttagaaaggcgatcattttctacgccattgactttccaaattacggtgctttcatcactgatagatatccccgcccctttccacgtttcattatgggtaggcgaaactataaaatctccctcaaaatacaaaccgcctgcaccttgatcgatattattactaaaagttagcaccccttttccgtaatcaataaaataaaggttttcgccgtgacttaatgcgggagaataattgtttacaccaccattagtatagacaggctccgtgcctttcatagataaattgtaattagcaagtttgactttataaattttaccagctccagatgtaatagtgcctgacccatcattttttgaatgaaatgtgtagtgctgattttgttgatttttaggagttctgaaatcaaatatggtcgttttaagattagcagagaaaatttcatcaaaataatttttacggactagctgaaaagtattctctctacctaaggatgggtttccagtacgcaatacaccatttataagccattttttctcggtagcatcataaataaacataggtgacccactgtctccaaatgatcctgctgtcggcataggtccataatcatttcctttacgtacatcgccacttaaactaacatctccatttcctgcaccagtttgcatatgggtattccccgcaataagatatccataagcttcagctacttgagttcctttatcttgttcatttctccaatattgatcaccagaaccaatccgcacacgcatcgggtatttttctttgtctgcataggtctgtcccttcatacttcctgtcatatcaaaaggagaactttcagttacaaatttatgtaaacgaggcatatggtaatccccattataatgatgcttctgatcaggtttataattattacgtttaactatttgataagtaaaacgatgttgatcgggattttgtccttccgcaccaaaatcagcattagtgtatcccccattgtgagcaacacttacaatatattgatcgcctactaatgcagcataaccactacgagcaacagatgcaaaatcaatcatcggagcttttgtcattgatttgccgaccaactccccttttttgttgtaaacctcaatatctttcgcaccgactgcaaacttccctttattctcagcaaaatcacgataatattggtagtcaatcccaaaataagtgtgacctgcccacgcttgcgatactatccctaatgaaatgcaagcggttaaaaaattcagacgaaatacagtttttttcataatgtttatttaattaagtaatttttcgtattaaaaaatacgtggttaaacgactattgaacaataaaagtgcggtgattttctaagggatttcagctaaaaaaacgaactaaaggcacaaaagaaaataaagcagtaaaactatatagtaattaagccaaaatttctaggtttttgcttaatacttagtgggtaatcttatcttgcgatggattaatattatatgtaatttatacagataactaaaattaaaacaatatcactaataaaataaccgcactttatgtgagttttctctgaaagtgcggttattttttctaaggtttttctaaaatcggtttaaggaagcgagcggtgtgggaactttctactttggcaacttgctctggtgtacccgtcgcaataatttgtccgccgccactgcctccctttgggccaagatcgacaatccagtctgcggttttaatcacatcaagattgtgttcaatgacgacgatagtatttccttgatcgcgtaatcgatgcaatacttcaagtaattgcttaatgtcagcgaaatgcaaaccagtcgtcggttcatctagaatatacaaagttttacccgtatcacgtttagaaagttccgttgctagtttcacgcgttgtgcttcgccgcctgaaagtgttgtggaagattgacctaatcgaatataggataatcccacatccatcaaggtttgtaattttcttgcaatcattggaatcgcatcaaaaaactcgcgagcttcttccaccgtcatatctaaaacttgatgaatcgttttgcctttgtaacgaatttctaaggtttcgcgattatagcgtttgcctttacattggtcgcaaggaacataaacatcgggtaaaaaatgcatttcaactttgagtacaccgtcgccctgacaggcttcacagcgtccacctcgtacgttaaaactaaaacgtcctggattataaccacgagcacgtgcctctggcacccctgcaaaaagttcacgaatcggagtaaataaacctgtataagtggctggatttgaacgtggcgtacgtccaattgggctttggttaatatcaataactttatcgaaatgctctaatccctcgatagattgataaggtgcgtaatccgtcttttccgctctatttaacgcattttgcgcaagtggaaataaggtgtcattaataagtgtggattttcccgaaccagatacaccagttacgcaagtaaacaaaccaacgggaatatctaaattcacatttcttaagttattacctgatgcacctttaagtttgagccattttttcttatcaagtgcggtgcgttttttcgggatttcgattttatctgcgcccgataaaaattttcccgtgatggaatttggattgagcataatttcatcggcatttccttgtgcaataacttgtccgccatgcacgccagcaccaggcccaatatcaataatatggtcagctgcacgaatcgcgtcttcatcgtgctccacgacaattaccgtattaccaagattacgcaaatgaattaacgtattaagtaagcgttcattatcacgttggtgcaagccaatagagggttcatctaatacatacattacgccaacaagtcccgcaccaatttgactcgcaaggcgaatacgttgcgcctccccacctgaaagagtttcagcagaacgagaaagagaaagataattcaaaccaacattgactaaaaactgcaaacgctcgcggatttctttaagaaattttttccgcaatttgtgctttttgaccagtgagagaaagtgcggtaaaaaattcaagggtttcgccaatgcttttttccgcaattatcggcaaattggtttttccaatatacacattacgtgcttcgggtcgcaaacgagatccgccacagtctatacaaggtcgattactaatatttttcgctaattcttcacgcaccgacattgattccgtttctttatatcggcgagccatattattcaaaataccttcaaaaggatgcttgcgaataaccacatcgccacgatcattcatatattggaattcaatttcctctttgcctgagccatgcataatgatatgttgaatcttctttggcaaagattcatagggcgcttcaacatcaaaatgataatgtttcgccaatgaggtgagcatttgataataatagaaattacgacgatcccaccttttaccgcaccaccagcaagagaatagtcggattttgcacacacgaatctcatcaaaatatgctgcacacccagccatcacaagtgggcaagcactgcaggatngtaaaggaaataaacgagctctaatctgcacagataacacatgcggacagcaaattgctgaaaataaatcttcgcttcgataacatattgcacaacgcatgcactgagcttaatgcgntcaagatcgctt

SEQ ID NO: 521 - DNA, 5870 bp, H. influenzae
  misc_feature (5437)..(5437): n is a, c, g, or t
  misc_feature (5597)..(5597): n is a, c, g, or t
  misc_feature (5741)..(5741): n is a, c, g, or t
ttttaatccgggcttcaaatttgcgggtgcggggcccggattgaaccggcgccctcggggtatgagcccgacaagctaccaagctgctccaccccgggtctgatgaggcgtactatactcgcttaaaatttaattgcaagaattaaacaaaactttatcaaatgtttgttaataaaatgttcaatgtgagttttattaagcaatttcactaaataacactggttgttttctgtaatttttgatagcgtatgcgaccttatttctgcttactttaggattgaaaatgtcggtgtgtaaaccattttggttcaaaactttttctatctcaattattaccgcacttttggtgtcttgtacctctaacataaaaaacattcagattcccaccaccttaaatggtagtgatcctcaacaattcggtgcaaaatataccaatcgaacttatcagcaagcagcgcttgtgcctgtatccaacatagaaaaccaaagtgcggtaataaatcaaggcgattttttaacacagctttccaatataaaaaattattcgagtaaactttccaccaatttttacgacaattatgaaaagattacaaattgggttctttctggggcaaatattaatgaactcactcaatttaatatccatccgcaaattatgcgtggatttgatgggtatcaaaatgtactgatgacaggctattattcgcctatactttatgctcgtcataccccacaaggtcaatttaaaaatccaatttatcgtatgcctgtaaaaaaacgtctaagtcgagcacaaatttatgcgggcgcattaacgggaaaaagattagagttagcatatagcgattcaatgttagaaaactttttacttggtgtacaaggcagtggctatgtagattttggcgatggtaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtgtacaaagcttgttagaacgcaatgaagcttatgtattctttaaaaatgatccaagtggcaaagtgaaaggctctgcgggcgttcctcttgtagcaatggcttcagtggcatcagatcgcaatattatcccgtctggttctgtgcttttagtcgaagtacccgacattgataataacggaaactggattggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaatggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatcttaatcacctcttgaaaatgcacattgaccataaatgtgcattttttattgaatgaaacctattgactttgaaaatgaaaaattttccctctttttactataaaatcgttgcaatttatataaaaaggcgtactcttttttccctttgagaattactaccaacaagtaaggaaacataaatatgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataaatctttctaaaaacaatgaccgcacataaaagtgcggtcattttctttgctaaatttgatatttagttttatctccaatatcaaaatgcaaaggcattcgccatttttgtatcgctaaaactaaaagtaatacgccagaaataatagaaaaaatgcgtagtgcaataagattatttaacacccacgaaaaccacaagcaagccacaaatatcggctgtaaatttagcaaaggcacgcggaaacaaaaatattctttaaaacacaagccacctaaagtaagtaacgcaccgccaagagccaacgcaggataatgattaatataaaaaagtaatcctatccaagtagcaaattgaaaaagcaatcgaaaagattttaagtaaatgtgtaacgaagaggcacaacaggttgccgcaattaatataaatgtgagtgataaatctggataccaactcactgtaagaacagccaacgccgctatcacaaaaccagttcggtaaataataacagtcagataatctaaaaaatccatcggtgatttaatatgtggatcagccattgtataaatgttcctttttatgaattacaaattaaaaataaatatagcctaaaagtcagaaataaaaagtacagtcaatttagaaacaggttctaaattaaccgcacttttattatttcagttttagcttatcaagaattttttgatgaatgccaccaaaactgccgttagacatcactaaaatatgatccgtaggttgagcctctgcaacaatcatatccactaatcgatctaaatttgcattccaataagcaggttgtacacattggtttgcaatatctgccacttcccaagaaagttgttcaggttgaagcataaacacggcatcagctcgaccaagtgcaggcgcgatgtcatctttgtgaacacccattttcattgtgttagaacgaggttcaagcactgcaagaatacgaacaccaccaactttatctcgtaaagcggttagcgtagcaagaatagcttctggatgatgagcaaaatcatcataaaccgtaatgccattaacttcacctttcacttctaaacgacgtttagcattcacaaaagatcccaacgctttgcacgcatcttcaatagcaacgccagtatgatgagccgcagcgatcgccattaacgcattatgcatattatgttgtcccactacattccattttacttctgccactttttctccatgatggaagacagcaaaatgtgaagcatcatttgtaatacgttcagcaaaccactcgttatctttgcctaaaaattgctgttgagaccaacatcccaatgccaaagtttcttttgcactttgttcactcgccgaacttaataccaagccactggctgggatagttcgaatcatatgatgaaattggcgttggatcgctttgagatcatcaaaaatatctgcatggtcaaaactaatgttatttacgataagtgtacgaggattgtaatggacaaatttcgaacgtttatcaaagaaagctgtatcatattcatcagcttcaataacaaaataagggctatctcctaaacgagctgaaatgccaaaattacccgcaattcctccgattaaaaaacctggttttaagccattttgttctaagatccacgttagcatacctgttgtggttgtttttccatgcgtacctgaaatcgccaatacccaacgatctcgcaataaatgatcatgtaaccattgagggccagatgtatatttcaaattattttccaacacatattctacgcaaggattaccacgtttcatcgcattaccaacaattaccatatcaggcgcaggttgtaattgtgcaacatcataatttggaataatctcgataccttgctcttctaaaaaagtgttcattggagggtaaacattagtatcggaacccgttacgtgatagcccatttgtttagcaatcatcgccacaccgcccataaatgtgccacaaatacctaagatatgaatatgtttcattgtatttctctgttgattaaggaaaacgaaaatatgataaaacaacttctatgaactttcaaaagatnagaccatcataccaaactatatgatctataattaacgccactgaactattatttaaccacttcaataggaataaacaatgaaatttaagcgataaaacaatttcagaagcacaatagctcactatttacaaaggaaataatcagccgttctatgtagcanatcttcctgcattacattttggaaaagtatttcagtcgatattatgggacttcattcattttgctgacggacccaaattggtttagttcagaacaaaataatcctataaaaatgcctgtgtaaaacacgcttttttttattcgnacttttagcaattcgctcaaaccaagtttcaaactggcattagttcattccattttcaaaacatatgcgcacgaataaagaacctggagaatacgttaaatttggccgaattggccatttttttggtgt

SEQ ID NO: 522 - DNA, 4644 bp, H. influenzae
agaaacattatctttatcaggcgtagaagaaattgcgcctaaaattgaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattgtaaataatattcaaaacattaattgacaattaatataaaggattttatcattgctccacttcttgcggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgttgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttggcacaatgtaagccaaatccacctacaccacaaaatagatcccataggttataaataggtaattcagatacccattgttgagctgttgcatataatccctccgccactttaggattagtttgaaagaagccttgtggacgaataaaaagcggaatactattgaaattttctggcaaaaattgttgttctgtcagaaaaatttcttgttctccctccaaaatagcagcgtgcagtggttgcaaattaacgctaaccacttctaagtgcggtagtttttctaataattttggtaattctcgacggattaacggcaatttattttctgtacgtaacacaaaacgcaacattaattttcctgttgcgatactttctgtcagtaaaatatatttaagctcgcctttttgtttagcaatgttataaggtactaaacctgcgcgaccaataaaatctttgaggattgaaaaaattattgagaaacgtgcaggataaagaggacaatcacacaaatcaatcgcactttgtggatcattaggattttttaaaataccaagtattgggcgttccacactaccactaacaagcattttagctttattacgaaagcattgttcattagattgaaaaggagctaaccattgagctttatcgcaattaatagaaatcagttgctgttttaaatgatgttgtttttcagcaagctgctgactataaggtatttcaagccattgacaagaacgacattcattttgttgatagtatcgacaatcaatcattttttgcggcctgaatatctagccaacggctttgaatatctgcgagatttcgatgattcagtttccaacgttgatctaaaaccaagtcattccattcgattacgctacgcttaaataaattttttaagcgagcttgacgagccataaagtgcggttcattttcagtaagttttagattatctaatacttgaatgacaccttcacgttcattgcacagtaacaaaagatcacaacctgcattcagtgcttttttgctacgctctacaaaattccccattactcccgcgcctttcattcctagatcatcggaaaaaattgtaccttggaaatttaatttcttgcgtaaaatttctttcaaccaatattctgaaccacttgcaggctgactatcacattgtccataaatcacgtgagcaggcataatcgcatcgagtttattttgtgaaatcaactgttggaaaggttggagatcgtaaccaaaaatttcgtcttttgcgcgatcatcataaggtgtttctaaatgggaatcggctaatacatgaccatgaccgggaaaatgtttacccgtagatgccatacctgcttgatgcataccatcaataaaattgatggctaaatttaccgcactttttacatcagatgaaaaactgcgatcaccaatcgctcgacattcatgccccaaatccagcactggtgcaaaactcaagtcaatatccaaagcaatcatttctgctgccatttgccaacctgcttctttagcaaaacttacttgttcagttgctgatagtgtttcttgaaaagcctgcattgaaggcaacattgtaaatccatcacgaaaacgttgaactcgtccaccttcttgatccactgtaattaataaaggcttttttactcgttggcgaacagaacgaattaattcttgaatttgttctctgtcttcaaaatttcgagtaaataaaatcaatcctgcaacaagagggtgcgaaagtaactcaacttcctcttgttccaactcttttccttttaaatcaattaacaaggtgctcataaattattttaaataaaggcggtaatttttactttctacagtaggtttaattaaatcgattgatttctcttcttgtggttttagcgaaaattgagcggaatagctttcttgctgattttcccaaatttgggtaactcctaaatgatcataccaatacaaatggtaacttacattcaaaagttgctgacttttattttttataaccgctgatttttgagtcgtttcaacttgaattaaaggcgaaagagacgacgtaatattcaaaatcggctttgttgaataagttaagttttgctctgaaattgaacaagctgcgagcataaagctcgccaaaattagaaaatattttttcattatttcgctaacattttacctaagggtcctccaccaactaaatgcatatgtaaatggatacctcttggcccacctatttattgcaattcacaattagcgataaccatctttcgcatggt

SEQ ID NO: 523 - DNA, 6150 bp, H. influenzae
gaaaactgacttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttctaatccgttaaaaaatttagcataataaagcacacttccacaccaagtgtgcttttcttttataaaacaaggcgaaaaatgaccgcactttattacacttattacccctcgccagtgggacggcttttgattttatctgacggcgaaagcattacacatattgattttgaaaaagagcaatatgcgcctaatccaaaatggctcaagcaagatgaattgcctgtttttcaaaaagtgcggttagcttttgaacgatattttaatggggaagttgagcgatttgcagacattcccttaaaaccagaaggcaccgcatttcaacaagccatttggcaagccttgcgagaaattgcttatggcgagctttcaacttatggcgagctggcgttacggattaataatcctaaagctgttcgtgccgtgggcggtgcggtaggcagtaatcccattagtattattattccttgtcatcgcattttaggtaaagatcgtactttaactggttttggcggtggcttagaggcaaaacgttttttattgcagttagagaaaattccctatattgataaaggcactgaaaacactaagcctcgcttttttaagaaatatcacgaatgattccacaaactcttgaacaattactttcccaagcgcaatcaattgctggcttaacttttggggagttagctgatgaactgcatattcctgttccgattgatttaaaacgtgataaaggctgggtgggcatgttattagagcgtgctttaggcgcaacggcagggagtaaagctgaacaggatttctctcatttaggtgttgaaactttaaaacattgccgattaatgcgggagggtaccctcttgaaaccacctttgtgagccttgccccgttggtacaaaattcagggattaaatgggaaaattcccacgttcgccataaactttctgtgtactttggatacccattgaagcagccgtcatattccattacgtgaacgccatatcggtgcgccaattttctggaagccaaccgctgagcaagaacgtcaattaaaacaagattgggaagaattgatggatttaattgtacttggcaaattggagcaaattaccgctcgaattggtgaagtgatgcaacttcgcccgaagggcgcaaatagtcgtgctgtgacaaaaggcattggcaaaaatggcgaaattatagataccttgcctttaggtttttatctaagaaaagaattcaccgctcaaattttgaaagcgtttttagatgtaaagccgctttaacttgattttaatattcgtcaaaaacacggaaaaaaccgaccgcactttttagctcattgccataaaaaattaaagggatccgatttcgttcccaaggtggtacgcttaattcttgccagattttttttatatcttctcttgggcgtttcggatgatgtttcactttgcccgaatagccaaaacgaatagaaataggcaagttcgttttttccagcgtaacagagtaatcctgccagtagaaaatcagattatgttcattttcgtgaacagtgagattgcctaaatcatcgggtaaatttagcatgttttgttctaattttagggtgcatttggttagatcagaaaacggcttagttaaatataaactatcttgataacgtcgaataactttatttacaagctgaaattgaggatttgcctcttcttttgcaaaaatgacatcattaataagctgtgtaagctggcgtttacttggcatttcaagttggtttttggcaagccacatacgcaaaagtgcggtctgttttgcgagagaatattggcgaaattggagcagtttaaattggtttttaatttgacaatgttctgtaaaaatttcgctcaataaatcattaattaactgttgttgctcaaaacaatgttgtgcggaacgttgtacggctaaatcaaaatgcgcccagcgttcacgtaattttggcaaaatttcattgcgtaagaaattacgatcgtatcgattatcctcattactttcatctgtaacccagttgagcttttcttgttgcgcataatcttctaactgtgggcgagtaaaacctaacaaagggcgaaaaattggcattccgaataatacactttgttgttgcattgcgcttaagccttgtagcccactgccacgttttagggctaagaaaaatgtttctgtttgatcgtttagatgatgcgctgtaactaacatttcttgtatttgaagatgtttttttatggcttgatagcgtgcttcacgcgcccctgcttcaatgccattggttttatctacttgtactcgctcgataatcaatggaatttgaaattgatcgcacaagttttggcagtgtttagcccaactatctgcattggggcttaagccgtgatgaatgtggattgctcgtaccgataaaggcggtaagtgcggttgtttttgacaaagttttgcaaataaagaaagaagtacagtggaatctaaaccaccactcaaggcgataagaaacccttgagcggtggctttttggagttgtttttcaatgtctgaaagtaaatccattaggcaactttttcagctttatagttactgcttggattaagaatttcaaaacgtgcagcaatggtttgtaactcgtaagaacccagttcaaaggtggttttcattgtgttttctcctttgttgtatatttagatcaaaaaagagcggcaaaaatcaccgctcttttagaaagttagttagcaataaccataagacattaaacgttcatagcgtctatttaataattcttctttgcttagttcatcgagttcagctaaatcttcttttaaacgaagttttaagttttcagctattttcgcataattgcgatgtgcgccacccaaaggttcttgcataatgctgtcgataagatttaattcttttaaacggcttgcagttaatcccattacttctgctgctgttgatgccttttccgcacttttccaaagaatagaagcgcagccttctggagaaataacagaataagttgaatactgtaacatattcactttatcgcccacgccaatagctaatgcaccgcccgaaccaccttcgccgataacggtacaaataacaggaacggtaagctgtgccatttcgcgtaagttacgggcgatagcttccgcttgaccacgttcttctgcgccaatacctggataagcccctggtgtgtcaataaatgtgataattggcaatttaaaacgttcagccatttccattaaacgtaacgctttacgatagccttcaggtgcgggcataccaaaatgcgttgtactttttcttttacagaacgacctttttgatgaccgataaccatcactggacgaccatctaaacgcgccaagccaccaacaatcgctttatcatcagcaaaagcgcgatcccctgcaagttcttcaaattccgtaaaaatatgttcgatataatctaatgtataaggacgatttggatgacgcgccatacgtgaaacttgccaagcatcgaggttagcaaaggtttttttagtgagttcgttacttttcttttgtaagcgtttgatttcatcagttaaatcaactttatcatctgatgctgctcgtaatgcttcaatttttgcttctaattcagcaatcggcaattcaaaatctaaatattcttggttcattttgttatcctaaaaagaccgtaaaaatcgaccgcactttatcaagaattaaactgtggcgcaaatggttttcactggttgggcaagcttataatcgctcttttttgaagagtgataagacaaataaaaacgcagaacaaatcacaacagaaggcccagcagcagtatcataaaaggctgataatattaatccacctataatcgataacatactcataataatcgcccagcccaccatagattctggcgttctcgcaaagcgacgagcggttgccgcaggaatgattaataaggatgtgataattaatgcaccgacaaatttcatactcaaggcaatcgtcaatgcggttaatatcattaaaataaaacgcatttttttgatattaatgccttcaacttgtgcgagttctggcgatacggtggtggaaagtaaggattgccaaaagtaaattaatgttgaaagcacaattattacgccaatcccgatataaattaaatccgtataattaattgcgagtaaatccccaaataaataattcattaaatctacccgtacattccgtaataatcctactgtcacaacgccaagagataaacagctatgggcgataatgccgagcaaggtatcaatagaaaattgcgtattgctttctaaccacaccattgcgatagcaagaattaaggtaagcaccacaatcgcaatgtaaggattgacttgtaagaaaatacctaatgctacaccgagcaaggcagaatgagaaagggtgtcgccaaaataagccattttacgccacaccacaaatacgccaagtggcgcggtaataagcgaaagcacaatgcctgttaaaagggcaggaaataaaatttcaaacattatttatccttattttgacaatgcactgctgatgaattacaaccgcacacatcgccgtgcaaggtgtgatgatgattgtgatgatgggtataaaagccgacattttgtgcgatctgatttccccataaacgcataaatgttggatcatttgagagaacatcgggcgtacctgcacaacaaatatgttggttaatacacaatacttctttactatccgccatcacaatatgtaaatcgtgtgataccatcaatacggcacaatttaatttttgttgggtttgatgaattagctgataaagctcagcttgaccagtaatgtctacgccttgagtgggttcgtctagcacaagtaaattcggtttatttaaaattgcacgcgtcaataatacacgttgcatttcgccaccagaaagtttttgcatattgcttttgcgtaaatgtgaaatcgaaagttgctcaagtgcggtggatatttcttgggttttaatgcctttttttagcgaaagaaatcgctcaaccgtaataggcaaactatgatccaaatggattttttgtggtacataaccaatgcgaacatttttactataaatgacttcgccagaagtgggcatttgtagttttaataaggtttttaacaacgtagatttgccaccacctttg

SEQ ID NO: 524 - DNA, 6415 bp, H. influenzae
aagacaaaaaaagaaaaaaccacggggacgccggtcgaaaagagaggatgaaggagagaaccacgcagaacaggggagaccggccggaggatggaagagaagtggggtccaatagttgggggggtagataaagaaggcggaagtcgtaatcccatgaccagttttgggaaggaagcgagagagatacccaccccgtaaaaacatcattgtgttaattctgggattacgaatatatttgcgcggatttggcacgatatgcttaggggataaaagcaataatttcgtggaatgaagttggggtaatatcgctaatgttcttttgtttgcgtcgcaaaccccttcatgggcagcgacaattaacattgcataatgcacaccaccctaaacctgccagcatgtttgacaagaatttttcatgccccggcacatcaataaagccaagtactttgttttctaacggcagataggcataccccaaaatcaatggtcattccgcgttttttttcttctggtaaatgtgcggtacttgtgccagttaatgcttttaataatgctgttttgccgtgatcaacgtgacctgaagtaacaataatcatagttcatccaatgtatttaataatgtttcaatagctgcaaggctacgtaaatctagccaaatttttccgttttccattcgcccaataataggttgggaaagttgtttaaaacgagctgaaagtgcggaaagttttacgtttgttttttctgcaatagtaacagccacggaagggattctttccattggttgtgagccactaccgatttgtgcttggctagcttcaatttgaatatcaaattgtgaatttaagcgagattctaaccgctctttgagacgcatagcatttattttgagttgttttaatggttgcgtgagtaagtacaaagttggtaatttttcagttaatttttcaggatttaaatacaaacgtaatgtggcttctaagccagctaaaatgactttatcgcaacgtaatgcacgcttgagaggatgggcttgtaattgttcgatccattcttttttacccacaataatgcctgcttgcacgccaccaagcaatttatcgccagagaaagagaccaaacccacaccttgtgcgactttttcttgcacagttgattcttttggtaagccatattggcttaaatctatcaatgcgccgctacctaaatcagtgactactggtacattcatttctcggcctagttccgcaagctcttcttctgaaactgaagaggtaaaaccacaaatttgataattgctgctatgcactttcattaaaaaagccgtattttcagtgatagcattacgataatctttcagatgggtacgattagtggtgcccacttccactaaatagcatccagcttgttccataatatctggaatacgaaatgcaccgccgatttcaattaattcgccacgagaaataattacttctttaccttgagcaaaggtcgctaacattaacaataccgcagcagcgttgttattcactatgcaggcagcttcagcacctgtgagtttgcataataattcactgatgtaattatcgcgatgactacgcttacctttatctaaatcatattcaagcgaaacatttttttgcatcacagaaagcgctgcttgttgtgctgcttcagaccaaagtgcccgcccaagatttgtgtgcaataccgtacctgtcagattatgcaccgctttgatttgtacttggttttgtttttgtaggcgagaatgaatttctacaaaagtgcggtcaaaattagaaaaatattcaggaagttgattgtttttttttataaattgacgagcttgggttaataattctcgacatgttgccacgactgcagtgtgaccaaattcggtaataagttgtagaccttgagatgttttgagaattttatcaacggaaggaagttgttgaaaaagtgcggtcatttttgaatccgtttaaaataacgttgaattgccgattaatttacgctaaagtgaccgcaatttcaaccacggaggggcgtcatctccggtgaggtggcaggatttcaaatcctgttgaggacgccagcgttcttgggtgggttcaactcccattcccctccgccaatccatataaacctttgaatttatcgctaggatataatatttaccccaccattttctttaactgatacaaatacgccaaggcttgtttagggcttaaatcatcgggatccagcttttcaatagcctctcttagtgcatccgtttcttgttcaaacaataattcgccctgattgtgattggcttcacgcaacgcttgaatttgctgttcggctgaatagcttgagtttttttctaattgtgtcaatttctgttttgctagtttaatgacggattgtggcacgcctgccaaagccgcaactgccaaaccataacttttacttgctgcgccatcttgtacggcgtgcataaaggcgatgctgttgttatgctcaagggcatctaaatgaatattggcaatgccttctagctgttccggcaatgcggttaattcaaaataatgggtggcaaataatgtaagcgagcggatttttttggctaaccattccgcacaagcccaagctaaggataagccatcataagtggatgtgccacgaccgatttcatcaataagcacgagactttgctcagtggcttggtgaagaatatttgccatttccgtcatttccaccataaaggttgaacgccccgaggctaaatcatcagacgcaccaattcgagtaaaaatacgatcaatcggcccaattcgcgcactgtctgctggcacaaagctaccgatatacgcaagcaatgtaattaatgcggtttgacgcatataagtacttttaccacccatatttggcccagtgataattaacaaatgacggttgtgatttaactccactggattggcaatgaaaggatctttcaatacttgttccacaacaggatggcgaccattttcaattttcacactcacttcatcacagaatgttggcataacgtaattgagggtatctgcgcactcagcaagattgactaacacatccaattcagagagtgcaaggctagccagttgtaatgaacctaagtgcggtaataataaatcaaacaattcatcgtaaagctgcttttctaatgctaacgctgcacctttcgatttcagtactttgtcttcatattctttgagctcaggaataatgtaacgctctgcatttttcaaggtttggcgacgtacataatgaatgggtgctttatgcgcttggccttggctaatttgaatgtaataaccatgcactgcattaaaaccgatttttagcgtatcaatacctgtactttcacgttcacgtttttcgagattttccaaatattgcgttgcaccatcagacagcatacgccattcgtccaactccgcatggtaaccttcagcaattacaccaccattccgaattaaaagcggaggcgtttcaatcaatgcacgttgcaataaatcccattgctcactgaaatcggcaatttggctgaaaagtgcggttaaaaatggcgatgttttttgttgcacaatcgtgcgtaatgcaggaatttgttctaaggctgtgcgtaagcgagtgagatcgcgaggacgcgctgaacgcagagccacacgcgctaaaatacgttccatatcgccgactaattgcaaataaggttggagttcatcgactaaatcaaaattcagaatttccgcaatcgcttgttggcgttgttttaatttttccacatcacgaataggctgatgaatccaacgtttcagcaaacgactgcccattggcgtaacgcatttatccaagacagaggctaacgtattttctgtgccacccgaaagattttgtgttaattcaagatttctgcgcgtggcggcatctaactgaatgcagtcttggttttgaattaagctaatgctttgaatatgaggtaatgcggtacgttgggtttcttttgcatattgcaataaacaacctgccgcacttaagccgagaggggatttttctacaccaaaggcgcgtaaatcttttgtgccaaattgacgatttaataacgtaatggcagtgctaagttcaaattcccaaatcgggcgacggcgtaatcctttacaatgttctatggctgccatttcattaaattcttcacaatacagcaattctacaggcacaatacgttgcaattccgcacgcaatgtttctttatctgcaggttcacaaagctgaaaacgcccagaagtcatatctaaagtggctaatccaaatttttctttttcttgatataccgcagcaatcagattgtcttggcgttcaggcaacagtgcttcatcactgaccgtaccgggcgtaacaattcgcacaatttgacgttctacaggtcctttgcttgtagatggatcaccaatctgttcacaaatcgccacagattcgcctaactgcactaattttgctaaataaccttccaccgcgtgataaggcattcctgccattggaatgggctgtcctgcagattgccctcgtttcgtcaaagaaatatccaacaatgccgccgcttttttcgcatcgtcataaaacaactcgtaaaaatcccccatgcgataaaacaacaaaatatctggattctctgctttgagttttagatattgttgcatcattggcgtgtgctgttggaaattttcttcggaaatcatctaattacctgctttgaaactgaataaagataggttttatggcggctattttaggtgccgaaaggggaaaaagccagataaaaaagtgcggtaaaaatttgttgagattttttaccgcacttaaaattgatattttccccttagaacttaaagaaaggtaagcagccaaacattgcaagaaaatggaaaatagctacaaaaacaccaaataatgcaataaagattattaaaccatttccaccacacactcggaatgttgcagctgtatttattttgcgggatttataggcaagaagagcaggaattatacttgtccaaatcgtagctaccgcaccagcatacccaatagcttttaagaaacccaatggaaataaattgacataattagtggaggtaggaaagtcacagcccatgactttgttcgtccaattttacaattatcaaatttaaagaaatcagccaaataatcaaatacgcctaatcctacgccaataaaagatgataaaattgcggcgatagaaaaggcattaatcatttgtttaaccgtgttagattcgattactccacctaatgtgttaagtaaaatatctaaattaccatcactggcaattactggagcaaattgatctcgcggtaagttgccaaaaatagagaaaatccaaagtaaataaagcgtaagagcaattgctgttccacctaagatagcgtattttgcttttttttcttccccatagtaagctcgcatcgtacaaacagaatgatgatagccaaaagatgttaatgcaacgggaaacattcctaccgcatattttgcataatttgtctcctttccaccaatatctaataaagtgtctaaactaatattagttgctaatccataagtactaaaaataaaagtaaaacccatgcatacaatcaataaaacagatattctgtctacaatgcgagtggagtgccaaacaaagaaggaaaaaactaatacaaatacagtggaacaaattgccaatgtagatgaaccaaaatcaatccacggtttaataaggttttctagtataccgccagatgcagtggtataagcataaagtaaaatacccccgacaaaatataccgcaagattattaatagaattgacagttgaaccgagcatatctttagttacagtactaaatgaagctcttaaatcataagtagagtaggcctcaagtaataaccagcctgacaatgtcatgactatcattgttaagcaaattactaatactgaccatattgtccaagcacccgcgccagatgtcggcaaaccaagcattcctgccccaacacaaacactagcaataatacacgcaccaccaaagatggaaggttgttttttcatataacatccttatcaataacaaaatattgagttagctgttgataaaaaaatgcagttcaaaatgaactgcatttttcgtgatattattcaacttctttataacgtgccgtaaagaggcggaaaacttttggtcataagtaaaggtaaacccctaatattctctgcattttctttcactttttggaaagcctcataaggaaatccatatgccgttgcgtataaatggaccggggatagtataacctaaagctcccgtggaattgggggatttcac

SEQ ID NO: 525 - DNA, 6363 bp, H. influenzae
accccttcatccattcaatcattgggcgtttattcctgttaattttattcttgaaacggtgactttattggctaaaccaatttcacttgctttccgtttgttcggtaacatgtatgcaggggagttgatctttattcttatcgctgtaatgtattccgctaatatggccattgcagcattagggattccgttacatcttgcttgggctattttccatattttggttattaccttgcaggctttcatctttatgatgttgacggttgtttatttaagtattgcttataacaaagcagatcattaatcgttttttattaaccagctctagggctaaaacttaacttctattggagaaaattatggaaactgtaattacagcgacaatcatcggtgcatcaattcttcttgcatttgctgcattaggtactgcaattggctttgctattctaggtggtaaattcttagaatcatcagctcgccaaccagaattagcatctagcttacaaactaaaatgtttatcgtagctggtcttttagatgcgattgcaatgattgctgttggtatttcattacttttcattttcgcaaacccattcatcggtttattaaactaatcaccttatttgcttatcaacgtaaaacaagcatagtaaggaggacgttgtgaatttaaatgcaacattgattggtcaacttatagcattcgcactttttgtgtggttttgcatgaagtttgtttggccaccaattattaatgcgattgaaacacgtcaaagccaaattgcgaacgctttagcgtcagctgaagcagctaaaaaagagcaagcagatacgaaaaatcttgttgaacaagaactttcagctgcaaaattacaagctcaagacattttagatgctgcgaataaacgtcgcaatgaagtattagacgaagtgaaggcagaagccgaagaactaaaagcaaaaattattgcacaaggttatgctgaagtagaagcagaacgtaaacgtgttcaagaagaattacgtcttaaagtagcttcattggcagtagctggtgctgagaaaattgtgggtcgttctattgatgaagcggcaaacaatgacattattgataaattagttgcagagttataagaggcttagcttatgtcagaattaactacaatagctcgcccttatgcaaaagctgcattcgactttgccattgaacaaagtgcggtcgaaaaatggactgaaatgttaggttttgctgctgccgtagctgaagatgaaacggtaaaagcttacttaagtagttctctttctgcacagaaattagctgatacagtaatttctatttgtggcgaacaattggatcaatatgggcaaaatcttattcggttaatggctgaaaataagcgtttgagtgctattcctgcggtgtttgaagaatttaaacatcacgtagaggaacaccaagctattgcagaagttgaagtaacatctgcgcaaccattgaatgcaacacaaatcgaaaaaattgcagctgcaatgggaaaaaagattagctcgcaaagtgaaattaaattgcaacgtggataacgcacttattgctggtgtgattgttcgtactgaagactttgtgattgacggaagtagccgtgggcaacttactcgtctcgcaaacgagttgcaattataagaggaatacaagatgcaactaaattcaactgaaattagtgaattgattaaaaaacgcatcgctcaattcgacgtggtcagtgaagcgcgtaatacagggacaattgtttctgtaagcgatggtattattcgcatccacggtttaagcgatgtgatgcaaggtgaaatgatcgccttaccaggtaatcgttatgcgatggcacttaaccttgaacgcgattctgttggtgctgtagttatgggaccttacgcagatttagcggaaggtatggaagttcaatgtacaggtcgtattcttgaagtaccagttggtagtggtttattaggtcgtgtagttaatacgcttggtcagccaatcgatggtaaaggcgaaattgaaaatgatgatttctcaccagtagaagtgattgcgccaggtgttatcgatcgtcgttctgttgatcaacctgttcaaactggttataaagctgtcgattccatggtaccgattggtcgtggtcagcgtgagttaatcatcggtgaccgtcaaacgggtaaaactgcgttagcaattgacgctattattaatcaacgtaattcaggtattaaatgtatctatgttgcgattggtcaaaaagcctctactattgcaaacgtcgtgcgtaaattagaagaacatggtgcgcttgcaaatactatcgtggtagctgcatctgcatctgaatcagcagcgttacaatatttagccccttatgctggttgtgcgatgggggaatatttccgtgatcgcggcgaagatgcgttaattgtttatgatgatttatcaaaacaagccgtagcttatcgtcaaatttcattattattacgtcgtccaccaggtcgtgaagcctatccaggtgatgtgttctatttacattctcgtttactagaacgtgcttctcgtgtaaatgaagattatgtagaaaaattcactaaaggcgaagtaaaagggaaaacaggttctttaaccgcacttccgattattgaaacccaagctggtgacgtatctgcgtttgttccaaccaacgtaatttctattaccgatggtcagattttcttagaatctaacttgtttaactcaggtattcgtcctgcggtaaacccaggtatttcggtatctcgtgttggtggttcagcgcaaactaaagttattaagaaattagcgggtggtattcgtactgcactagctcaatatcgtgaattagcagcgtttgcacagtttgcatcagatctagatgatgcgactcgtaagcaactttctcacggtgaaaaagtaactgaattattaaaacaaaaacaattcgcgccattatctgttgcagaacaagcggttatattgtttgctgttgaatttggttatttggatgacgtggaattatcaaaaattgcaagttttgagaccgcacttttagattattctaaccgtaatcacgctgaatttatgcaagagcttaataaaaccggtaactataatgatgaaatcaaagatacgttaaaaagtattttagatggttttaaagcgaatagtgcttggtagtaacggagagataagatggcaggtgcaaaagagataaaaaccaaaattgccagtgtacaaagtacacaaaaaatcactaaggcaatggaaatggtggcaacctcgaaaatgcgtaaaacgcaggatcgtatggctgcatctcgtccgtattctgaaactatccgtaacgttattagtcatgtgtctaaggcaagtatcggttataaacatccgttcttagttgagtgcgaagtgaagaaaatcggtatcttggttatttcaacagatcgtgggatgtgtggtgggttaaatgttaatttattcaaaaccacacttaaccaaataaaaaattggaaagaacaaaatatttctacagatttgggcttaataggttcaaaagggattagttttttccgttcctttggatttaatatcaaaggtcagctttctggtttaggcgatacgcccgctctagaagagttaattggtgtggcaaatacaatgtttgatgcttatcgtaatggtgaaattgatgcagtttatattgcatacaataaatttgttaatacgatgtcgcaaaaacctgttgtgcaacagttagttcctttaccagaatctaaagacgatcatttaaatgaaagacaacagacttgggattatctttatgagccagaaccaaaggcacttttagatagccttttagttcgttatttagagtcccaaatttatcaagcggttgtagataatttagcttcagaacaagcggctcgaatggtagcaatgaaagcagcaacggataatgcaggtaatttaattaatgatctgcggttggtgtacaacaaagctcgtcaagcaagtatcacaaatgaattgaatgaaatcgtagccggtgcggcggcgatttaagaaaagaggaacggtaatgtcagcaggaaaaattgtacaaatcatcggtgcggtgattgatgttgaatttccacaagatgcggtgccaaaagtttacgatgcattaaaagttgaatcaggtttaacacttgaggtgcaacaacaattaggtggcggagtagttcgttgtattgcattgggtacatctgatggtttaaaacgtggcttaaagtagaaaacacaaataacccaattcaagtaccagtaggcacaaaaacacttggtcgtattatgaatgtgttgggcgaaccaattgacgaacaaggagcaattggtgaagaagagcgttgggctatccaccgttcggcaccgagctatgaagaacaatcaaacagtacggaattattagaaactggtatcaaagtgatcgacttaatttgtccattcgcaaaaggtggtaaagttggtttattcggcggtgcaggtgtaggtaaaaccgtaaatatgatggagttgattcgtaatattgcgattgagcattcaggttactctgtatttgcgggtgtaggcgaacgtactcgtgaaggtaatgacttctatcatgaaatgaaagattctaacgtattagataaagtatctttggtttatggtcaaatgaacgagccaccaggtaaccgtttacgtgttgcattgactggtttaactatggctgaaaaattccgtgatgaaggtcgagatgtattattctttgtggataatatctatcgttatacccttgctggtacggaagtatctgcgttattaggtcgtatgccatccgcggtaggttaccaaccgacattggcagaagaaatgggtgtgttacaagaacgtatcacttcaaccaaaacaggttctatcacttctgtgcaagcggtgtacgtaccagcggatgacttaactgacccatctccagcaacaactttcgcacatttagactcaactgttgtattaagtcgtcaaatcgcatctttaggtatttaccctgcagttgatccattagattcaacttcacgtcagttagacccgcttgttgttggtcaagaacattatgatgttgctcgtggtgtacaaggtattttacaacgttataaagaattgaaagatattatcgcaattcttggtatggatgaattatctgaagaagataaactagtggtagcacgtgcacgtaaaattgaacgtttcttatcacaaccattctttgttgcagaagtcttcacaggttcaccaggtaaatacgtgacattaaaagacaccatccgtggcttcaaaggtatcttagatggcgaatatgaccatattcctgaacaagcgttctatatggttggttcaatcgatgaagtgttagaaaaagccaaaaatatgtaatcacttcaagtcatttgaaggagaacaaaatggcgacatttaatttaacaatagtaagcgcagagcagaaaatctttgaaggtgaagtaaaacaaattcaggtaactggtgtggaaggggagcttggtattttgcccggacatacgccattgctaacagcaattaagcctgggattgttaaatttactcttaaagatgggaatgaagaagttatctatgtttctggtggttttttagaagttcaagcaaatattgtgacagtattagcagatattgctattcgaggtagtgaattagatgcagatcgtattcacgaagcaaaacgtaaagcagaagaaaatatagtatctcgcggatctgatgcagatcacgacttacttgttgcaaaactttctaaagagttagcaaaacttcgagcttatgaactcactgaaaaactattgaaaacaagacgataattgaaagtataatatagatgaagtgaacttcatttagtttaagggctaagttctataattttagaacttagcctttttgttgtatgagattaatgataagttttgtctgaaatttttatctaaattaattaggataatatttactcttttttagataaaaagtgcggtaaatttttagtttgtttttaacctacaacaaagggtaaataacccgcacgaatcgcaaatggaatggatgtaatgatcacgcctaataccaatacgataattaaagtcagatttcctccccacactttgtatggcaaattagcgtgggcacgacgagctttccaaacaaggctaactggcaatactacggcgtagaatgcagggtaccgagtccgatattcggaaaca

SEQ ID NO: 526 - DNA, 6821 bp, H. influenzae
  misc_feature (5346)..(5346): n is a, c, g, or t
atctcacttacgtcatattttgactaaaaaaacactaaacgtaaacgtcatttacgtcataaatcaatggttgcgaaagcagaccaagttttagtagtagcttgcttaccatacgcataagccgttatttaagcaaaacgtacgattagttcattttagaaaaatattacataggagattaaataatggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcatatcgtgaccgtcgtcaacgtaaacgtcaattccgtcaattatggattgcacgtatcaacgctgcagcgcgtcaaaacggtttatcttacagcaaattcatcaacggcttgaaaaaagcatctgttgaaatcgaccgtaagattcttgctgatatcgctgtattcgacaaagtagcgtttgctgcattagttgaaaaagcaaaatctgcactttaattttttaaagtttagataaagaagaattaggacgctgaaaagcgtcctttttttgcatttgtgacttcaaattttgtaaaatgatgccattagttctcatctgttaaaatctatggccgaaacaatcccactgaatcccatcacgctacctttaaatcaaattagcttaatcgaagcatctgctggtacgggaaaaacctacactattggttctttatatctccgacttttattaaaggcgggagaaaataatttttcacgtccattaaatgtggaagaaattctggtggtaacctttacggaaatggcaacagaagaactcaagaaaaaaatcgtgagcgtataacagatgcgattaataaactcactgcctttgctaaaacccaagataaatccgcatttaaaaatgatgaatttcttaccgcactttgtgataatttagatatttttgaggcaattcatcgcttaaagttagctgaacaaaatatggatctggcggcgatttataccattcacggtttttgtcgccgtatgttgatgcaatatgctttccattctggcattcatttcaatttagaattaataaaagatcaatctgatttattagttcgttttgctaatgaattttggcgagagcatttttatccgttggattttgaatctgcgaattttatcgcgacagaattagtatcaccagcaaaggtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaattttagcgattattaccaatgaactggagaaagattatccaaaagatcagttgaaatcgttaaatcgtaaaaagtaccaagtaaagcgtttaggggattggattaataaaatcaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagagcttgaaaagcgcgttaatgccttaatgacaccagatttactaagcaaactcactctttatcattatcgacaaggcttacaacaaaaacttttagactataaactaaatcatcaagaaaaatcctttgatgatttattgcgtttgctttgtgaagccctgcaagatgcgcaaggggatgaattagcggaaatgattcgtttccaatatccttttgcgatgattgatgaatttcaggatacggattcacaacaatacgctattttttcaaaaatttatcgtgataatcccgaaaaaaatactggttttattatgattggtgatccgaagcaggcgatttatcgtttccgtggcgcagatatttttacttatctaaaagcctcagacgaagcccaatctcgctttgaactcactaaaaattatcgttcagagaagcatttggttgatggtgtaaatgctttattcgattttcctcaatcgccatttatttatcaaaatattaaatttactgctgttgattctcgtgatgatcatctgcgattttatttaaatggcaaagccgaaccagcttatcgtttttatctaactgaaagtgacaaagtgaataaaactgaaatggcaaaaatatgtgctatttctattcaacattggctaaaaagtgcggctgaaaatcaggcagtttttcaaaatgaagatactcgtaaaacattgcaagcggcaaatattgccgtattagtgcgtgataaaaatgaagcggctttagtaaaaaatgaattgcaaaaattagggatcgcgtcagtttatctttctgatcaaaatagcgtatttgatagcaatgttgcgaaagaattagcttgggtgcttaaagcctgtttgaatgtggcagaacgtccaattttgaacgcgattgcgaccgcactttttggcttaaatgcagcggatattcatcaaattcagcaaaatgaagcagattggcaacgttgggcagatagttttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaatcggcattgctcagttggtttgaaaaacaaattcaaggcgaaggtcgtcaagaggctcaaattcgtttagaaagtgaacgccagttggtaaaaatagtgacaatccataaatctaaaggcttagaatatgatttagtttggctaccatttttagctgtgccgagcaaagatccaagtaaaaaagacatcaatatttattattctaaagaacgagatgaaaccttatgggatatagaaaatcgcaatttaaacgctctttgtgaagaaacttttgctgaagaattacgtttactttatgtggctttaacacgtgccaaatatcaaatggcattcgcgttgcctgcacaatttgataaaaaatggaatgccttacattatgtattaagccaaggtgaaataggcaaggaaataaatttgtcgaattctaaagataccgagacgttgttgcaagcctttaaagaaaaaatgcgagataatgtggaaatctgtactaagccaaatctagaggcttttccggctttatctatcaatacaaaaaatgatgagcttaaagccgcagaatttacgggcaatattgagcaagattggcgaataaccagttttacttcaattgaacaaggtcatcgccgacaaaattatttcgctgaaagtgcggagaaaaaacacgctgtttttgatgacgcaaaagattacgatagtcaaaatgctattgaaatatccaccgcacttttaaacgaaaatgaatcaaatattttagatttaccacgaggtaaacaagtcgggactgcattgcatcgccattttgaaaattgctatttttctgatttagcaaatatagaagaaattgacaaattaagacaatccttacagttagatgaaacttttacagagccgctacaaaattggctacaacagatttcacatacgccactttctcatgaaataggaatagcattagctgatttggcaaataaagattgcattaaagaaatgccattttatctggctatttgggaacattttgatgttgaagagtttaatcgcacattgaaagcccatcatcatttaccaagcgagccacttcaatttgagcaaattcaaggaatggtgagaggttcaattgacttagttttccgccataatggaaaatattatcttattgattataaatctaatttcttaggttcaacccttgctgactacaatcaagaggcattgaaaaaagaaatgttacacagtcactatgattggcaatatttaatttatacgctggcattacatcgttatttacaaagcgttgtgcctcattacgattatgcacgagatttcggcggggtattttatcttttcttacgtggaatgaacggtgaaccacaatctggcgtattttacgatcgtccaagcgttgaattaatcacagaattagacggggtgttttaatgttatctgtattacacaaacttaaagagcagcgcattctttctcaaggtgattattattttgctaagttgatagctgataaacaatgtcatacggattatgcggaaccaatcaaaaatttagctatattattagccgcactttgtagttggcgttatacgcagggaaatacttgcagccaattagatcgctatttagaacataatttatttggcttggcttatcgcactacagaagaagactatttagctgaaattcgtgaaaagattggttatttagctgtggaagattggcaaaatgcgttgtgcgggcatatggcatttacgcaagatcccgtcaatcaaattgcaccaatggtatttcaatttggcgcgttgtatttctatcgtacttggcaagatgaatatcgtatcgcgcaatatataaaaaacactttaaaaaaacaccgcactttagccttttcttatgatgaaattcatcaaaaattagagaaatatttccctgaaaaacaggaaaaaacagattggcaaaaagtggcagtggcgacagcgattaaaagtccattttcgattattacgggtggcccaggaacaggaaaaaccacgacagttacgcgtttattgctcgttctacaagaattatttgattgtaaattacacatcaaattggttgcaccgactggcaaagccgcctcccgtttggaagagtcgattaaaaatgcgttaggttttatgcaagaaaaaatgaatgtatcccattcacttttcaatgcgattccacaaaaagccagcaccttgcatagtttactgggcgtgaacgcctttaatgattacacgcgctataacagccataaccctttgcattagatgtgttagttgtcgatgaaacatcaatgattgatttgccgatgatggtaaaacttatcaatgcgttaaagcccgaaacccgattaatttataggcgatcaggcacaattagcctctgtgaggcgggggctgtatgggggaattagctcaatttgttcctcaaccttaatagtatgaccaaagtcgcatacttnttagcaccaccaggctacaaagtagaaggttccgattgttcaaatcccaaatacgtgattgcttatgccatctaacagaaaggtccccgttttataaagattcaggcattggaaaattggctgaattcattcaaaaaggcaaagcagacgatagccttgagttatttgcccattatccgcaagaattgcactttaatgccctaaatgatgaaagcgatgcggtcaatcaagtggtgaaaagtgcggtggaaaattcccgcactttcttaaaaatgtggacgatttacgtaaacaaaaaattgatcctaacgctaaaaatgaacaaggcatttcctatgccgaagccattcaagcgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaatgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttccgaatttgaacacactgtcatggtgcttccaacagaagtaaatccagtactgtcgcgagaattagttttcacgggcgtcactcgtgcgaaaaaagaactcactgtatttgccgatgaaaaaatatggaaaacagcgattcgtcagaccgtcaaacgccagagcggattgggaaaattattggaagatttaaattagtaaaaggcggtaaatttggaagataaatcaatcagataatctccatttaaaataacttttggggaagattattttaataaattcttcaaactggttttcattgctgccatttgattttcaaattgtgccttgctttctctttcgtcaatcatataggtaattgtttccgaaagtgtcatcttcatttttcgagaatatttagaaagacgtagccaaacagcatattccaaatcaatggattttttcttggtatgttgtttttctccattaaaaaagcgtttacggcgggcacgaatggcttgatcaagcttaattggtaaggctggagaaagatgatttttaatccattcttcaatttgtgaaggataattttgggattctaataattcttgggctttagcttcttgcaaactacgttcttcgtagcgagtaatattttccccttcgcgatgtttacgaattaggtaaatccatttccaatttgattcttgattttcgagtttttggtatttcattttttatcattgagtgacgtggtaactgcattaatatacgtgtttatatgccgttttctagggttttcgcaggctataaaggaacaggctgaatagaaaca

SEQ ID NO: 527 - DNA, 8957 bp, H. influenzae
  misc_feature (6783)..(6783): n is a, c, g, or t
  misc_feature (8617)..(8617): n is a, c, g, or t
  misc_feature (8901)..(8901): n is a, c, g, or t
  misc_feature (8911)..(8911): n is a, c, g, or t
  misc_feature (8913)..(8913): n is a, c, g, or t
  misc_feature (8943)..(8944): n is a, c, g, or t
acgaaattcggctcggtacccatacgttttcacaaaaaatcctattattttgaacgctagaatttgaagttgtttattctacacgcaaaaacgaatttttctgtcaaaaatgttgatgtaaatcaaaaaaactctcaatagcatttcccttgcctttcaatattcagtaacatagctcccgtcaagtgattgcttgatattcataaagttcctaaataaaataatgataaatatagctaaactactttcctgccacccgtttcgggtggttttttttatctaagtcgaaagatgcactcttgcattgtgcatttattcttattatgatcagctcgagtataactaagagaataatagatgtttaatttaaagcgtgagcattttagagatgattatctttataggttttatcaatatggtgatactcatagtaagattccttctaatttgtataaagtattggcaagaaaattagatatgataagtgcctcagaaaatatcaacgatttacgttctccaccagctaaccatttggagttgcttgagccaaaagaaaataaaatttattctattcgagtgaataaacaatatcgtttaatttttaaatatgaaaataacgaagtaaataatttatatttagatccacattcttataatttgtaaggaggataatatgatgacgagaaaacccacctctgttggtgaaattctacaagaagagtttttagaacctttaagtcttaaaattagtgatttagctcaaattttagatgtacatcgtaatacggcaagcaatattgttaataatagttcacgaattacgctagaaatggcagttaaacttgctaaagtatttgatactacgcctgagttttggcttaatctgcaaacacgtattgatttatgggaccttgaacacaataaacgttttcaacaaagtcttgcaaatgttaagcccgctctacatcggcatgatacttctacatttgcaatgtaatttgagccctaaagtgtctatttaatttagggaatacttcactctaaatattgacaagtggttaggtttcgccaaacttttgcaaaatctgtccacttgtttcctatattttcgccctattttccagtagaatagggcgaatttttttgtgaggaattattaatgtcatctcaatttgtgtatacgatgcatcgtgtcggcaaagtagtgccgccgaagcgtcatattttgaaagatatttctttaagctttttccctggtgctaagatcggggttttaggtttaaatggtgcgggtaaattgactcttttacgcattatggcaggcgtagataaagagtttgaaggggaagctcgtccacaaccgggtattaaaattgggtatcttccgcaagagccaaaactcgagccacaacaaaccgtgcgtgaagcagtggaagaagcggtttctgaagtgaaaaatgcactgactcgtttagatgaagtgtatgcgctttatgcggatcctgatgcagattttgataaattagcggcagaacaagccaatcttgaagctatcattcaagcgcatgatgggcataatttagataaccaattagagcgtgcggcagatgcgttacgtttacctgattgggatgccaaaattgaacatttatctggtggtgagcgtcgccgagtggcactttgccgcttattactcgaaaaaccagatatgttgttgttagatgaaccaactaaccacttagatgcggaatctgtggcgtggttagagcgattcttacacgactacgagggtacagtggtagcaatcactcacgaccgttatttcttagataatgtggctggttggatcttagagcttgaccgtggcgagggcattccttgggaaggcaactattcttcttggttagagcaaaaagagaaacgtttagaacaagaacaagcaactgaaaacgcacgtcaaaaatccattgcgaaagagttagaatgggttcgtcaaaatccaaaaggtcgccaagcgaaaagcaaagcacgtatggctcgttttgatgaattgaactctggcgaatatcaaaaacgaaacgagacgaacgaactctttattccacctggcccacgcttaggcgataaagtgattgaagtgcaaaacttaaccaagtcttatggcgaccgcactttaattgatgatttatcattcagtattccaaaaggggcaattgttgggattatcggagcgaacggtgcaggtaaatcaaccttattccgtatgttgtcaggtcaagaacaaccagattcaggttctgtgacaatgggcgaaaccgttgtgcttgcttcggtagatcagttccgtgactcaatggatgacaagaaaactgtgtgggaagaagtgtctaatggacaagacattcttactatcggcaactttgaaattccaagccgtgcttatgtggggcgtttcaacttcaaaggtgtagatcaacaaaaacgtgtgggggaattatcgggcggtgaacgtggtcgtttacacttagcgaaacttctacaacgtggtggtaacgtgctattactggacgaaccaaccaatgacttagatgttgaaaccttgcgtgccttagaaaatgcgatcttagaattcccaggctgtgcaatggttatttcgcacgaccgttggttcttagaccgtatcgcaacgcatattttagactacggcgatgaaggtaaagtcacgttctatgaaggtaacttctcagactacgaagagtggaaaaagaaaaccttaggcgatgcagccactcagccacatcgtattaaatataaacgtattgcgaagtaatttagattgagaaagtgcggtggattttgaccgcacttttcttacttttttgggagtgattatgttagttgatttacatatttttttcgcctttttaagtttggcattgttagtaattcgtggtgcaatgcagcttaatggtaaaaattggcgttcgataaaattattaaaaattttaccgcacttatcagataccttgctgattgtgtctggcgtcgtcattttatacctctttgcttttggtattgaatggtggttagtggctaaattcgcattactgattttgtatattgtgtttgctgcaaaatttttcagtaaaaaagtttctcaacccaaaagcattttcttttggcttgcttgcgtaagttttattggtgcgatgttaattgcctatttaaaataaaacgatgtcatctcgccagcttcaaattttaatctgcaaaactttgccgcttgtgcctgataacgtattaattatcggcgaaagtggcattgctttttctaaagcaacgaatttgcttggacaagaatttgaacatatcttatttgatgcgcgaaatggcattcatcttgaagcgctggctattgcagctggaacactgaaaatgggcggcacactttgtttagtgttatctgattgggaaaatttatctcagcagcctgatcaagatagtttacgttggaatggaaatcagtcagcaatcgccacgcctaattttattgatcatttcaaacagtgcattgaacgttatcatttccccattttaagagaggaaagtgcggttgaatttcctacggttttttattctaacgaacatcacaaaaatgctacgttagcgcaacaacaaattatcgagactattttacaagccgagcaggatatttattttctaacctccaagcggggaagaggaaaatccgcattattgggtatgcttgctaaccaaattcaagcaccagtttatctcaccgcaccgaataaaagtgcggtgcattccgttattgaattttcagaacgagagatagaatttatcgcgcctgatgaactggctattcggttacaacatgaaccagaattcagtcaatcagcttggttgctggtagatgaagcggcggtaatcccattgccgttattgcaagaatattctcaatattttcaacatattgtcttcagcacaacaattcatagctatgaaggtacggggcgtggtttcgaattaaaatttaaacggaaaattcaccgcacttttcagcattttgagcttaaacagcccctacgttggcaagaaaatgacccgttagaacattttattgatgatcttttgttgctaaatgccgaagatgattttcagcactttgactataacaatattacttataacatagaggaaaacgctaaaaatctttccttcccctgcttgcgaggaaaggtgccccgaagggcggaagggggatttagatatagccagcctccctcaagctttggaagctcccctcacaagtaagggtagtaaaggaaaatataatcgtcaatttttatttcgagatttttatggcttaacgacattggcgcattatcgaacatcgccactcgatcttcgccgtttacttgatggagaaaatcaacgtttttattttgccgaatatcaacagaatttgctcggtgcaatttgggcattagaagaaggaaatatggctgatgatgagttgattattcaaattcaacaaggcaaacgccgcccgaaagggaatcttgttccacaggcgttatgtttctatgaaaacttgcctcaagcctgtaaattacgatctttacgtatttctcgtatagcggttcagccaaattggcagcaaaagggcattgggcaaaatttgatgcaagccatggaaaatgccgatgtggattttctttcagtgagttttggctacaccgacgaactggcaaaattttggcaaaagtgcggttttgttttggtgcatttaggcgagcatcaagaagcgagtagtggttgttattcagcgattgcccttaaaggactttccaaagaaggcttggctttagttgatactgcgtacaaacaatttcagcgtaatctccctttatcttttcatccgtttgccataaattttgagcaaaatcagcttgattggcagcttgatgattttgattggatgagcttaaaaaacttcgctaattttcaccgcactttattttcgagcgttcctgcgatgaggcgtttattaaaattagcgggcaaagaaaatttcccattaatttccgcttatttaacaaaaaaacaacttcctattaacaagaaaaaaggcgtagaatgtttgcgtttagaaattaaacaatatttagagcgaggaactttatgacagaacaaaccgcaaaaccaaaaggctggtttaaacgcgcacttgaaaaatatgacaacttcattaaagaatggggtttagatcaaccgaattgtagctgcgtgcctatgtcagcaacagaagatgaaaatggtaatttgaagacaaaagaatcttctttaaagaaataaatattaactgtttttttaaacagtgaacttattgaaagatagagcaaattccagtacactatgcctcaattttacacaagattgacgcattatttatatttatgaaaacggcttttttccaacctgatattccaacccaacccaatgatcacaaaattttaggcaatgtattaccaggcgctgatgcattggcgattagtgaaattgcagagcaaaaccaaaatttaaccgtagtggtgactccagatacacgaagtgcggtgcgtttatcacgtgttttatcggaattaagcagtcaaaatgtatgccttttccctgattgggaaaccttaccttacgatactttttctccccatcaagaaattatttcctctcgtttaagtgcgcttttccatttacaaaatgcgaaaaaaggcattttcttattgccgatttcgacattaatgcaacgcctttgcccgccacaatatttacaacacaatgtgcttctgattaaaaaaggcgatcgtttggtcatcgataaaatgtgcttacaattagaagcagcgggctatcgagctgtggagcaagtattagaactcggcgagtccgcagttcgtggttccttggtggatcttttcccaatgggaagtgcggtgccttttcgccttgatctttttgatgatgaaattgattctattcgcacttttgatgtggatacgcaacgcactcttgatgaaattaactcaatttatcttttgccagctcacgaatttccaacggtcgacaaagggattgaatttttccgtgcgcaatttcgtgaaacttttggggagattcgccgagatcccgaacatatttatcagcaaatcagtaaaggtaccttgatttctggcattgaatattggcagccacttttctttgttgaaatggcaactttatttgattatttgccggagcaaacgctgtttgtagatatggaaaataatcaaacgcaaggcgagcgtttttatcaagatgccaaacagcgttatgaacaacgtaaagtggatccgatgcgtccgcttttatcgcctgaaaaattatggcttaatgtagatgaagtcaatcgccgattgaaatcttatccacgtattacatttaaagcggaaaaagtgcggtcatcggtacgccagaaaaatttacctgttgccgctctaccagaagtgactattcaatcccagcaaaaagaaccattgggacaattacgtcaatttattgagcattttaaaggaaatgtactgttttctgtggagacggaaggtcgccgagagactttgcttgatttgctttcaccgttaaaactcaagccaaaacaaattcaatctttagaacagattgaaaatgaaaaatttagcttgttagtcagctctcttgacaaggttntataattgaacaatcgcttcctgttgcgattattggcgaagctaatttacttggcgagcgcattcaacaacgttctagagacaaacgtaaaacaattaatcctgatacgcttgtacgaaatcttgccgaactgaaaatagggcaaccagttgtgcatcttgatcacggtgtgggacgttatggcggtttggtcaccttagatacaggcggcattaaagccgaatatttgctactaaattatgcaaatgaatcgaaactttatgtgccagtgacttcattacatttgattagccgttatgttggtggctctgatgaaagtgcgccattacataaattagggaacgaggcttgggcgaaatcacgccaaaaagctgcggagaaaattcgtgatgtggcggcagagttattagatgtttacgcacaacgtgaagcgaagaaaggctttgcctttaaatatgatcgtgaagaatttcaacaattttccgcaacctttccttttgaagaaacctacgatcaggaaatggcaattaatgcggtaatttcggatatgtgtcagcctaaggcaatggatcgccttgtttgtggtgatgtgggttttggtaaaactgaagtggcaatgcgcgctgcctttttggctgtgatgaatcataagcaagtagcagtgctagtgccaaccacactgttagcccaacagcattatgagaattttaaagatcgttttgcgaatttgcctgtgaatgtcgaagtgttatcgcgtttcaaaactgcgaaagaacaaaaaccaattctggaaaaccttgcagaaggaaaagtcgatatattaatttggtacccataaattaattcaatcagatgtaaaatttaacgatcttggattgttgattattgatgaagaacatcgttttggtgtagggcaaaaagagaaaatcaaacagcttcgtgcgaatatcgatattcttacgctaacggcaacgccaattcctcgaacgcttaatatggcgatgaatggcattcgtgatctttccattatttccacacctcctgctcgccgattaagtattaaaaccttcgtccgtcagaatggcgatcttgttgtacgagaagcgattttgcgtgaaattctccgaggtgggcaggtttattatctccacaatgatgtcgcaagcattgaaaatacagcagaaaaactgaccacgcttgtgccagaggcgcgagtaattgtggggcacggacaaatgagagaacgtgagttagaacgtgtgatgagtgatttttatcatcagcgttataacgtcttagtttgttcaaccattatcgaaacgggtattgatgtaccaacggcaaataccattattattgaacgagcggatcattttggtttggctcagttgcatcaattacgtggacgagtcgggcgttcacatcatcaggcttatgcttatttgcttacgcccccacctaaaatgatgacaaaagatgctgaacgccgtctagatgcgttggaaaatcttgataatcttggggctggttttatcttggcaacccacgatttagagattcgtggtgctggcgaattacttggaaacgaacaaagtggacaaattgaaagcatcggtttttcgctttatatggaattattggatgcagcggttaaagcgttaaaagaagggcgtgaaccatcattagaagaattgacgcaacaacaagcggatattgaattgcgtgtgcctgctttactgcctgatgattatctaggagacgtgaatatgcgtttatccttttataaacgcattgctgcagcagagagtaaagcagaattagatgaattaaaagntgagttgattgacagatttggattattgcctgatgcaacgaaaaatttattacaaattacagagttgcgtttattggttgagccgttgaacgttgtgcgaattgatgctggaaccaaggcggttttattgaggttttcagcaaagcccaagggaatccagaaaatttattccattaattcaaaaagaacctattggtgtatcgatttgagggcccattaaaatttaagtttattgaagatcttatccgaaacaaagggccggtagaaattgggggggatttgtnaaaaacaacngntgcataaaaaaaacccccgacattgggacnngatttttttctaa

SEQ ID NO: 528 - DNA, 7150 bp, H. influenzae
  misc_feature (583)..(583): n is a, c, g, or t
  misc_feature (712)..(712): n is a, c, g, or t
  misc_feature (6487)..(6487): n is a, c, g, or t
  misc_feature (6549)..(6549): n is a, c, g, or t
  misc_feature (6612)..(6612): n is a, c, g, or t
  misc_feature (6634)..(6634): n is a, c, g, or t
  misc_feature (6721)..(6721): n is a, c, g, or t
  misc_feature (6739)..(6739): n is a, c, g, or t
  misc_feature (6851)..(6851): n is a, c, g, or t
  misc_feature (6856)..(6856): n is a, c, g, or t
  misc_feature (6860)..(6860): n is a, c, g, or t
  misc_feature (6876)..(6876): n is a, c, g, or t
  misc_feature (7020)..(7020): n is a, c, g, or t
  misc_feature (7048)..(7048): n is a, c, g, or t
  misc_feature (7050)..(7050): n is a, c, g, or t
  misc_feature (7100)..(7100): n is a, c, g, or t
  misc_feature (7102)..(7102): n is a, c, g, or t
  misc_feature (7124)..(7124): n is a, c, g, or t
  misc_feature (7144)..(7144): n is a, c, g, or t
  misc_feature (7147)..(7147): n is a, c, g, or t
gaaaatgccaaccgcaagcagaaagaattgctaatgttgcgataagcagtaaagtcttgattgagttgatcataaaaattacctttattgtaggacgtgtaaaatgtaaatatttcacatacctataaaaaatggtgcgtgaattttaaatccacacaccctatgtattatggtttcactaccacgtttaataatttacctacgacataaatcactttgacaatgtgttgattatcaataaattctttcacattttcatatcgcaaaagcaatcgttttgactgtgtcttcatctgcatctgccgcaacagtaactttgccacgaaccttgccatttacttgcacaacaatcagtttttcatcttctaccattgcggcttcatcgacttttacccattctgcagtatcaatagcactttcattgccaagagcttgccataattcaaaacagatatgtggcgtaattggataaagcatacgaacaactgcacttaatgccttcgcccataactgcacgatcttgctcgattatcaagcgatgccttagtcagtttattcatcaattccatcactgcagcatcgncagtattaaatgtttgacggcgacccaatatcatcgctcactttcgcaatggtcttatgaacttcacgacgaagcactttttgttctgcggaaagtgcggtgatatctaggctagtttgtgctggattntgttgatattgatataccaattccaaacacgccctaagaaacgtttcgccccttctacgccagattcttgccattccaaggtcatttctgctggagaggcaaacatcataaagaggcgaacagtatcggcaccatatttttctaccatttcttgtgggtcaataccgttatttttggatttcgacattttggtcatgccactgtggactaattcacgcccttcaggatcggtggctttaataattctgcctttttcatcacgttcaagagtcaccagtgttggacttacccaaatacgctcattggttggacttgtgtagtagaaggcatctgcaagcaccataccttgacataataatttatcggctggttcgtcactggttacaaatcctgcatcacgcaataatttgtggaagaagcggaagtagagtaagtgcattgttgcgtgttcaataccaccgatatattgatccactggtaaccaatagtttgcttcttccgcatcaagcatgccattttgatattgtggacaagtgtagcgcgcgtaataccaagaggattccataaaggtatcaaaggtatccgtttcttttaacgctggtgcgccgttaagggttgtttttgcccagttaggatctgctttaattgggttttttacgccatccattaccacatcttcaggcagaataataggtaaatcttccattggtgcaggtactacatcgccattttcaagggttagcatcggaattggcgcaccccaataacgttggcgagaaacgccccagtcacgtaaacggtaattaacttgacgttttccaacacctaatttttctaatttatccgcgataccgttgaatgcaccatcaaagtctttaccatcaaattcagctgagttcactaatttaccgtgctcaacgaaagcttgtttagttaaatcaatttcttcatctgcaatgggttcaataacttgcttgatttgtaaactgtatttttgagcaaattcaaagtcacgttggtcgtgagcaggaactgccattactgcgccagtaccgtagtgcattaacacgaaattagcgacccaaatcggtaatttttcgcccgtcaatggatgaatagcaaataagcccgttgccattccttttttctccattgtcgcaagatcagcttctgccactttggcgtttttcgcttcttggataaaggcggctaattcggaattgttttgagctgctaaacttgctaatggatgtgccgctgcaatgcctaaataactcacgccgtaaaaggtatctggacgcgtggtgtaaactgctactttttcgttggtatttgcaacatcaaaggtaatttctaccccttcagagcgaccaatccagttacgttgcatggtttttaccatgtcaggccattgtggaagggcatctaaaccacctaataattgctcggcatagtcagtaattttgataaaccattgtgggatttctttttgttccactggtgtatcacaacgccagcaacaaccttcgtgtacttgctcgtttgcgagtactgtttcatcattcggacaccagtttacggttgaggtttttttgtacactaagccttttttgtaaagctcagtgaagaaccattgttcccatttgtagtattctggtttacaggttgcgatttcacgatcccagtcaaaaccaaagcctaaaagttgaagttgtttcttcatgtaggcgatattttcgtaagtccattttgctggtgcggttttatttttaattgctgccccttccgcaggtaagccgaaagcatcccaaccaaatggttgcaatacgtttttgcctagcatgcgttgataacgagaaatgacatcaccaatagtgtagttacgcacgtgccccatatgcaggcgaccagaaggatatgggaacatagaaagacagtaatatttttctttagattcgtctttgattgctttgaaaactttattttctgcccaatattgttgaacctttggttcgatcatatcggggcgatattgttcttgcataaaatcaccttaaattttaaccgcacttttgcagcattttgacaatagaaaatgtggcatagaataccgtaaaatggcaaaaattaatagggagagaaataaaaagtgcggtggttttttagttgttttttacaataaattttcaatttttacagaacagattagaacaaaggaatccatggcaagccaatataacttatgatatagtttaccaccaaatttatagaggtctctcaataataaaaataatgatagagttggatcaaacaaatataccaaaacacgttgccattattatggatggtaatggccgttgggcaaaacagaaaaataaaatgcgaattttcggacacgccaatggcgttactgcggtacgcaaagcagtggcttatgcacgacaaatcggtgtggaagtactcacactttatgcctttagtagcgaaaattggagtcgcccagaacaagaaatcagcgcgttaatgtcgctttttatgcaagccttggatcgcgaagtgaaaaaattacataaaaataatatttgtctgaaaattataggcgatgtatctcgttttagtgaaactttacaagaaaaaatcaaaaaagcggaaaatttaacagaaaaaaataccgcacttacactcaatattgcggcaaattacggcggttgttgggatattattcaagccgctaaacaaattgcagaaaaagttaaaaaagaagaaatgtcagtttcagatattaataactcgacttttcaacatcatcttgcaacccaaaatgcaccacctgtggatttattaattcgcaccagtggagaacagcgcataagcaactttttattatggcaaattgcctatgcggaattatatttttccgatgtgctttggcctgattttaatcaattagaatttaatcacgcgattgcaagttatcaacaacgtcatcgccgttttggcgggactgaatagttaaacggattaaaattatgcttaaacaacgagttttatctgctattgtgttaattgctgcagttttatgtgcgctatttttattcacgcctttttattttgccctcgctttaggggcggtagcgattttaggcatttgggaatggactcaatttgctcgccttaaacaacctttgatacgtttttttgtggctacctttttaggcgtatttatcttcttatggctctatactgagggcaactatttagatgcagggcgtgtgtttgaacaacatcttcagcttttattgataaatgctgttagctggtggggtttagctttgttgcttgtgatcagttatcctaaatcagctaaattttggtctaaaaatccacttttacaacttttatttgccttttctacgttgattccatttgtcgcaggtgtattacgtttacgtttagaacactatacccatgatccttatcacggcttatttttattactttacgtatttatacttgtttgggcggctgattctggtgcttattttagcggacgcgcctttggcaaacgtaaacttgcccctaaagtatcgccaggtaaaagttgggaaggggtcattggtggattaattacagcattagtgctttcttttatctttattcatttctctaacaatactttagtaggcgatcgaaatattactggatttatcattctttctgtagcgacagttgcaatttcagtattgggcgatttaactgaaagtatgtttaaacgtgagtcaggagttaaagacagtagccaattgattcctggtcacggcggtgtgttagatcgcattgatagcttgactgccgcagtaccttttttcagctatttctatttctttgtcttataaggatttttaatgtcatttttgtggtcactaggttcttttatcattgcgattgctgtattagtatccgttcacgaatatggtcactttgggcagcgagaaagtgcggtataaaagtccatcgttttcccattggttttggaaaagtaatttggaaacgcattgacaaatatggtacagaatttgcggtttcaatgattcctttaggcggctatgtaaaaatgcttgatggacgtaatgaagtagttcctgctgagcaaaaatcacaagcatttgacagtaaaagcgtattacaacgcgcatttgtaattattgcaggccctttagctaattttatttttgcaatttttgcttattggatcatctacctttatggaatgccaacggttaaaccagtgattcaatcaataacaccaagttccatcgcagcacaagctcacattgaacctaatacacaaattctagcggttgatggcgaagaaactcaagattgggaaaccatcaatatgctacttgccacaaaaatgggtgagcctaatgttgaaattaccctttctcctttcaattctaatattgaacaacaacggactttaaatcttacaaattggatattcgatcctgaaaaagaaagtgcttttgaggcattagggattatgcctatgcgccctaaaattgaaatggtgctttctaaagttgttcaaaattctcccgctgagaaagctggtttacaaatcggtgataaaattttaaaagaaaatttaaccgcacttccttggcaagattttataaaacaggtcgaacaaggcgaatctttttctattaaagttgaacgtaatggagaaacatttgacaaagtcctaactccagtgcgtaatcaaaatggcaaatggtttgttggggttagcccaaccttgacaaaattagcggatgaataccgtactgaattaaaatatggtattcttgaatctttacaaaaaggcattgaaaaaacagggcagctttcccttttaaccttgaaaatattagggaaattacttactggcgatttgtcattaaataatttaagtgggccaatttctattgcaaaaggtgctggtgcatcagcaaatattggattggtgtattttttaagttttatggcattgattagtgtaaatttagggattatgaatttatttccattaccagtattagatggcggtcatttagtttttttaacaatggaagctgttaaaggaaaacctgtttctgagcgggtgcaaagcatctgttatcgaattggcgcagcactgttattaagcttaacggtgtttgcattatttaatgattttttacgtctataatttatataggatacaatcgatgaaaaaacttctaatcgcaagtttattattcggtacgacaacgactgtgtttgccgcaccttttgtggcaaaagatattcgtgtggatggtgttcaaggtgacttaaaacaacaaatccgagcaagtttacctgttcgtgccggtcagcgtgtgactgacaatgatgtggctaatattgtccgctctttattcgtaagtggtcgattcgatgatgtgaaagcgcatcaagaaggcgatgtgcttgttgttagcgttgtggctaaatcgatcatttcagatgttaaaatcaaaggtaactctattattcccactgaagcactaaaacaaaacttagatgctaacgggtttaaagttggcgatgttttaattcgagaaaaattaaatgaatttgccaaaagtgtaaaagaacactatgcaagtgtaggtcgctataacgcaaccgttgaacctattgtcaatacgctaccaaataatcgcgctgaaattttaattcaaatcaatgaagatgataaagcanaattggcatcattaactttcaaggggaacgaatctgttagtagcagtacattacaagaacanatggaattacaacctgattcttggtggaaattatggggaaataaatttgaaggtgcgcaattngagaaagatttggagtcaattngggatttattatttaataatgggctatgccaaagcaccaattactataaccgtgtggttagcttaatgctgaaaaaaacaaaaggtnatgggaaccattggtggnaaccggacggttccggcgtgcccttctagcggccgcataataggtgatctgcgcggctttgcttccgcttctccacctctttcgtgcgcccccgccttattttctgctccgncgccncctncgttttcccgttcgtntcgtcgtttcctgctctgctctccgctggctgtcttcagtcatcctccgccttcttttctcctattcccccttccctcccttctctgttccacctctttttgttgttgcttgcgttcctctccctcgtgctcgccctcccgccncgtctgctctttcattctgctttgtttngncttgcctcttctctctcattgttccttcttcttcccctttcctcgtgacncncgtgtgttccctttcgtcgttncgcgttcttgtcgaacttcncancct

SEQ ID NO: 529 - DNA, 9967 bp, H. influenzae
  misc_feature (4130)..(4130): n is a, c, g, or t
  misc_feature (8251)..(8251): n is a, c, g, or t
tgacattctttctgtagaaaacttatgaatccaacttacaaagcgaaattaaataaataatttacgccaaatatcaagaaaatttaccgcactttaatctgtgccttaaagctgaataaataaaccagctaattgggtgcagatttttttatgattaaaatgttttaaataaccaatatttgttgccattgttaaatgttaatggcttatctaactaaaatagttgaaatttgaatgcatattaatgcggtgctttaagtaaaagtaaaagtaaaaggactaaattctgcggattatagaatttagtccttaaacaaatgtatctgatttttttaagattagatcgatttttctcttttatgtttctctctattcatctaaaaaacttctcagtgtttcagaacggctaggatgacgtaatttacgtaatgcttttgcttcaatttgacgaatacgttcgcgtgttacatcgaattgtttacccacttcttcaagcgtatggtcggtattcatatcaatgccaaaacgcatacgtaatacttttgcttcacgtggcgtcaagccttctagcacttcgtgagttgcaacttttaaactttgtgctgtggcagaatcaagaggaagttctaaggttgaatcttcaataaaatcgcctaaatgtgaatcatcgtcatcgccaataggtgtttccatcgaaatcggctcttttgcaattttcagtactttacggattttatcttctggcattcccatacgttctgccaattcttctggtgttgcttcacgtcccatttcttgtagtaactggcgagaaatacgattaagtttattgattgtttcaatcatatgcacaggaatacggattgtacgcgcttgatccgcaatagagcgagtgattgcttgacgaatccaccaagtagcatatgtagagaatttgtagccacgtcgatattcaaatttatctaccgctttcattaaaccgatattcccttcttgaattaaatctaagaattgtaaacctcgatttgtgtattttttcgcgatggaaattactaaacgcaagttagcttcaaccatttcttttttagctcgacgtgctttttgttcgcctcgtgcgactgcatcgcaaatgtcacgcatttgagtaatggtaagtttagtattttcttctgttatcgctagattgtttaaggcttcataaatacgatcttcatatttaattaaacgtttagcccaaggtttgctagattttaatgcttttgctacccattcactgttactgccattagcggtaatattttttcaaaatcatcctttggcattcctgctatatccactaatttttttgtagctgacgttcttggtagcgcacacgtttcatcatttctttcattgatagaacgagtaaatcaaattgttttggtactaaacggaattgtttaaaaatttcgccaagtagtgcaatttgatcttgggcacgttttccagagcgaccgtgtttttcaataacagcaagggttttagagtgctgttctcttaattgctgaaatttttcgcgagcaacttcaggatcaatactgttatcagagtcgcttgaatctgatgtagattctgattcattgtcttccacatctgcattactagattcttcttcatcatcttcgtcagaaaagtcttcatcaagtccgttgtgttcttctatttcggcatttggatcaacaaaacccgtaattaaatcggtcaaacggaaattacctttttctacatcatcatagttttttagtaatccatttaatgcttcaggataggctgcgatagaggtttgaacttcatcaatccctccttcaatacgttttgcaatgctaatttcatcttcacgagtaagaagatccaccgttcccatttcgcgcatatacatgcgtacgggatccgttgttcgaccgatttcagattctacatttgaaagaatttgagttgcttcttccactgcatcttcatcagggatggtatcactcaacatcatatcatcgctttctggtgcttcatctaatacagggatacctgcatcattttgcaacgtttgtagcaatttgtcgtaatattcaggatcaatagcatcttcgggcaataagtcattgatttcagcaaaagttaaatacccttgtgtacgacctagctccatcaattgctcaatttgttctgaatattgttcagccgtagattgttgatttttttccatttttatactcgttttgcttgatgtgattgagaagataagatttttttatgaacttgagattctaccattgttatagcggattcactaactgttttttctgctgttctttaccagctaaaagatgtacaagtaccgttttttcttcattagtgagaccctctgttcgttctttagcaataagcatttcaatatcgcgctcaatagcttgaatatttaagcgacggtaattttgagaaaatgcgttgattatgtcggattcgtctaataaatgatcccaagttgccagtatttcaaggggattactgtaagatgtattgcggaagtattccaaaatttgccccgtagtaatgccctctcgttggcgacaaagtgcggtcaatttttccagaatttcaaaccctgcttctgcacgtaatgcttgcacgccgctttcagacatacgttttactaactcaggattttgcagaagcaatgaaatgaccattcgcattggtgtcttcttgatcttattatgagtgactttttgttgtgtattggcttgttctaattgtttgggaataagattttccagctgagtttgatcaaaaatcccaagtttttgagcaagcatattgcgtagcgataagcgaagcatttctcctggaatttggtgaattaacggcgcagctagcgcaactaattttccgcgcccttctttagtggaaaaatcaacctgaggacttaaatgtgcaaacataaactcgcttaaagattgcgcactttcgatgtattcttcaaatttttctttgccgtattgacgaatgtaagtatcaggatcttctccatctggcaagaaaataaatttgagttgtctgccatcttctaagtaaggcaacgcattttctagtgctcgccaagcagcatcacgtcctgcacggtcaccatcgtaacaacaaacaacctgttcggtcgaacgaaaaataagttgaatttgttctgatgtcgtggacgtacctaaagaagcgaccgcataatccacgccaaattgtgctaatgccaccacgtccatataaccttcaaccaacaagtaattgtttgggttcatcgttggtttgtaaggcttcatacaaaccataaagctccttacctttatgataagtaatggtttctggcgaattcagatatttcggtttttcatctgttaatacacgcccaccaaaagccactgtgcgaccacgtttatcacgaatcggaaacatgatgcgatttcggaatttatcgtaaatattgccacgatcatttcgagaaagcatgcctaattcaatgagtttttgttgttcttcacgattaacaccaaatttacgcagtacagtatccattgcattcggcacaaacccaatttggaaacgctcaataatttcaggtgaaagcccacgttgttgtaaatattcttgtgcttgagtatttaatggtaattggttttgataaaacgtggcaatctcttgcattaattcatagagatttcgtttggtttggtaattagcttgaggttttccgctgtgattagcgcgtttttcgtaaggtatttcaagccctgccattgctgcaagttcttcaatcgcctctataaattcaagtttgtcataatccattaaaaaggaaatcgcattaccatgtgcaccacaaccaaagcaatgataaaactgtttcttttggctaactgtgaaggatgggagttttttcgtgatggaaagggcagcaggcttgataatcgcggccagctttttttagttttacgcgcgtgttaatcacatcgacaatatcggactttgtcagcaaatcatcaataaaggggcgtggaatagaacctttcattgtcgagcctccgtgatcgaggtgtgaaagtgccggncgttttggcggagatttttattgtgctttagtacataaccgtgagtccaaggattcacggtttgtcttaactcgagtcagaaaaactataaattagtataaacgggtattgcgcgcgttttcgcgagcgttgcgttttgcgtgacgttttgcaagtgttgcattttcacgtttacgaattgtagttggtttttcgtaaaattcgcgagcgcgtacttcagctaagattcccgctttttcgcaagagcgtttgaaacgacgtaaagctacgtcaaatgattcgttttcacgtactttaattacaggcataagccaatcacctcaatgagtttaatttaattgcaatttaaaattttatttttgccaaagcacctgtgtgtaaatgacaaatttaataaaggacgcaattctaatctatttttagggaaaaagtaaaggatagaatgccaattaaccttaatatttgtggtttcaactggttaaaaccgcttaaacagggtaaaatcgcgcaacattttaggtaataaattaagaaaatcaatgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgtgatcatattcggaaaacagcgcctcttattaaagcggcattagaggaagccaatttaaccgcaagcgatattgatggtattgcttatactagtggccctgggcttgtcggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccaggcggcgcggcactttctcgtttagcggaaaaaggcacgccaaatcgctttatatttccacgtccaatgacagatcgtgcaggccttgattttagtttttctggtttaaaaacatttgccgcaaatacagttaatcaagcaattaaaaacgagggcgaactgacagaacaaactaaatcggatattgcttatgctttccaagatgcggtggtggatactcttgccattaaatgtaagcgcgcattaaaagaaactggctataaacgtttagtgattgcgggaggagtgagtgcaaataaaaaactccgagaaacgcttgcgcacttaatgcaaaatttaggtggcgaagtgttttatcctcaacctcaattttgtacagataatggcgcaatgattgcttacacaggttttttacgtttaaaacaaggtcagcatagcgatctggctattgatgttaaacctcgttgggcaatgacggaattaccggcaatttaggagaaaaaatggcgaaactctacttctattactccacaatgaacgctggaaaatcaacgacgttgctacaatcttcctataactatcgtgagcgtgatatgagcacattagtttatacggctgcgattgatgatcgttttggcgtgggaaaagtcacatcgcgtattggcatttcgcaagatgcctttttatttcgctcggaaaccaatttgtttgatgaaatcaatgagcacttaaaaaaagaaaaagtgcattgcgtgttggtggatgaagctcaatttcttagcaaacaacaagtttaccagttgagtgatgttgttgataaactcaaaatccctgtgctttgttatggcttgcgtacagatttccaagcggaactttttgaaggaagtaaatatttactggcttgggcggatcaactcgaagaattaaaaacaatttgttattgtggccgcaaggctaattttgttttgcgtttaaatgatcagggcgaggtcattaaagaaggtgcacaaattcaaattgggggcaatgattcttatctttctgtttgccgtttacactataaagaaaagtgcggtcaaatttaaattagtttttaaacacaacattataaggacaattttatgctaaaaaacaaaacttttgggagtgcgctgattattgcaggcacaaccattggagcaggtatgcttgctatgccgcttacatcagcgggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgccacgttgagtttgttagttttactttatgcactttcagccgcttatattactggtggtggatctttactttcaggcttgccaacggcttttggaatggacgcaatctcacttaaaacggcgattattatctttactgttgtattaggttctttcgtggttgtaggaacgaaaggcgtggatggtttaactcgcgtgttatttattggtaagttagtcgcttttgcttttgtactgtttatgatgcttcccaaagtggcaacagataatttaatggcattgcctttggattatgcttttgtggtttctgcggcaccaatattttttacttctttcggtttccacgttataatggcgagtgtgaatagctacttaggtggaagtgttgataaatttcgtcgtgccattttgattggtactgcgattccattagctgcttaccttgtatggcagttagcaactcatggtgtattaagtcaaagtgaatttgtgcatattttacaagctgacccaacgctaaatggcttagtgaatgcaacacgtgaaattacaggttctcattttatgggagaggttgtacgtgtgttctcatcacttgctttaattacttcattcttaggcgtaatgcttggtgtatttgaaggcttaggtgatttattcaaacgctatcatttgccaaataatcgctttgtattaactgtagccgcatttttaccgccacttgtatttgcattgttttatcctgaaggatttattacagcattaagttacgcaggtttgttgtgtgcgttctattgcttaattttaccaattagcttggcatggcgtacacgtattgaaaatccaacattgccatatcgtgtttctggcggtaatttcgctttggtgtttgcgttattaattggcgtcgtgattatgctcattccatttttaattcaatggggatatttaccagtggtggcggggtaatatttgatttttccctagagaaaacacttttcttcctctgtttgcaggggagctgccgaaggttgaggggagatatagaaagcccccttccgtccttcgggcatcttcccccacaagtaagggaagttattttctacaatttatccgaatgatgaatcattacaaagcgttcccaaagctgttcttcggtttcttgatgttcaggatcgggcttaatacagttagtgattgggcaaactttttggcaggttggggtgtcgtaatggccgacacattccgtgcaaagtataggatcgatcacataaatctcatcgccaatggaaatggcttcgtttgggcattcaggcaagcacatatcgcagttggtacatttgctagtgatgaataatgccattgtgatccttaatagaaagttgaaagcggcgaattatagccgacaaaaacttgattgacaaaaactaaacaaaattaatgaaaaaactttccttccattctttctcttatggttctcgttatattagcaatttggcaatatttttacccgatacaaccaaaactaaacatcaatcatcctcgcccgtaattgagcagacgaagcaaacaaaagtatctgagccctaaaatttgaacctaaattcgagcctcaatttgagacaaagcggacggatattgaaaaagtgcggtaaaaaatccagatgtttttgcnactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaatacccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaataagaatttctttgatctaaatcgttacaacctagcacgaagtaggtataatacgaaaagttttcaattttaattttaacttaacaagaggatagattatgtcagtaatcaaaatgaccgatttagatttagcgggtaaacgtgtatttatccgtgcagatcttaatgtgccagtaaaagatggcaaagtgacctcagatgcgcgtattcgtgcgaccattcctactttaaaattagccttagaaaaaggtgcaaaagtgatggttacctctcacttaggtcgtccaactgaaggagaattcacaccagaagattctttacaaccagttgttgattacttaaaaaacgcaggctttaatgtgcgtttagaacaagattatttaaatggtgtggatgttaaagatggcgaaatcgttgttttagaaaacgtacgcataaacaaaggcgaaaagaaaaatgatccagaattaggtaaaaaatatgccgcactttgcgatgtatttgtaatggatgcctttggtacagcgcaccgcgcgcaagcatcaacttacggcgttgcagaatttgcaccgatcgcttgtgcaggcccattattagccgctgaattagatgcattaggtaaagcattaaaagaacctgctcgtccaatggtcgcgatcgtaggcggttctaaagtttcaactaaattagaagtattaaattctctttcaaaaatcgctgaccaaattattgtgggcggtggcattgcaaatactttcatcgcggcagctggtcacaatgtaggtaaatctttatatgaagctgatttaatgccagttgcgaaagaattagccgcaaatacagatattccagttccagttgatgtgcgtgtaggttttagagttctctgaaacggcagcagcaacagaaaagcggtaaatgaagtgaaagatgatgaatctatttttgatattggcgataaatcagcagaacaattggctgaaatatcaaaatgcaaacccgttttgtggatggccaatggtggggtttgggattccctcattcccgaaggaactgaatcatttctacgccttgcaacagggagcatctttttgctggcggggggtaccttacggtttgattattgggattgcggaaaattctacttcacgggggg

SEQ ID NO: 530 - DNA, 8401 bp, H. influenzae
  misc_feature (8179)..(8179): n is a, c, g, or t
  misc_feature (8304)..(8304): n is a, c, g, or t
  misc_feature (8330)..(8330): n is a, c, g, or t
atgctaattagggggctaaaagtatttctgcattgaatgactatactcaacgtattgtgccattaaatgatgcgatgaaaggaatgaataactattacaaagaccgtaaaaaagcctttgtgctaggttatttcggtgatcaccaagtggcatttgataatgctatccctccgaagaaaggggattatgccacagcccgattatgtgacgcaatttgttgtaagaagtaattatgcaagtcaatttaagcaagaacaaaagtttttagatcttgcttttgctggaggcgtcttgatgaatgtagctggattatcagcagaagatgaatttatgaaagcgaatatggcaatgtgtaaactaagtcacggaaaattagaagattcttctgatattcagctactcaatgattatcgccattatttatatcaaacattggcgattgccagataattttcttagatcgagcattattgctcgatctgctcgccaatttcatctaaggttgaagctaattgtgcaccaactaataccacaagccaacttatttgaatccacaataacataattggtaaagttgccattgcaccgtaaattaattgataagagggaaaagtgacgacataccaagtaaatgcttgtttaccaagagtgaaaaaaatcgcggcaagaaatgcaccgtaagctgaatgcttaattttcacttttttattcggtacaaccgtataaataagcgtaaaaataaaccaagtaaataaaaaaggcacaaaactgagcaattttaagcctaatgataaatgttccgattgctcaaacattattttaatatacgaactaatcccaatactcacgccaataataagtgggccaagtgtcaaaatcatccaataaatcgcaaaagaagaaagcggagagcgagattgactattgtgccaaatactatttagtgttcggtcgatgttattaattagcatcaaggcaacggcaattaaactcacaattcccaccgcactcattttctttgagtttgatacaaattgatcgatatattcgcccaccatatcactcgctgatggtgcaaaattagtaaaaatcatttcttttaattctcccgtcacttcattgaatacaggaaaagcagagaaaatagaaaaaataaccataactaaggaactattgctaacattgtgctataagtcaatgcaccagcgacttgattaagtttattttctgaaaaacgttccaaaataataatccaaaattttttaatgaaatcatagaaatcccccacaacaatgtttaaattttttaccataaccacatacacaaggttgtttcattgtcggtaatgatacggtcggatcaacaaaataccaacggttttcaatttttacaaaaattgaccgttcttgatgggctagttctccctcttcgccttgaaaaatcgccttaaattctaccgcactttgagtttttgtaaggctttccgtttttagaatttctaatcctagccacgtagtgttgtccgcccattcttgcaataacctaggctttaataaagtttgttggcttggcgcagttgttacaacaatatagggaatattttttaacacataagccgtataacgtgaacgcataagttgctctgccgtttcgggaaatgcttgtctcaaatgaaatttgccacaacaatctgcgtaatgatgactagattgacatggacaattttctaaagaaagtgcggttgaaatttctgacatatttatccctgttgtttgaatttcgatatttgcgatcgaattgagcgtttaaaggcttcagctaatacttcaatctctaatgctgcatctaattcagcttcattttcgggcgcagataacaagcgatttaaatgacgaattgttatttgcggataaggacgggcgagtaattttagttcatccttttgcttaattgttcctgtttcaataatacgaacataccatccactaagcccagtttgataaacaatatcgcgagtatcttcgttttccgtgttttttgataaacgctcacaaggtttacgtggttgagatacttctaaaatggttgagccgatttgataacgatcgccaatacatacattgtcttcattcaagcctgacacgacaaaattttctccgtatatcgcagtatccatataagaaaaatctttatttaataaagtatttaattcattaaaagaatctgccgacataaaaaagagagctttatctacacccccgtgatgtttttttaaaccaacatcgtttccttccgcaccaagagaatgaatttttaccgatggcacaacttttttacgaatcgcgctttcatactggcttccatcggaaaggttagggtttcaacttgtcccacttttataactaaaatttttgcattcattttatttttcgcttgttctagaaaaaatttacgtggaattataaccgaaaacgtttaactttttgaccgcacttctttttttacttattattcgttatcagaaaaacaaaaaagaaataataaaaatgtttgaaagagaaaaaaattttctaaaaatattttatttcttttcttgaaaataagatttttcctaagggcgaaatcatcacgttcaatgataataaggagatttattatgtcagacgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccatcaacatcaatttgtgtggaagaacttgctcaacttggtgttcgcactttcttacgtattggcacaacgggggcaattcaaccgcacattaatgtaggcgatgttcttatcacaactgctgctgttcgcttagatggtgcaagctgtcattttgtaccattagaatatccagctgtggcaaactttgaatgtacaaccgcactttataatgcagcgaaagcaaaaggtattgagccttatgtaggtgtaaccgtatcatctgatacattctatccaggtcaagaacgttacgatacttatagtggtaaagtatatcgtgattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagcggtgtctgttgtgatcgcagctgcacaagcgttgttaagttaaattaatatttatttgaaacaataaaactttattttattctgcaccttaattagatttattttctaacgaagtaaggtgcagatttttttattaataaactgcgatcttctgatcaatttaatcaaagtagtctatttacttgttggcattgaaacctaaacttgatataagttctaaataaactacttctaaaggctaaataacctaaaatatttacgactaaaattagatttctgttaaatctacatttttagtctcttttgaggctaataatgccaagaaagtcattaatgcattgattgctaaataaattcctacgcccattacaccgaatgacgcgttaatttttaaagaaatcattgctgcaattgttgcaccaataattgatgctaaattatacgcaagagaggcacctgaataacggacttctgttgggaataattctggtaatagcgcagccattggaccaaatgtcattcccataatcgccataccaatcactaaaaatgcaaatacgctaactggagtgccattttctaagaataacggcattgctaaaccaagcacgccgatagcaatagtcacccaaatcaaccatttacgacgaccgattttatctgcataaaaaccggaaatactgataaaaataccaaatacaatggcactaattaataacaagccagtaaatgtatttgctgggattcctaaaccaagcgcataacctgcttcagaaagctttggcacggttcgagaatatgcctgtgcaaaagccgtcataatgtaaaacaaagaataagttgccaccataataaatgtaccaatgatcattggttttaagtgtttggtaaacacaacactcactggtgcattcaattttttgcctttttgctctgcttccacaaatacgtggctttcgtgcaaagttaagcgaacatataaaccaactgcaactaataaaatggaagatacaaatggaatacgccacgcccattcaacaagtgcattatgaccaagtaaatagctagctaagaagaacgttccattagcgacaaataaaccaattggtgcgcctaattgaggaaaagtaccgtaccaagctcgttttccttctggtgcattttctgttgcgactaacgctgcacctccccattctccaccaagtccaattccttgacctacgcgacatacacaaagcaaaatcggcgcccagataccaatttgagcataattaggaagtaaaccaattactaccgttgaaccacccattaaaacaagagaggcaaccaaggtttttttacgaccaattttatcgccaaagtgaccgaataatgccgaaccaataggacgcgcaaaaaatgctaaagcaagcgtagaaagagaaagtaaatcattagaaagcggatcatcgctatgaaagaattgcgtattgaaaactaatacagcggcagccgcatagatataataatcaaaaaattcgattgccgtaccgaccatcgaggctaacgccactttcatcggattattacgaagttgtgtagacattgtgtttccttagaagtttattataaagagaaaggattgaatcctagcattttaactaaggtctaacaatttttaatatgcaattttctatttttttagagaaatattttgagttttctaaatgtgagttatgtccagcgcagggaattgtcactaaatcaatttgattttctttggctaatacttggaacttatgatctctttcgccacaaaaataaaaaaatggcaaagaacttaaccgcactttttcactaaaatcaggttgtttggatagacttgtcgccagcagcattttgccaatattttccccacaatttgattttcgtttttcaaccaactgtaatctttcttctgcagtcaaatgagaaaacacaggttgttgataccaatcattcaacactttttctggtggttcttgtataaaacgttgcgcccaagcaaaatcctgctgaaaacgagcctgcttttcttcgtcagtttttaaacctagattcgctccttctaaaataacgccttgcaaattagatcgttccacctgagctttcagcgcataatacaaagcgatccttccacctagagaatacccaacaagaaaatagggttcatttttcaccgcacttttaatttgcttagccaaatactcagccgtttcttcaaaatttgtgacttcaatatctctagcttgcccgtgaaaaggcaaatctagcgcaatacaattaaagtgcggtagattttcaatgactttttgccagtcattttttgtaccaagaagtccgtgaagaaaaatgatgtttatcattgaagggattattgatagaaataataaaatatggcggactaaagcccgcctacagaatatttaagcaccaatcacggcgtgactaatttgatcgattaagcgtttatacaaactactaccatcactcggattcgttttaatttcaattaacgttgccttgcgacgactataagcctgtttaacaacggaattgagatccgcccaagtataaggatgagcgtatttgagatcgaacattgccgcgatttgagaaaaatcgccattatgcggtaatcgatagaactgatctttgacttgttcatccacaggtaacatatcaaaaatcgcaccaccattattattgatcacaaagattagcgttggttgcgtaacatttttgaataatgcgaaagaatttagatcatataaagtggacgtatcgccaatcaccgcaacaacaggtttatttgaaccaatacctattccagcagcagtagccaacaaaccatcaattccactcgcaccacgattggtataaacgggataactttcgggtaattgcgttagcgcatcaaccagacgaacaagtaaactattacctaaaaataaaacaccgttataaggtaaaagtgttggtaaacgtaatgctagcgaggcttccgttaaatttccgcccacttgctgttcaataaaggtcgcacagaacttagataaagctaacggctcaagcaaccaaggcttttggcgtaaaggtggatgcgcacgtaaccaatgatgcgctttagcattgaatcttgtcaatgaatgatggtaaggatctagtgctttaccgctttgttcaactagccaaaattcccctttaaacgcctgcaagaattgattaatgcgtttactaataaaacgcgcgccaaattgaatcacaatatcagcttgtagaagtttttcacgaacagtttggtttgctagccaaatatcttcataaggcgtcgttggaacaacaccagattgaatatccgtcagtaacacccagcccatagcacttgcccaagaattaatgcccatcgcttgttctgcaggtaattgaccaaccacaacgacaccacgtttggtacgccaatgatcccaattttcatgcattaatacttcgttttgttggacttctacatttatccaagacttgttttgaattaaccagcgttgtaacggctgtagccaactatgggaatttacttcctcatcagttgcatcataaagtggctcggtaaatggcacattaatatgaacaacgccaccttgttgtttttgttggaaagctgcctgttcaagtagagaaatcaaccactgcgcagaataatcagcgttcggtttaggtaaattaacatttgcaactggatactgaccaaacatattttgttgcaaaatagcttgatttgcaccgcactcccaaagttctggtggacgatcagcagttaaaacaaataaattcacaccggtttggcgcgcttcaataattgctggataaaggtttgcagtcgccgtgcctgatgtcacaataatggcaacaggtgattgagttgccttagcaataccaagtgcaaaaaaacctaaaccgcgttcatcaaaatgcgtatgacaagtgactgaacctgcattttgcaaacgtacggcttctagagttaaaggtgtcgaacgcgaacctggcgcgatacaaacgtgagaaacgccttggcgcaccaaggtttctaaaatcactttcgaccaacaacgattaaacacgcttaccgacattttttttctccgttatcatttttcttctgcaaacaaggaaattaaccctgctgctttacgttcaatttctttccattcttccaatggctgcgagcctgccacaatgcccgcgccagcaaatacacgaatacgatgaccttcaataaaagcagaacgaatcgccacacaaaactctgaacatacatcgctcatcacgcccaatgttcccgcataccagcctcgatcaaaggtttcgatttctgacaaaatcattttggcttgttgctgtggcaaaccagatactgcagctgtaggatgaatcgcttttaatatatttacatctgcataatgtgcggtcaaatttgcgcgaattttacgaatcaaatgttgtactttacgtaacggtttcaattccacattgcttacatcaaaactttctacttgcttacgtaaattctgcgaaatatcttctacgaccaaccaattttcttttaaatttttctcatcatttaacaaccaattggcttgagattgcgtttcttcctcactttcagaaaccgatgctgtccccgccaaagcttcggttagcaacaaattatactcacgagcaaataggcgttctggcgtagaaccaacaaaaaccgaatgagaattttcagcccataaaaaatgataancaaccttgatttttgttttttcgctttctgctaaaaaatcgtacgcattaatcgcttgctttaatgaaaagtggtttcattggctacacaatttttgtcagctctccacttttaatttccaccanagcctgatttacccaacacaccaagntcttttattagctcgaggctcttatgcaaagaaattggtttggtacgcaaaagggggggagattttaaagg

SEQ ID NO: 531 - DNA, 6732 bp, H. influenzae
atcttcctcttgacatcgctaagtctgtgtaaaacttagatttttgcctgatcaattttacacattaaatatgctaaaatagacattattcaaaactatcaaaaaaccgaccgcactttatgtctgaaaaaatcaacacaaaaccgttcattctacattccgactttcgtccctctggcgatcagccacaagctatcgaaaaattggctgaaaatttaacggatggtttggcgcatcaaactttgctcggggtaacaggctcggggaagacgtttactatcgccaatgtaatcgctcaattaaatcgacccgcaatgttacttgcgccaaataaaacccttgctgctcagctttatgcagaaatgaaagctttttttccagaaaatgcggtggaatattttgtgtcttactatgattattatcagcctgaagcctatgtgcccagcagtgatacatttattgaaaaagatgcgtctattaatgatcaaatcgaacaaatgcgtctttctgcgacgaaatcttttctagaacgtcgagataccatcgtggtggcttccgtttctgcaatttatggtttgggcgatcctgatagctatttacaaatgatgttgcatttacaacaaggtgccattatcgatcaacgccaaattttagcgaagttagcggaattgcaatatacccgaaatgatcaagcatttcagcgtggaactttccgtgttcgcggagaaattattgatatttttcctgctgaatccgatgatcgtgcggtgcgtattgaattatttgatgatgaaatcgagcgtttaagtttatttgatccgctcactggcagtagttttggtgctgtcccacgttttacgatctatcctaaaactcactatgttacgccaagagaacgtattttagatgcgatagaaaacatcaaaaaagaactggtatcacgccgtgaatacttcattaaagaacataaacttttagaagaacaacgtatcagccagcgtacccaatttgatattgaaatgatgaatgaattgggctattgctcgggaattgaaaactactctcgctatttatcgggaagaaatgagggcgaacctccaccaacattatttgattatatgccctctgatgccattttaattattgatgaatctcatgtaactgtgcctcaaattggtggaatgtatcgtggcgaccgttcacgtaaagaaaccttagtcgaatatggtttccgtttgccatccgccttggataatcgtccgttacgctttgaggaatttgaacgcttagctccgcaaaccatttatgtttccgcaacaccagggccttatgaattagaaaaatcaggcactgaaatcatcgatcaagtggttcgccccactggtttacttgatccactcattgaaattcgtccagtgtcaattcaagtggatgatttactttccgaagctcgccaaagagcggataaaaatgagcgagttttagtcacaacactcactaaaaaaatggcggaagatttaacggattatttggatgaacacgggattcgtgtgcgttatctgcattccgatattgatactgtggagcgagtagaaattatccgtgatttgcgtttaggggaatttgatgtattggttggaattaacttattgcgtgaaggtttagatattcctgaagtgtctcttgtggcgattttagatgcggacaaagaaggatttttacgttctgaacgctctttgatccaaaccatcggtcgtgctgcgcgaaacttaaatggtaaagcaattttatatgcagatagcatcacaaaatccatggaaaaagccatcaccgaaactaatcgtcgtcgtgaaaaacaaataaaatacaatgaagaacatggcattgtgccacaagcattgaataagaaagtcggtgaattattagatattgggcaaggtgcaaaccaaaaagcgaaagccaataaacaacgtggaaaaatggcggcagaaccaaccgcactttataatgcaccgaaaaatgccaaagaatatcaacaacaaatcaaaaaattggaacaacaaatgtataaatttgcgcaagatttggaatttgaaaaagccgcagcaattcgcgatcaattacatcaattacgtgaacaatttgtttttgataactaaaaaaacgccagcttaagctggcgttccatttatttattttcacctgaagaatacaagcgatttttatataaataactacctaataaagcgtgagccaatgcctcttttttcattgcatcaggtacgtcttttggcgttaaagtttctgttgatttatcataatgataaccttgcgctgctttatttgacatttgaattaccacatcattattgcctttcatcattgcttgagtttgatcgtattgcataaaagcacgatctgggtttacatcttgcgttaaatcaaaaccaatcattggataattgccacttacgccagctaaagaaagcaatgtagttggcatatcaatttggctcacaagacggctatcacggcgtggcgtaatgccatcaccaagaatcaaggctggaatatggaaatgcttaatcggcacaagacttgctccgcctacacgagaatcgtgatccgcaacaattaagaaaatcgtatctttccaataattagactgttttgccattttaaagaaatgacctaaggcataatccgcatattttgctgcgttattacgagtggcttttggttgctcataaagctcaatcttgccatctggatattcaaatggatcgtgattgctggaactaaacactaaactaaaaaacggtttaccttcattttgtaatttcgtgaaagtttcattggctttatcaaataaatcctcatcactcacgccccaagtgccagtaaattttggattctgatagtcttgttgatcccaaatatctttaaagccattaccgtagaaaaaactcgccatattgtcgaagtgcttttcgccaccataaataaacgaagtgttatagccttgtttatgtaataaatccgcaatagtaaagaaaccactttgggcattattaagtttcaccactgcacgagctggtgttggcgtaaaacctgccgttgttgcttcaataccacgtactgaacgtgtgcctgttgcataaagattttcaaataaccacccttcttttgcgagctgatccacatttggagaaagtggtttgccaccaagtgttccaataaactgagcaccgagactttcttgtagcaaaatcacgatatttttaggtttaccctgataagtcgcgacatttttcgttaaagttgggtatttatctgaaatgtaatcactttctggacggccacgactggctttaacaatacgaaaaatttcatctgcatccatttttccgtacatttctgaagatttttcttcatctttaaattgctgtgccgcataaatcacggaatagccagaattaagcaccagagaattcactaacgcatcagaagaaaatgccaccatagcgggatttataccacggtgttgaaaacttgaacgtgccccaaggaagctcaagacaatcacaagcaaagcaatcacagggcgaagtttccaactgattgaacctaaatttttgactgcccaaccagaaattttccaataaatcacggcagctaaaatcgtgaaaacaaggctaaaaattaccgcacttaaatgtccttccgcaagcattgaaaaaacttctttcggataaatcaagtattcgataaataaacgatttgggcggtaatcgtaggtttcaataaaggcaggtgtggcaatttccataaagataataaacacactaccaagggttagccaaaggcgtaaaatttttacccaaactttactgctatggaacaatgttgtgagcaatgctggtacgccaaataaataacaaagtgccacaacatccattcgtacgccttgcaaaaataattgcaaccagccatctacggcggatacacgctctgattgccacacagcaagtcccaaacgggataaggaaaggatgatgagattaatcaacacgaatgtgaagatggggaataaaggaaaatgtgcttttttcattgtaaaaaccactaacacaacgacatccaagccgtattaaattaaagaaagataggcaactgtctatcggtcggttccttttcgacacaacaaaagtcttaaagtgcggtcaattttcgcatagttttactcaatctcaaatgtaaacacattcactagaaaataaagcctcgagaaaaatcgaggctttgttaagtaaacgacggaaatttaataaaaattcaccgcactttttttcgattactcttgttgtgctttcactgctgcataggcaatcatattgataatacgacgaacagatgcacctggattaagaatatgcgcagatttattcatacccattaagatcgggccaacggtaattgccgtagtggtgctgcgtaataagctataactaatacgtgatgcactcaaatcagggaacactaataaatttgcgcttcctttcaatgggctatcaggcatgacttcttttcggtgagcttcattcatcgctaaatcgccacgcatttccccatcaatcattaaatgtggattgcgctctttgacgatttgtaatacttcgcgcatttttggtgcgcctaatgaatcagacgaaccaaaattagaatgagaaagcaatgcaactgcaggttcaataccaaaacgatgaatttcttctgctgccattaaggtaatttcagctaattcttctgctgtaggattactgtttacgtgagtatctgttaagaatacgttacccgtcggtaatacaagactatttaaagcagcggcagttttcacgccgtcttttaagccaataatatcgcgaatagatgcaaggtgttttccgtatgaaccaaataaaccacatactaaagcgtctgcataacctaagctaagcaatgtagaagctaatacggtagtgttagaacgcacgacacgttttgcaatcgcaggtgtaatgcctttacgtttagtaagttcgtaatagtgtttccaacattcttcatagcgaggattatcttcgttatccacaatttcaaaatccacacctgcagttaaacgtaaaccaagttttttaattttttcttcaatcacactgcggcgaccaattaaaattggatttgccaagcccattgaaatcacttcttgggtagcgtgtaatgctttattttcttccccttccgctaaaataatgcgttgttttgccgattttgcttggctgaaaatagggcgcataaacaagttggttttgtaaacaaactgagtgagttggtcaatataaatatcccaattttgaatcggacgagttgccacaccagattccattgcagcttttgctaccgctggagcaatacgcacaatcaagcgaggatcaaatggacgaggaatcacataatccgcaccaaatgttgccccttctccaccgtaagcagaggttaccacttcgttttgctcttctaatgcaagatcagcaatggcataaactgccgcacgtttcatttcttcattaatagtggttgcgcccacatctaatgcaccacggaaaataaatgggaaacaaagcacgttatttacttggtttggataatcagaacgacctgtacatacaatcgcatcaggacgaaccgcttttgcttctggcggggtaatttcaggatttggattagctaaagcaagaataattggatgcgcagccatggttttcaccatatcttgtgtaagcgcaccagccgcagaacaacctaagaaaatatctgcatttggcatcgcatcaccaagtttacgccagccattatcttcaattgcataatcttttttggtttgatccattttgtcatcacgacctttatatactacgcctttcgagtcgcaaaccgtgatattttcacgtttcatacctaaagaaagcaataagttcaagcacgcaattgatgctgcacccgcaccagaagcaacaagtcgaacatcttcaatttttttacctacaatacgaagagaattgatgatcgcggcagcactgatgatcgctgttccatgttggtcatcatggaatacaggaatattcatacgctcacgtaatttttgttcaatataaaaacattctggtgctttaatatcttcaagatttactccaccgaaagttggctctaacgaggcaataatatccacaagtttatcgggatcatgctcattcacttcaatatcaaacacgttgatgcctgcaaattttttgaacaatacgccctttccttccattacaggtttgcccgctagcgcgccaatattgccaagtccaagcaccgctgtaccattggaaatcaccgctactaaattgccacgcgcggtatatttgtaagaggcggcaggatctttttcaatttctaaacaaggctctgccacacccggtgaataagctaaagccagatcgcgttgtgttgcgagtgattttgttggggtaacttcgatttttccaggaattggaaattcgtggaaatctaaggctgcttgacgtaattgttcgctcataataagtgctccattttcttgaaacaggattgaaatactgcgtcgattatatctgttttttattcaaaaaattgtgacgaactgcaaatcggggtaccgagccgaat

SEQ ID NO: 532 - DNA, 7828 bp, H. influenzae
  misc_feature (875)..(875): n is a, c, g, or t
ctaagcccaataaagtcgcatcttcttttaagattgtaaaaatttcatttggtgtaagcaagcccgagcgtggatagttgccatagaatataagcacaaagtgttatggcagagccgaccaaaatagagaagcgcaatgcttttacaatgccatctaagtatttatttaaccttggaatggaaccgtggaaaccaaacgccgtgaaaaatacagggcttgcagagataattaaagccttaacaattggcgtcgccattaagttatcaaatttgatttctggcaacattaagcttaacaccacggcaaaggcagcaagcataacgaaaaataacacgcgattaattttatctacgctatgtgtgccgatgacaataaatgaaccgaaaatcacggtaaataataagacgctaactttatcgccaaaactttctggtaataaatcttttagtagtgaaccgccaccgctgatataagcggcaattaatgcgtataagaaaataattagcacggctgtggcaataatgcgtcctgttttaccaaaatattgttctgcaagtgtgccgatacctgcatcactttccgcagtttgatagagttcaacgaataaaagtgcgctaaaagttaataatgcccaaagccccaataacaagactaaagtaaagccgaagccaatgccagcggaagtgagtggcatagccaacattcccgcgccaatcatcgtaccagcaacaagaagtgtgctgcctacagttttgttcatttttgtttccttatgatgtaataaaaaatttacgataattgtattgtataatttacagtctgtaaataaaatttataaattgtgaattttttactatcttccttgctatattgntgcttaagaagaaggaataaaatgatatttcctaaattttgttgtttatcaatacatttaattaccatagtttcactgtattttacgatgatattgaattgcccaaacaaatcttctaattgctcacttaatattgcctgaccattttcttattatttcctccttctggatgtaatccaatcccttgatggcgttcttgtagttttgcgataatttcgtaccactgaagatcttgattgtgtaataatacggttaagtgatagaccaaatctgtagcttcagaaatgacttccgctttatcttgtgcgaccgcagccaaggcagtttccacaccttcttcccccactttttgggcgatttttttggtaccttttgcgtgtaatgttgcagtataagaattagaaggatctgcatttttcttttcttttaaatgttgttctaattttataaaccacgcccaatttgcaaattgttgcttcttgttctctgattgtggagaggtaaattgatggaagcagctgtattcacctgtgtggcaagttgccccaatgggatcaactaaaatgagcaaagtgtcgttatcgcaatctaagctcatttcttccacatttaaaaaattgcccgagatttctccttttgtccataatcgttgtttggtacgagagaagaaagttactttacgttctttgatggtttttgtaagggcttcttcattcatatagccaagcattagtacctcacgagtacttatattttgaataataacaggaagaagaccattaactttttgccagtctattttagtaatattcattattcactccgaatctcgatggctgattgcacaaggtaggattttaactcgccaatttcaataatctgtttatggaatacgctggcagctaatgccccatctacttttgcttcaataaaagcatcacgaaaatgtaccattttacccgcaccgccagatgcaattagaggtactctacatactcctcgcaccagcttgagctgggctaaatcgtacccgtttcgtaaaccatcttgattcatcatatttagcacgatttctcctgcaccgcattgttgtacttcttttacccaatctaacaactgccaatgagtttgtcgggtacgtgtttcatcgcctgtatattggtttacccaatacttacctgtttcctgttcaaaccaactatcaatacctactacaatcgcttgtacgccaaaacgatctgctaagcgagaaatgagcgttggatcagcgagagcaggggaattaatcgaaattttatccgccccaaatgcaaacaatttttccgcatcttcaatggttttaatcccacctgctacgcaaaacggaatatcaattacctgagcgattcgttctacccaacttttatccacggtacgaccgtctgatgaagccgtaatatcataaaataccaattcatcagctccttcttgcgcatagcgttgagcaagtggcacaatatcgccaataatttcgtgggtacggaattgtaccccttttaccacctgtccatcacgtacatccaaacaaggaattatccgttttgccaacattttgatgcctccgaaagcgtaaatttttcttctaataaagcgcgacctacaattacacctgacacacctgtgccttttagagcctcaatatcagccagtgacccaatccctccagaagattgaaactgaataggtggatatttctcacaaatttcttgataaagtccaatatttgaacctgtcaaggtgccatcgcgtgaaatatcggtacataaaacttgttgtaagccaacggtttggaaatcttcgatcaacgtttctaatagtacaccactttcttcctgccaaccgctaatcgcaacgattttctgaccgcttgcattaatattcacgtctaatgctagaacaaatttttccgcaccatatttgatgaaccagtttttcaccattgaacgatgagttacggcggttgaaccaatcaccacgcgattcgcacccacagccaataaatctgccacatcttgctctgtacgaatgcctcctcccacttgtactttacattgtgttgcttcaacgatttttccaataagtgcggtttgtcttgactggggatttttcgctcccgttaaatcgactagatgtagttgttttgctccttgacgtacataattatcaaattgcttaattggattgtcagaataggtagtttgcttggcataatcgccttggtgtaaccgcacaacttgaccattgataagatcaagagcagggataataatagattgtttcattgtgtttgatcctgtatgactatatgatctagtgattaaaacggtactttttccacaaaattttttagcaacaacgcaccatttttacccgaacgttcgggatgaaattgtacaccgtaaaaattctctttcgctatcgcagcagaaaaattcacaccataattgcttattgccaccgaatgttcattcgggctaactgcataactatgcacaaaatagaagtgactattttgcacaataccatcaaataacggacagttttttacaaattgcacgcgattccatcccatttgaggtaacggtaaacccgtatcgggaattcgattagtttttccgcttattaggtttaaggtcggcacattaccctcttcggaaaattcggtcattaactgcatacccaaacaaattcctagcactggttgagttagattttgaatggtttcgatcaattgacgttcttgtaaattatacattgctgcatttgcagtgcctacgccaggtaaaatcagcttatcggcagatttgattttattgagatcaaaagtgatctcggtattgtaacctaatcggtcaaaggcgaattttacagaagaaaggttggcacaacctgtgtctataatcgtgatgtttgtcatttttttatccttttacaatcggtcgaattttgcaaaaatacgacaaaaattaaccgctctttcaactataaaactccttttgaacttggcatttcatttccttcaatccgaatcgcctgtcttaatgttctcccaaaggctttaaataagctctctattttatgatgatcgttattacccgtgacatttaaatgaatcgtggcaagcattgaaaatgccaaagattgaaagaaatgttcagtgagttccgtactaaaatcgcccactttatcgcgtttaaagcaggcattgaatttgatccaaggtctgcccgataaatctaaagcacattctgctttacattcgtccattggaagcacaaagccgaaacgggcaataccacgtttgtcaccaatggcttgtttcagtgcttgtccaagggcgagagcggtgtcctccaccgtgtgatgttcgtcaatccataaatcgcctttacactgcacgttcattctaaacccaccgtgtgtggcgatttgatcgagcatatggtcaaaaaaaccaacgccagttttgatttcatttacaccagcttcatctagccaaatctgcactttaatatcggtctctttagtttgacgaattacttctgcaaaacgtggcggacgtttgccacagtttgtgaccgtttcccccaacaatttttctgcaatcagatcccaattcattttctgtggatcgtattgaatagctcgaatacctagattttctgctaattgcacatcggtctctcggtcaccaatgacaaaagagcggtcaatatcgaataaatttttacgaatatagtgatcaagcaacttaatttttggtttgcgacatagacaattttcttcgggcttatgcgggcaaatgagtacttcatcaaaggtaatgccctgagattcaaataatgccatcattacattgtggggcttatcaaaatttgtttgcggaaaagcatccgtaccaagcccatcttgattagaaactatcacaaaacggtatttcgctttcagtctgaggagtgcgggaatcactttcggttctaattttagtttctctaaactgtcaatttggaaatcagtttttggttcatcaattaatgtgccgtctcggtcgataaaaagagtaggttgcatatttttctccgtgtatgttatatgaatggtatgaggtttatcatttgctttatacaaacagtataaaactaaataatctcgaatcgctctgtgacttaaataggaggtggttcattttacctccttaattgcttcaacaactttctcacactcattccttgttcccacagtaatgcgaatacaattttgtaaatgcaatgtcttattctggtctcttaaaataattccttgttcccacaatgccttaaacacagcttgcccgttttgacatttgatcaacagataattagcttcactttcatacactttttccacttgatgtaaaactaaaagagctttagcaagccattgacgattggaaagaagttcttgtgtgagagcttgaacagtggcgatgttcgcaggtcttaacgcttgttccgcaagatcagcactcggcacagggataggatatggagcgattaccttacttaagatgtcaattagctcagggtttgctaacacaaaaccacaacgcaatccagctaaagcaaaggctttagagagcgtgcggataattgctaagtgcgggtaatttttaagcaaattaataacgcttgcttcaggacagaactcaatataggcttcgtccaccaccacaatcgctttgcctgccgtgatttgcaaaagatcgagtatatctgattgcttgagcaaattacctgtcggattatttgggctgcatacaaagactacttttacatcattaagatgatttttgatttctggcaaattaagctgaaaatcgtcagttaaaggcacgctcttacttagcacacctgccgtttcagcactcactgcatacattccgtaagtcggaggacagaataaaatggcatcttgtttgggttcgcaaaaagtgtggattatcaattcaatgccttcatcaccgccacgagtaacgagtacattttcagttgaaacgcccgcataattcgcataagcctgtaccactctttgaggctgaggttcggggtagcggtttaaatccttacccgaaagctgaaattcaggcgaggttggatattcatttgcattcagccaaatcgtaccattgccgccgagttttcgagcggattgatatggcgttaaggcttgtatattttgtcgggataaagttgtgattgtcattattgttttcttccattgtaaaatgtgcgaattgtaatcattcatacatatttcgtattgttgtatgaaaatttgactgcttacgtgtcgtgcttagatctacaattaatatcttagatattgagtttcgccaatcttacacttactgccattttatgtgctgccaattgctcagcttctgccatcacttccaccgtttcagcaaggtttttaaaaccttttggtgtgagttcttgtactgtcattcgcttactaaaatcagctaatcctagactagaataagttttggtgtaaccataagtaggcaaaacgtggtttgtgccactggcataatcgcccatactttcaggcgaatatgcacctaagaaaattgagcctgcgttatctaaatatggtaataatttacgggcgttttttgtttgcacaattaaatgttcaggggcatattcattgctaatttctaccgcttgttcaaggctttctgctataaaaatacggctgtggtttaacgcttttcgagcggtttcagcacgaggtaatagagcaagttggcgttcaatcgcaagtgcggtctcttttgccagagtttcacaggtcgccaccaaaatcacttggctatctgccccatgttccgcttgagagagtaaatcgcttgccacaaattcaggatctgccgattcatctgcaattactaacacttctgaaggtcccgctggcatatcaatcgccgtactattttgtgctacctgacgttttgcttctgtcacaaatgcgtttccaggtccgaaaattttatctactttcgccacactttccgtgccttgagccatcgcaaaaactgcttgagcaccacctatagcgtagatagtttccacaccgcaaagatgagcagtgtagagaatttcatctgagatcggtggcggtgaacaaagcacgatttttttacaacctgcaattttagcaggaatagctaacatcaatacggtggaaaacagcggtgctgaaccacccggaatataaagccctacacaagaaattggacgagtcacaacttggcaacgcacgccttcttggatctctaggtcaatttcctgattttgctgtgctttgtgaaaggcttcaatgttcgttttggcttgctcaatcgcattgcgaagttttacagaaatccgactgcttgccgcttgaatttcatctgccgaaacaatgagtttatctaacttcacgccatcaaatttttcacagagttcaaataacgcccgatcgccattgtatgccacattttcacgaatggcattaactgcctgctgaatgttttccccattttgttggactggacgcataatgactttgcgtttttcagtttctgataaatgattccaaataattgtttgcattgtttattttcctttgtatccgtaaaatggatgataacccaccattttgagatattgattatttaaatggcgagtcaaagctcgcactacatttactccatcatcttctcaattggtaacactaaaattgaactagctcctgcctcttttaactgttccattgtttcccaaaataaattttcttggctcactacgtgcattgctacccgagttgtatcactggctaatggtaaaatggtcggattttcaacgccaggtaaaagcgcagtgattttt

SEQ ID NO: 533 - DNA, 6580 bp, H. influenzae
aatttaaacgtgtatataaatgttgtataagtttgggtaataaggtttgtcggtctacatcaggatcaatttcacacacttccgcataaggctgactaatttctgtttgttttgacaacgacgcattaatacctacgccaatcactaaattgagcatgccatttttatgattagcaatttcaactaaaatgccacctaactttctttcatcaaacaaaatatcatttggccatttcacttgtacatttagcacttccgcaatcgccaaaccgatgactaaacttaacccctcaattgattttttaggatcaaacgtccaataaaaactaaacatgatttgcccagcaaaaggcgataaccattggcgaccacgccgaccgcgccctgcagtttgatattcagccacacaaagatcacctttttttaaggaaggaatattttgtagtatccactcatttgtagaggaaattatcggctgataatggatgccataaggaaaaagtgcggttgatatttgctgaggatttaataaaggaagcattggcactaagcgataatcttgtccatcaacgagaatatccaaaccaatttcacgtaattgttgaatatcttcctctagatttttagtaaaatttttccaattcagaccgcacttttgtctgacaatccgctaaatatgtcaataacgtaaaattcatcattcattccttatggcaaatagtatgaaaatcatagcataaatcctaaaatttcgttttcaaaataaagtgaaatctgtataatctcgtcgcaatattttttaacttcaacttagcgagaatattgcaatgtcattacgcattaaacaagaagcccttacttttgacgatgttctactcgtcccagctcactcaacagtgcttccaaatactgccaacctttcaactcaacttaccaaagaaattcgcctaaatattccaatgctttcagcagcaatggataccgtaactgaaaccaaacttgcgatctctttagcacaagaaggcggtattggctttattcataaaaatatgacgatcgaacgccaagcagatcgtgttcgtaaagtaaaaaaattcgaaagtggtatcgtttctgaaccagtaactgttttaccaaatttaacgcttgccgaacttgctgaaatggtgaagaaaaacggatttgcgggctaccctgttgtagatgaggaaaataacttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcgtgtaaagatgaatttggtcgtttacgtgtcggtgcggctgtaggtgcaggcccaggtaacgaagaacgtattgatgcattactaaaagctggggtggatgtgttgttaatcgactcttctcacggtcactcagaaggcgtattacaacgtgttcgtgaaactcgtgcaaagtatccaaatttgcctatcgttgcaggtaacgtagcaacggctgaaggcgcaattgcattagcagacgcaggcgcaagtgcggtaaaagtaggtattggtcctggttcaatttgtacaactcgtattgtaactggcgtaggtgttccacaaatcacggctatcgcagatgcagcagcagcattaaaagatcgtggcattccagttattgctgacggtggtatccgtttctctggtgatattgcaaaagccatcgctgcaggcgcaagctgtgtaatggttggttctatgtttgcgggtactgaagaagcaccaggtgaaatcgaactttatcaaggtcgtgcatttaaatcttaccgtggtatgggctcattaggtgcgatggctaaaggctcttcagaccgttatttccaatcggataacgcggcagataaactcgtaccggaaggtattgaaggtcgtattccatataaaggttacttaaaagaaatcatccaccaacaaatgggtggcttacgttcttgcatgggcttaactggctgcgcaactattgatgaactacgcaccaaagcggaatttgttcgcattagcggtgcaggcattaaagaaagccacgttcatgatgttgctattactaaagaagcaccgaactatcgtatgggctaatctttaaggtgggctttagcctgccttttgctgtttaaagtgcggttggtttttgcaaagttttaaataatatgaaccgcttacactatcaataataagagcattataaatgacaaatatccacaatcacaaaatcctaatcctcgacttcggttcacaatatactcaactgattgcgcgtcgtgtgcgtgaaatcggtgtgtactgtgaactttgggcttgggatgtaaccgaacaacaaatccgtgaatttgctccaacgggtatcattctttctggcagccctgaaagcacaactgaagaaaacagccctcgtgcacctgaatatgtgtttaatgctagtgtaccagtattaggcatttgctatggaatgcaaactatggcgatgcaacttggcggtttaaccgaaacttctgaccaccgagagttcggctatgcttcagtttctcttgaaaattccaccgcactttttgcaaatttaaacgataattcgaccgcttctgagccgaagttagacgtttggatgagccacggcgataaagtaacgcgcttaccagaaaacttcaaagtaactggcacaacgccaacctgcccaattgctgcaatgtcggatgaaaatcgtcgtttctacggcgtacaattccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtaggcgatgatgaagtgattttaggtttatctggtggtgtggactcttctgtggttgcattacttttacaccgtgctatcggcaaaaacttacactgcgtatttgtggataacggtttactccgcttacacgaaggcgatcaagtcatggaaatgtttggcgataaattcggtttaaatattacccgtgttgatgctgaaagccgtttcttaggcgaacttgcaggcgtatctgatcctgaagcaaaacgtaaaattatcggtaaagtatttgttgatgtatttgatgatgaatcgaaaaaactcactaatgtgaaatggttagcacaaggtacgatttaccctgatgtcatcgaatctgcagccagcaaaacaggcaaagcccacgtcattaaatcacaccataacgtaggtggcttaccagactatatgaaacttggcttggttgaaccattacgtgaattgtttaaagatgaagtacgtaaaatcggtttggcattaggcttgccagctgaaatgatcaaccgccatccattccctggccctggtttaggcgtgcgagtattaggcgaagtgaaaaaagaatactgtgatttattacgccgtgcggatgcgatctttatcgaagaattacgcaacagcggttggtatgaaaaaaccagccaagcattcagtgtgttcctgcctgtgaaatctgttggagtgatgggcgatggtcgtaaatacgattgggttatttccctacgcgcagtagaaacaatcgattttatgaccgcacattgggcacatttgccttatgatttattaggcaaagtgtctaaccgcatcattaacgaagtgaacggcatttcccgcgtcgtgtacgacatcagcggaaaaccaccagcgacaatcgagtgggaatagaaaatctctatttcagataatttctaattatttcagtaactttaataagtgcggttaatttttaccgcactttatttttgtttaaaagcccttctatgccaatcacaatgagacttaaccaaataggcacataagtaaaatagtcgcttgtggttatttgattatccagcacaaagacagctattaaaaaaagcagtatgggttcaatataactcaacaccgcaaaaatactaactggaatttgttggctggattttaagttggctgaaagcgaaatcgcactcacaataccaagtgctggtagcaataaccaataacgatattcttgcgtaaccaaagaaagcgtatcgctttgagaaagaatataaataaaccaaggaatcgaaattaaaataatatccaatgtaattccttgtagagcagggattttcatcaatttacggcttagataataaaatggataaaccgtacaaacccacaaacttgtccatgaaaaactttgagtgtgccataattcatgtgcaacaccgcaggcagccagtaaaagcgcgattttctgaataaatgataaacgttcttttaaccaagcccatcctaaaacagccataatcagcggaaaaagaaaatatcccatcgcaatatttatcccttcaccatttagcggagcccacataaagagccagaattgacttcccgcatctaatgtccccagtaaaaataaaacccaacgcgtccaactttttcctaacgttgtcgtgataagagacaaaagagagcggcaaccaatagtcgggaataaaattaaaagtaacccaaagatcatggtcagcatacgccacgcaaaaacatccgttccgctaagtggttggagccatatactaaataaatacaatatgccaaataaacattgtgaaaaaatgcacaataatacaccttgagtaactactttcattttgaacctcatctcatcaatgtgattattataaaatcccaagacaataaaaaatctcaactttattttttattgtgataatatttttctcgatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcgttattacaaaacgagttgcagttgtttccccaaaagccgttgggcgtacgattagcgtatttgtcatggtcgaaatggataatcaccattcttattatcaagagcaatttgaacggaaaatgcgtcaagaagacgaagtggtaagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatagaacaagtgcggtaaatttttaccgcactttgtgtatgattaacttagttttgtcgtctgttttaagaataaataaccaagtattgccgaaacagttgatccaagtagaatacctaaacgagaaagagtattgacactttcccccgcattagcatcaaacgcaaggcttgctaagaacattgacatcgtaaaaccgattccacataaaaccgcaacagcaaaaatttgtttaaaattaattccatctggtaatttagctaatcccaatttaacagaaagataactaaatccaaatataccgactggtttaccaataattaaaccgcttgctatagccaataataatggcgacgaaatcatattcacatctatgccagcaaaactcacaccagcattggcaaatgcgaaaagtggtaaaataacgaaagatgaccaagaggataaaatatgctcgaaatcatctaatgggcgttctccttttttacctttcaatggaatgctaaaaccaataataacgcctgctaaagtagcatgcacaccagactttaatacggaagcccataaaattgcacctacgaccatataagcgcaaagtgcggaaactttgaaacgatttagtaatatcagcacaataattgccacggcagaaaaaattagtgcttgtacactcaatccgtgcgagaaaaataatgcaataacaactatcgcaccgaggtcatcaataatagcaagggcaagtaaaaatattttcagtggaagtggcacttgtttactcaataacgccataattcccagtgcaaaagcaatgtctgttgccattggaattgcccagccattagctaaacttggatcttgtttagcgataaaccaataaactacagccggtataaccattccgccaatagctgcaatagcagggaaaatagcttgctgataggtagaaagcgcgccttcaaataattcttttttgacttccattcccactaatacaaaaaacaccgccataaaaccatcgttaatccagtgaattaaggttttattaattgagaaactaccaatttgtaaacttacag

SEQ ID NO: 534 - DNA, 8189 bp, H. influenzae
tgctggctgattacaacctcggttccttggttatttaccaaaacgtgggagaagaaattattttgtatttatcttcaatttaaagtgacttctgcagatagtcgtcgattaattcaacttcgcgtgacagtgccagatgaacatttggcagaaatgaataatgtagatgaaaaatctgaataggattttattatcaattaaatttatgaataaatatttaacttattttattgcttttatatcgggtttagtcggtgtttttgccttttcgccatttgattattggcctttagcctatgtgtctttactcggtttactttatgtcgctaaaaatcctaaaaaatccaccgcacttttatccactttcttgtgggcgatgggatttttctgctttggagtaagttggcttaatgttagtatccatcaatttggtggcgcgtcgttaggagtgagttatttccttgtcggtttgcttgcggcttatcttgcgctatatccaatgctctttacctatttagttcagcgtttcaaagtgcaaagtgcggtaatttttgccgtgatttggacattgacagaatttttacggggttggatttttactggttttccttggcttcagtttggttatacacaaattgacagcccattttatggtctcgccccgatttttggggtaacaggattgacattctttaccctttgggcaagtgcggtcatttttaatctcgtttcatctttgtttaaaacgaaaaattttaaattagttttagcgaatgctttgttattgattattgtagggggattaagtgcttattcatcgcgaattcactttgtaaaatctgttgaaaataaggcaatttcagtcacgcttgcgcaaggcaatattgaacaaaatcttaaatgggatcctaattatttctattctactttggcaatttatcaaaaattaatcgcagaaaatcttggtaaaaccgatttaattattttgcctgaatcagccttaccaacccttgaaaatgcaattacaccattttttgaaaaattagagcatgctgctaaagaaactaaaacggagattatgattggaacggtattccaagatacaaaatctggtaagttattaaattcaattatgactactggaaacccagattttccttatcaaccagatacgccaaatcgttataataaacatcatctcgtgcctttcggggaatatgttccgctagaaagtattttgcgaccgcttaattcagtgtttaatttaccaatgtcagcatttcaaagtggagaggctgttcaaccctctttaatcgcaaaaaaacgtgctttttcgccagcaatttgttatgaaattattttcggcgagcaagtgcgacaaaatttgaaacaagatacggattatttgctcaccttatctaatgatgcgtggtttggcgattctattgggccttggcaacatttacagatggcaagaatgcgcgctttagaattaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataaaaacaccagttaaaatgaccgcactttttcattcatataaataaacattatgcgcataccaagaatttatcatccaatatcccttgaaaatcaaactcaatgttatctttcagaagacgctgcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacactgagcggatggataaaaaaatccaacaatggcaaaaaattgcgattgcagcttgtgagcaatgcggtcgtaatagcgtgccagagattcgtccactgatgaaattacaagattggtgtgcagaaaatgatggtgcattgaaattgaatttacatccacgcgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggacttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcattgcggaactttattcaaaactcaattttatgatgaaaaatgaccgcacttttggtaatgaaatggtggttgcgggtgggcctgtgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaatgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctttaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattagattcacattgtaaaaataaacttcattttagaatgattaaagcgcgattttataatcttgctttttcgccaccaaattcatctaataaattttcggtgagtttggctaaaataccagtcatcagtacaaaatctgcatcgaaacgctgtgcaaaatcttctttcagaatatcatcatttttttcccgtacagtatctgcaaattttaaacgtttgattgtgcaatcttcgttaaaaacgaaagttaaggtatcttcccattctaaggctaatttacttactacttttttgccatcttgcagaagagcgagaatttcttcattttctaaaggttgttttttgcaacggataacgctgtcttcctgactgccacgaagctcggcttcttctaatgcaagtaaccaatgcggcaaattatcttgaaggatccaattggttaaaatcgtgctaggttcattagcaaaggctaaaggcacgacagggagcgaacctaaggatttacgcagtaatgcgagcgcatcttccgcgcgtttacttgatgcggcatcaatatgaataagattattttccatatcaatccatagtgccgtatgctgatttttactaaatgcacgaggtaataaattcatcacgacatcatcttttaatgtttgtttttctacctttttaagtttgcgattttctttttttcaaggctttcaatgcgttcatcaagttcacgtttgaccacatttgccggcaagattttttcttcttttttggcgattaatagaatttgttttccaacagaaaaatagagtaaatcagaacctcgtaatggggctgaccagccaaatttactttgatcttgagcaccgcagggatggaattgacaatcttctagttgagtttgtagttgtgtaagatcccaatctagcggtttagtcagtctataagtcattaaatttttgaaccaaaaattaactttataactcataacatttcaccatgtacaattttatcattaaatcaataatttacttatttcaaaacaccatttataattcatagtatatcatcatatttcaattttttagtaaccataatggtaacttatcacaatcaagctagatttcttggttactaaaaaatatattaatacctatttttatatacataaacagatgtcttatggctaaaaaagtaaaaccacttgttgacactgaaatcaagaaagcaaaagcatcaaacaaaccatatacattgactgatggttatggactatttctaatcatttcaccaacaggttcaaaatcttggcggtttaattactatcgacctataacaaagaaacgagcaaaaatttctttaggcctatatccagcaattacactatcaaaagcaagggagttgagagaacaatatcgtcaattactagctaataagattgatccgcaagaatacataaaacagcatgaattactggcattacaacgacaaaacaatacattttttgccatatcaactcaatggaaacaaaaaaaagttctgaaatcaagtctgtaacacttaaaagccgatggagaacgctagaaaaatatgcatttccatatttaggcgataaccctattgctgaaattacaccacaacagttacatgatacagttataccattatttgaacgaggagtttctcacactgggaagcttgttattgcattagttaatgaaatcatgaattttgctgttaacaaaggtattattgagtttaataaatgcatcaatgtatcaaaggcttttaatgtaaacagaacaacacatcatccaactattagacctgaaaaactacctgaattcatgtctgcgttacgtcattcacatattgaccttatggtgaaatatcttattgaattctcccttttgactatcacccgtccaagtgaagctgcaaatgcacaatggaatgaaattgattttgagaaatcgctatggaatatccctgctgaacgcatgaaaatgaaaaaagctttcaccattccattatcactacaagtgcttaaaatacttaataagctaaaaaacatttcaggccgtagtcgttttatttttcaaagccaacgttatcctgaaagaccattacattcaagctctgccaatgcagcaattaaacgcgttggttataaagatcaattaacatcacatgggctacgttctatcgcaagcacctatcttagcgagacatttaccgaaatgaatctggaaattcttgaagcttgcctttctcatcaaagcaaaaatcaagttcgtaacgcctacaatcgctcaacctatcttgaacaacgaaaaccattaatgaatgcttggggagattttgttgaagaatgtatgaaaaaaagtatctaaaaataaagggaatcaatactgattccctttatttacctaacctttcttcagtaactctaccatttctctcagtagctttatttcattatctttttgctctactagcttattcaacaaaccttctttttcttccaataattgctgacaatgtgataacgataattttagtttttcaatctcaatcaatagagatttctcattgtctccctgaaatgacgaactaaaatgagaattctcattgaattgaacgaagacatttcgttcaccagaattaatcaattcaacaatatctatatctaaaatctgtgcaatttgctctagcttatccagatgtaatttcgtttcaccacgttcaatttttgcatagccattcaatgacatactcattctttcagccatctcttcttgtgaccaatgctttgtttcacgtagttttctgatcttttcatgtacgttcattcttatacccataaataggttaattttttacaacaaactgtgtgctaactatacatcgattgttggtagaacgcaaaatctctcttagataaaatttacaaatacaactatactggggatatttatgcttaaatctatacttaaaccaataggacatatactaaaacttctaataaaaactgctttattcttactttcattattattcatactaatgctaattatcggattcgttgataacaaaaaaattccaaccgaatttattgtttttgggattctaggtatttgttacatttgctacacatttaattcttgggcaaataagcctgaagtctgtccagtctgtaaatcaggcaaaattgaattggattcaattaaagaaattgaccgctggctgggaaaaactaaagtgcgtgaaagaatggcatctggaaaaacacgagaacgatatattcaatgcacgaaagtaaaaaaacgatatacatattgttgccaaaatcctaattgcaagcatacatatactaaaatacgggaagaagaattataggtgtaactatgttttcaaccgctataattgaaaaaattaattattacatctattgtcttgttgaccctagaaatcaaaatatcttctatattggtaaaggtattggcaatagagtttttcaacatgcacaaggtgcattaacttgcaaaactaatgaaaatgataaaatatcactaatcaatgatatacataaagatggacttgaacccttatactatattttaagacataatatcaaggaggaaaaacaagcacttgaatatgaggctttagcgatcgatttattatccattgttaaacctaatcaacaaccattaaccaatattcaaggtggcacacattcttctgaaaaaggtttaatgtcattatcagaactaaaacatatatatgacccacaagaattaaaaacagatttacctgttgttttaatcacaattaataaaaactataaaaaattaaaacaacaaataaaatcaggcgaaattgataaatcgcaaattgaaaaagaaatttacgaacgcactcgcggctattggaaaacgggttcacgccgtgaaaaagccaaatatgctattgcagtttatcgtggctggacattagcagcctacgaaatttcatactggattgaagcacctattgagcgtcaaggtcgttggggttttatcggtaaacttgtgccgaaagattctccaatttatcaagaacttgttaataaattaacctattcatcaaataatgattacaaggcgccacaaaatccaataacttatcgtaattgttaatatttactttaatggaatcttaaaatgaataaatttttattacatctatatttctaataacaaatattacatatgcaggaatccgtactattgaacttccgccagaacaatccggttcaatagctatgaaatgtggagactatatttattttggtgaaaaagttcatcttacgatgtctgcatgataaccagcttgttaaaaacatatgaacaaggccaatgtattacctcatgatgaatacaaactttttaaaaaagaatgtacaactaaacccgacaatgtttcacaagcctacaaaatgagaaattcatctaactatgtggaaactcccaaaaactgatggtttgtaccaatggatagtgaaactcaatacgcttatgaactcaaaatgaacctttcttaatttatggatcaccatagggtctatattctaaagaataatggccctaacattttcataattattgtgtttcattaatacctttatttctttcgtggtgggtcttatatgagtcaaattct

SEQ ID NO: 535 - DNA, 7499 bp, H. influenzae
agctgttgaagaaaccattcaataataaaaccaaaatgcggtattaattgagattctttccaccaatcagtttgttcaaaattggtaaaagtatccataaaaaataacaacgcagccacaatcaatgcaccgcgcactaaaccgaaagcagcacctaatacgcgatcagtgccgcttaaacccggcttaactactaattgactaatcacataatttactattgcgcccacgattaaagtcagaacaaacagaatggcgattgcagttccattacgcacatacattgattcaatttgcgtaagataagtggcaagataaggatagaactggcttgctacgataaatgccacaacccagctaccaagtgaaagtacttcgcgtacaaaaccacgtaataagctgacaagaatggaaaaagcgataatgccaataataatgtaatcgatcattaaaaaatctctcaatgaaaaacggccgtttaaaacgaccgaggtattctacaaaaatacagccaaaaagaaaacgtttgcgtaaactaaatttcctgccaaaaagcacgttcaaatttgctttgagctttccttaagacttccgctaaatgttgatatgtcggtttttcttgcacaaaaggcaagggttcattttgttgttttaagcgttcgcaaatatcgtaaaaccataccgcactttgattttctaatggcgaatttgcacgcttaccaagccaataaagcccttgaaaaggaataagcaaggcaaaaagtgcggtcaaaattgcgatagaaaatgccattaaatcattttttgcataaatctgttgccacagtattgcaaatacagcaacaaaaggcataaatttttgtgcaaaactcgtggctttcataatacggttttcagggaaaataatccctaacttcgcctcctgcggccaagtattaagataaatttgtccctgtttaaaaatggaaaaaaacgccataaaaaacacctcaaaaaattgaccgcacttatcatacgctattttaagtctatttttagtaaaaatagtttaatttttcaaaaaatacgataaagtttgtattttttccttaccgatgaatttattttattcatcaaaaggtgtatcctatacctaatttttcaaaccatcttaaatgatggatttctattaacctcaatcaaatatagggttcctatgtcaaaacttgttcttatccttaactgcggtagttcttcactaaaatttgcaattcttgatccagcaacaggggaagaaaaattatctggcttagccgaagcatttttcttaccagaagcacgtatcaaatggaaactcaatggagagaaaggtaacgcagatttaggcgcaggcgcagcgcatactgaagcgcttaattttattgcatctaacattctgactgatgaactaaaaaattctatcgcagcaattggtcaccgtatcgttcacggtggcgaaaaatacacccaatctgttatcgtaactgatgaagttgttaaaggtattgaagatgctgcacaatttgcgccacttcacaatccagctcacttaattggtattcgcgaagcatttaacgcattcccacacttaaaagataaaaacgtggtagtttttgatacagcattccaccaaactatgtctgaagaagcattcctttatgcccttccatactctttatataaagaacacggcgtacgtcgctatggtgcacacggcacaagtcactacttcatttctcgtgaagtcgctgaatatgtaggcaaacccgcagaccaagtcaatgctattatttgtcacttaggtaatggtggttctgtttctgttgtgcgtaacggtcaatgtatcgatacgtcaatgggtttaactccactagaaggtttggtaatgggtacgcgttgtggcgatattgaccctgcaatcgtattctatctatacaaaacactaggtatgtctatggaacaaatcgaagagactttagtgaaaaaatctggtcttttaggtttaactgaagtaaccagcgactgccgttatgctgaagataactacgataatgcatctaaaccagaagcaaaacgcgctttaaatgtttatagctatcgtttagcgaaatacattggtgcttatatggctgtgttgggcgatgatcacttagatgcgattgcattcactggtggtattggcgaaaactcagcgcacgttcgtgaattagcattgaatcacttaaaattatttggcattaaaattgataatgaacgaaatcttgccgcacgttttggtaaagatggcgtaatcacgactgatgattccgcatttaaagcgattgttcttccaactaacgaagaattggttatcgcacaagataccgcaagactttgtttctaattcaacaacaaactgccgaatttttcggcagtttttatttataacatatacatattaaggtttaactatgtctcgcacgattattcttatccctgtaagtacaggcgtgggtttaactagcattagtcttggattaatccactctctcgaacaaaaaggcacaaaagttgcttttatgaaacccgtttctcaaccaagcactggcgaagataaattggatcgcacaacctctattattcgcactagcactagccttgaaactgccgaaccctttatgttaagcgtggcagaatcattaattggtcaaaatcagtctgacgtattgttagaaaaaattgtagctaaccaccaacaattaaccaaaaacaacgatatcgttgtggtggaaggtttaattccaacaagaaaacacggttatgcaaataatatcaactatgaaattgcacaagcattagatgcagaaatcgtattagttgcagcaccagcaactgaaaccccaaccgaattaaaagatcgtgtagaagcagcagcctctttatttggtggtaaaaacaatccaaatcttttaggcgtagttgtaaacaaattcaatgcacctgttgatgaatctggtcgtacacgccccgatcttgctgaaatctttgattcattccaacacaatcatattagcgaaacagaagtaaacaaattatttgcaggtagtgccatcaagttattagcttgtgtgccttggaatgcaaatttaatcgctacacgagcaatcgacttagtcaaacatttaggtgcatcaatcattaatgaaggggaaatcaatcgccgtattcgtggtatcactttctgcgcaagaagtttaccaaatatggttgagcatttccgtgcaggcagtttattagtcgcttcagcagatcgtccagatgtgcttgtagcagccgctctcgcagcgtcaaatggtattgaaatcggcggtattttattaacaggcggttataaaattgatgctcaaattaataaactttgccaacctacttttgaaaaagcaaaattgccgatcttccgtacttgaaggcaatacttggcaaacggcattaagtttacaaagctttaatcttgaagtgcctgttgatgacaaagaacgtattgagaatattaaacaatacattagccaacactttaatgctgactttatcaataatttagttgcagattctagccgtttacctcgcttatccccacctgcattccgtttccaattaactgaacttgctcgtgcggcgaaaaaacgtattgtgcttcctgaaggcgatgaacctcgtacaatcaaagcagccgtactttgcgcagaacgtggcattgcggaatgtgtgcttttagcagatcctgcatccgttcaacgtgttgcagaagcacaaggtgttaaattaggtaaaggcattacaatcattaacccagcagatgttcgagaaaactatgttgatcgtttagttgaattacgtaaagcgaaaggcatgaccgaaaccgcagcacgtgaacaattagaagataccgtagtgcttggtactatgatgttagaagcaaatgaagtagatggtttagtatctggtgccgttcacacgactgcaaacaccattcgcccaccaatgcagatcatcaaaactgcaccaggtagttcaatcgtttcttctatcttctttatgttattaccagatcaagtacttgtttacggtgactgtgcggtaaacccagatccaactgcagaacaacttgcggaaatcgcaattcaatctgcggattctgcgaaagcatttggtattgatccaaaagtcgcaatgatctcttactcaacaggtacatctggtagcggtgctgatgtggaaaaagtgaaagaagcaacccgtattgcgaaagaaaaacgccctgatttattaatcgatggcccattacaatacgatgcagctgtgatggaagacgtggctcgctctaaagcaccaaattcaccagtagcaggtaaagcaacagtattcgtattccctgacttaaatacgggtaacaccacttacaaagcagtacaacgttctgcagatttagtgtctattggcccaatgcttcaaggtatgcgtaaaccagtcaatgacttgtctcgcggtgccttagttgatgatattgtatacacaattgccttaaccgcaattcaagcaacacaatagttcatacaaaattgtaaaagaaaataccgcactttgccctaggcagtaaaagtgcggtatttttttataacgtttttttacaaatcaaccaaaatcaaaattgcggcttcaccgccccattctcttggcgcttgatgcaatgcccgcactttaggatgttgtactagccaacgtggaatttgttttttcaatgtaaaggtgccatagcccgtcatgatactggcacaatcaatatgctcattttcacaagccagtaaaagtgcggctaattcttgcttagcttgttcacgggttaaaccgtgtaaatctaaaaacaattctggcgaaaaatctccacgacgaagttgttttaataaatgggaatcttccccatcacgtaaatatttcacaacaccatcatgctcattcagtaacggctcatattcatcagaaaaataaaataacgtatcttctttcgctcgtaattctttcaattctatttttttctgatcacgtttttggtgaggggcaacaaaagtatcttgtttcattggcttaatgcctttggtttccgcacggaataaatcaaattcgtcttgcatttttttctcattaatttcaaattttgcgtatcatatcatagttctacattctcatctgtggtataactacgccaaattttcataccgaattttatgctaacttttctactcacttttatggagaaatgcgatggaaacttcacataaccaagaattagttgcaactatcttggaagataatgttgcaaacgaactgcaaaccatccaagattttctgcgttggacgtatagcattctcaatcgttctgatatttacttcgggcaagggcacgataatccttgggatgaaagcctgcaactcgttttaagtggcttacatttacccattgatttacctaccgaattatttaacagtcgattaaccccatctgaaaaagaaaccttagttcaacttgtattaacccgaatcgaacaacgcatacctgtggcatatttaacgaatagcgcttggttctgcggtcacgaattttatgtcgatgaacgaaccattattccacgttctccaattagtgctttaattcaagatcgctttgaagatttaatttcacaagaaccaaatcatattctcgatctatgcacaggcagcggttgtattgccattgcttgtgcttatgctttcccgaatgcggaagtagatgcggtagatttatcggttgatgcacttaatgtcgcagagatcaatatttcacgccatcaattagagcatcgtgtattcccgattcaatcaaacttatttgaaaatattttgggacagaaatacgatcttatcgtgaccaatccaccttatgtggatgaagaagatctcgccgatatgccagaagaattccattttgaaccagagttagccttaggttctggcagtgatggcttaaacattaccaaacaaattttgaaacaagcaccagattacttaaccgaaaatggcgtgttggtgtgtgaagtgggtaatagtatgattagcttaattgagcaatatccagatgtaccatttgaatgggtagaacttaaaaatggcggactaggcgtatttgctattcagcgtaaagatttagtgaaatatcacgatctgttttaatctttcaagtgcggttaaaattcttattaaatttcaaccgcacttcatttatacattgttatcttgtttccaattcaatgccttcaaataattttttcactgaattgttatcacgcaaacgctcggctttttctacgacactacgaattaagtgcggtgaaaaatattccataaaatcgtacatataattacgtaagaacgtgctatgtttaaatgcaatattcgtcatactcgggcggaacaaatggcttgcatcaattagcacaagatccgcatctaatgccgtatgcgccatagatgccataatgcccacccctaaacccaagcgcacataagttttaataacatcagcatcggtagccgtaaaaactatatttggtaaaatgcctgcactattaaatgcgtaatctaaatcagaaacacccgtaaaaccaaacgtgtaagtcacaagtgggtatttgcctaattcctcaatggtcagttctttcactttggcaagcggatgttctggcgaaacaatcacggcacgattccaccaatagcatggaatctgaactaaatcatcaaataaataaggtgcttcagtggtaattgccaaatccacttcacctgacattaaagcatcgtgaatttgtgttggcgaaccttgatgaatatgcaagctcacatcaggatattttttagaaaaacgttcaatcacgcttggcagcatataacgtgcctgagtatttgtcgtcgcaatacgtaatacaccgtgatttggccgagtatattcatcggcaacggcacggataccttgcgctttaacaagtaactcgcgtgcaattgagataatctttttccctgctggtgtaattgattttatatgcttgccatgacgctcaaaaatttccagacctaattcatcttctaataggcgaacttgtttactgatacccggctgtgatgtgtaaagtgcatttgccgcttctgtgacattcaaattttggtttacaatctcaacgatataacgcaattgatgcattttcataaaaaaggccttattttttataacggttgttcatctccgaaaacggtttaccggcttacgaatttgcccagattttggacgaccaccaacctgggttacatcgtatttcggttccagtcccacagggtaatcccaccattcccagaaataaattggcgttttgcagaatacatttttttcccaccccccaagggcaatctcttcttag

SEQ ID NO: 536 - DNA, 7977 bp, H. influenzae
  misc_feature (4108)..(4108): n is a, c, g, or t
  misc_feature (7960)..(7960): n is a, c, g, or t
gccagacttgctgcctgcggtcgactctataggacccccaaacccttgtgcctgtgctgggtgtgccagtaaaaagttctatgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcacataaaaatatcttcagatctgaccgcacttttaaagtgcggttgtttttttcgtaaatttaacgagaaatattatgcaaaactccaccttatacccaacggtttatgtacttggcaacggacaactcggcagaatgttaggttacgctggtgcacctttagatatttatgttgaacccttagccttcaatgcgccagtttttgacttacctgaaaatgcgatcatcacggcagaaattgaacgctgggaaaaaacacctttgactgaattactcggcaatcataaaaacttcgttaatcaacatgtatttggattattagccgatcgttttgctcaaaaatccttgcttgatgaactcaatctttctacctcgccttggtgtttattaaaagataaaacgcaatggaatgatgttttccaaactgttggcgagaaagtcgtcgtcaaacgtagaacaggcggatatgatgggcgtggtcaatggattatcagcgatgaaaacaaagcggacatcactgatgacttatttggtgaagtgatcgcagaaaaatttattccttttgattatgaagtttctattgtaggcgcaagatttaaaaatggcgaaaagcgtttttatcccgttacgcataacctgcaacaaaatggtattttgcgttacagtgtgattgataatgcatttcctcaacaatccgcacaacaaaaacaagctgaaacaatgctcggcaaaattatggataagttaggctatgtgggtgtgatggcaatggaatgttttgttgtaggcgacaaattactaattaacgaacttgcgcctcgcgtacataacagtggacattggacacaactgggatgtgctattagtcaatttgaattacatttacgcacgctacttgatttgccaacacctgacttacaaatttttgccccaagtgtaatggtaaatttaatcggcacaaaccataatccaaaatggcttaatataccttttgcacaacttcattggtacggtaaagaagtgagggctgggcgtaaggttgggcatatcaatctttctcatcctaataaagcggtcattattcaacaattagaaaagctccgaattgaattacccgaagattatcaatcaggattaaattgggcgattgaaaaactaaaataatgtaaaaaatgaccgcactttttgataaatatttaaaaatattaaagtgcggttaatttttataaaaatctttcttgataaaataaaacggctgaagtataaaattatccatcacacaactgatacataaggaaaagctatgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaatagggttagaaataatatatcctctaaaatattgtaagtaaaaaataaagccttgattatcaaggctttaattttatttaatcattaacaaattctcggcaatggttcatttgttggtaaatctaataatttctgtggctaattcgttaataaatccatgatgatgggatgaaatcaacatgggtaaggaaagctcacgcaaaagtgcggtcaatttttcagtattttttcgatctaatccattggtgggttcatctaataataaaatttttggctgcatcgctaagacaccagcaagtgccgtgaaatttttctcaccaccagatagggtatgcaccatacgatcttttaaacctgtgataccaagacgttctaattgctgctctgcgatatgatacgcctgctctctgggcatattttggtttaatggcccgaaggcaacatcatccaacactgttgggccaaaaagttgatcatcggcattttgaaaacaaataccaatcgtgccacgaaagggcgcaaaatctttttcttcacgacaaactttgccaaataatttaatttcccctttggttacaggaacaaatcccaacaaagcaagcagtaaagtggtttttcctgaaccaatttccccttgtacgaagaggcgtttttgaccttccaaggtaaaactcaaatcttgaataatcgctctaccattgcgttctatacaaagattatttacagctaacatattatttttctctctttttgccaaactgaaaaccacgacattttaacgccatttgcgccgtttcggcttttaatagggcatggatcaataataaagcgacactttgagccgtcacataaagggttcggcgattaagcccaggacgaaatccacgagctcgcatggcaatatccattttttgacgcagttcgccaagcagtgcaatgtaacgtacggtcagcacaaaaagttgaattaatttttctggcaaaggcaatttaccaatggcttgaacaagtactgcatcattaatattccacaaaaaaagccaaagagaaatcaacaataaatgagtccgcaaactcaatttttctgctaattcaatgccttgaaaattgagttcaatgccattttctccaatttgccaacttaatgccgcccacattaaagcaataaaaatgactaaagcaaaccaacgtttaagataaggcaaaaaagatttttgactgagctgcagtgaaataaaaaagagagaaactgcaagcacattaagggagataagccaagtaagatcactcaatccactaatgattagcccccagataaacagantaatcaaccctaagtgcggttgaataagcgatgaattttcattaagagaaattctcggtacgattcatgacttcaggatacattttaccaagcaaggtaatcacccctacgctgataatactatccaaaacaaatactggaatatgagagactagcaagagccaaacaagattcagataacttttcccaccatctaacatcagcacaaaagaagcaagcacgcctgctccgccaacgccaattacgccagcaccaataccgactaataagcgatcttttaatgccatttgtggctgtaaacgagaacggaaaagataataagcgatcacagctggtattgccatcacgcaaagattgacacctaacacggcaaatccaccaaaagaaaagaaaatgacttgcaataaaagtgcgatgaggaatgctggaaaaacggcccacccaagaaataaaccagccatgccatttaaaattaaatgcacgctaccaattcctacaggcacatgaatggttcctgccacaaaaaatgcagcggcaaaaagtgcggtgagcggtaaacgttctgattctaaacgacgtacccccacagcaatgcccgcaacagcaagcactgcaccagctaataaaataggcgtatgtaacacgccttcagataaatgcattaaatacgtccttgtttaattttacgcgcattacgtaaagcaataagtccagcaataccaacgatataaccgattccacctaaaatatcatgcaaataaattttatcttttaaatgcgcaatatcttcacgaagcagcattaaatctgcactgctttgattttcggcagacgtatgagcagcagcaacaacggacgcacggtgtccttcatcgccttccaccacaacttttaaggttgtatgtggtacatcagcaatagaaagcttaaatgcaccttggcggtctgtttttccagttaaaacgggatcagaaacacctgagcggaaaacttctaaataagtttcagctgctggggtcatatcagaataataggatttgccagaaagtgtttgcccatcatattgggcaaacacataaagcgcgtgggcataagcattcgggagatagcaagccgcaaaaagtgcggttaaaaaagcaaattttttcatcccaaatccatattattgcgcatcaaaagttagcatatattccacagttcgacgatcgtaatctgcattatttgttactttttcctcaaactctgcccatactttgttgaagcctttagttggggtaaattgagcgatacctttttcattagttaaattgaacggtgcatcttcactcacacccactttaatgccttgaactggtttaccattatgtaaaacaaggatagaaagtggtttattcgcttgtgctttttcttgaggaatcaattcgtatgcttgttgatgagatttgaaagattcagcatcccatttcaaaatcgctttaccaaatttaacaggattagtactaaattctgctgttggttcttcacgttttgttttttcaacgtatttaccgcttggtaattttgaccatacaccattatcgaaatgaacgaaaaactaattctgatttaggcaaagattaggcttcgccatttctgaattggaatcaacagcagttaatttgccttgcgcatttaaggcttggagagatttaagtttagattctggtgaggtttcagtttgttcatgtccaaatttcactcggtattcatcttgcgatgaagcaggctcaagccaaacattatgtgcgttagcaacagacatacctaaaagtgcggttaatcctacagcgatttttttcaattccattttggatactccttgtttgtttaagaaaatctaggcgtatgataaaatatgaagtaactttagaatcaagtcattttttaaggaaattgatgaaaattggagcacttgctaaagccctaggctgtaccgtagaaaccatccgttattatgaacaacaaggtttaatcccgcccccaaaacgtactttaggcaattttcggcaatataatgaagaacacttgcaacgtttatcatttatttgtaactgccgaaatttagatatttcattaagtgaaataaaaagcctactgaatttagaaaatgcctccaaacaacaagcagaagaaattaatcgtgtgttagataaacacattaaagaggtggcaacaaggattcacgaactcgcccatttacggatgaaattaattgaattacgtgaaaaaacagtctcgaatgatgaagatccaatgaaattgctattgcaacatagtggcgtgaaatttgtgcgattaaaatagccgcacttttaagattatggctgactagataaacgctgttttgcttccttattgcctaattcagctgcttttttcagccattccaatgatttttcaggttggttttgtaagcgataaatattacttaacatcatcatcgcatccgtatctttagctcgagctgtacgttcaaaaagcttaatggcttgctctgtattttgtttgacgtaatcgccacgtagatacataacgccaaggttatttagccctttcacactacccttctctgccgcttcgctaaaccaccaataagccttttcatagtctctcaccgtgccacgcccaaggttatataacatacctagattgctttgagcagtggtgtttccctctaacgccatcggatacatgatatcgaaaacagagctccattgctgtttattggcaaactcttgcgccaaattcattcttgcttgatcatccattttcgaattcgctgtaatatcaatggttttcatcgcccaaacaggcaaactaaaacaaagtaatactatatgaaaaaataacttcagtttcatttacaaggttgctactaaaagtaaaataaaaaatacggcagtaatcgcaaattctgttagtccaacttgcataacagaaagctttttagtgggcagataaaccgctcgcactaatccaggcacaaaagctaatgctaaaataaattgttgcgaaaccacaaaaatcagcacacataataagtgaaaaatcactgatgcccaaaaataacgtggattttttcgttcacgcatcattgattttacataaagtgttgttccaataaaaaataatgttggataaatcgccacccaaagtattttttcatcaaaagtgcggtcagaaaagtaataggatcccattccagctagggcaaaaattaagatccctgccaagtcattccataaattgcgctcatcttttttcttggtgaaataaatattcaccgcaacaaacggtaacatggcaaacataaaatacaacacctgccaattataaattaacgcgggaatcgcaaaaatcacggcggcagcaaaataaatcacagaccattttttatataactcaagatttttacctttaaacaaattcaaaaaaggataagtcatcaaataaagcgaaaaccatcctaataataaaaacatgtgcgcccatactggattagcaagcaacataccataaataaaaggcagtagtgccataacaatagcaccgtgctgattagagataagcagtttcataataattaaataattgagaataattgtcggatattttagcctagtaaagaggattttacaaagcagtaaaggctatttagaatagaagaaaacaccccaaaggagaaccctatgacaattcaacgcattttacccaatgcacgtttaagtgaagtttcaattcataacaacctcgcctattttgcagggcaagttccagaattaaccatcgagcaaaatacctacgaacaacccnagaagtattaggtttac

SEQ ID NO: 537 - DNA, 7265 bp, H. influenzae
ctgttaacgaattcggactcggtaccctaaaaataaagctctggtggtggaattggtagacacgctatcttgagggggtagtgaccacaggtcgtgcgagttcaagtctcgcccagagcaccaaattaaaaatatacagcactaaaagcattacaaagccttgattctactgaaatcaaggcttttttattccctatactccactataaaatactatcgaaccttagaatcttagtaatagacttaataatatattcacgctaaggcaaaaaaatctattactaaaacagcatagagacttgtaaatactaggattaacgcctagtttgttatattactaagtagggctattttatggcatacttaacaaatccgctttctgacgcccaaattaaaaaagcaaaactgaaagaaaaagattgctcctacttttacaaacgattcacgaatacatccataactaaaaggactaagccctgtagattacagagcttagtccttgatttcatagtctaactttttcaatgaaaattattttttacattcaaagtgcggtattattccgcattgtttttcgatttaataatggcgtaaaccacacctgttgataaagcaccaatcgcaattgcaccaagatatttcaacggctcagatacaaatggaatgacaaataatccgccgtgcggagcttgtaaggtaatatttaatcccattgaaatcgcaccagccaccgcaccaccaatcacagagctaataatgactcgaattggatctgctgccacaaatggtaatgcaccttcagaaataaaacataaaccaagaacaaatgatgctttccccgcatcgcgttggctaacggtaaatttattgcgagcaatccaagtcgcaactgtcataccaattggaggaaccatacctgcggccattgccgcagccattggtgtataaacttgggaggcaatcaatccaacagaaaaagtgtacgctgctttatttactggtccgcccatatcgatacacatcattgcgccgataattacgcctaacacaatcgcattcacttcgcccattgaagtaagccaattacttagctctttcataatttcagccactggtggattgatgaggtaaatcatcgtcaaaccaacaatcatcgaacccaagagcggtaaaattaaaatcggttttaatgaagtcaggcttgctggcaatcgaataatcacatttagccctttcaccacatagccggctaagaaacctgcaataataccgccaagaatccctgcacccgcttcacttgccagcatccctgcaatcaaaccaactgcaagtcctggacgatcagcgatagaaaatgcaacgtaaccagcaaacacggcaatcattaacttgaacgccacaccactaccgatattaatcaacatattaggaagatcttgaaaaactcctgtattttcaattacattaaaactgaacataaaggaaatcgcgatcaacaatccaccagcaaccactaacggtaacatatgagaaacaccagtcattaagtgtttgtacacaccttttttctcacggctttcttctttcgttcccgcattatttccaccatcaaaaattttggcttctttaaatgccttatcaaattcttgctcagttttcttcaaggctaatcctgttgaagtgcggtatattggtttacctttaaatttatctaaaggcacgtcaatatctgctgcaacaaataccaaatcagccgccgcgacttcttctgcagtaatttcattgccagccccaacttgaccacgggtttcaacttttacattccaaccttgttttttcgcataggcttcaatcgcttcggctgacataaacgtatgtgcaacgccagttggacaagccgttaccgcaacaatattttttacaccagaaacacctgtaaaactcaccgcacttttcggtgcaacataatcagccccattcgctaaggcatttgccaatgttacttcaggagaaatcatggcgatagcttcgccgataataaagacttttttaccaactaacgcagggttatttggtaatacagaaccaaatacaagaacaagatctgcttcggctggtgtttctacaatagagacatttgctttttgtgcagctgctcgaaaaacttcatgtaataaataggctttcgcatcgcctacattagctgattgggttaaaaataacttcatactatccttcaatcatcgttatttgtactttttctaaaatggggtcaagtaaactcaaatcactcacaccgacgttactctgagataccgcaaaagcggacacagccgtagcaaaagctaaggtttctgttttcgataaacctttttcaaaaccatagattaagcctgctaccattgaatcccctgctccaacggtactcacgacattttcacattttgctggttcggctttaagcacgccttcattattaatccataaagaaccttttgcgcccattgaaataatcacgttttcaatgccttccgctttgagttgctgtgcagcggcaataatttcttcaagactatttaatgaatgaccaacccaagcctcaagttctcgatgattgggttttactagccaaggtttcgcttttaatccagcggtaagcgcagcattgctactatcaagcaccactttaacgccagcttgatgaagctgatttaaccaatcagcaaacaattcaggagacacacctcgaggtaaactgccacaaactgcgacaatgtcataatctaaacaataagccaaagaatccgtcacaaattgttgccaaatttgtgggcttatttgatatcccaagaaatttaaatctgtcacatccgcttcagtctcggtaatttttacattgatacgtgttttgccattaacacggtggaatttatctttcaaaccgtgctgattaaacatttgctcgaaatcagctgaattatccttgcccaagaaaccgcctactgcaacattaacgcctaaatcttttagtacttttgcgacattaatgccttttccagcagggaataagcccaatgtttctaccgtatttacttcgccaagttgaatacgatttaaacgcccaactaaatcataggcggcatttaaggtaatggttacgacgcttgccatactattcccctaaacccgattcgatcacagcgctgattccgtcaatagcttgttgcgcttcttcgcccgtcgcaacaaaacgtaaacgagtccctttgactacgcctaatgctacaattttcatcaaacttttagcactgactaattgagaattacgatcaaggttttgaactgctacggaagcattatatttcttcacttcatttaccaatattgcacttggacgagcatgcaaaccttgctcgtttttaatcacaaatacggcttcaatggcatttgccggcaaattatcatcttctgttaccgcaggtgtgtgaatttgatcgcccataatctcaatggtatcgggttcagacggtggcactaccgaaacattctcgcccaagccattggctatcgctttgcccaatgattcaattgcttgttttgcatcttccccctctgccacaaaacgtaaacgatgtccttgtgttacaccaagcgcaacaatcttcatcaaactttttgcgctgacgacttcactttcacgagtaagattttgcatggttattttagaagtgaattttttcacttcattaaccaaatttgcacttgggcgtgcatgtaagccgtgttcattacgaatcgtaaaggttcctacaacagcaccttctacagattgagtttcaacatcactcgatgaacccaaaagtgcggtcaaaatttctgttgaatttccattgagcaaggttgtttggacatcgtcatctaataaacgcgccaaagttggattaatttgatcaccgacggctgaaacggttatcacgccttttacggccttgccattgtggctaaaaatcgttttggcacgactaaatgctaaggcatttttcacatttcctacgacagagtccgttacccataaccctttgccaagtggtaatgccgcattatttatcacttcagaaataaagcgattttctaccgcactttgcacctgtaattgccccgcattaatcgcaactaaagttaataaactttgggtatttacatctaaactgatattggcagcaggaatttcaaatggatcaattgtctcgcccattaaaatcgcgcaaaattcagccacatcagttatttttgctaattttgctgcagtatcttcatcgctcaatacatgggttagttggcgtaataaggacaaatgctcatcagatcgcgccgcaataccaatcacgacataagcaatatttccttcgccccattctatgccttgaggaaattgaaacacttgcacgcccgttttctttaccatcaaacgagtatccaaggtgccatgaggaatagcgatgccattgcctaaaaaggttgaggtttgcagctcgcgcgctaacattccttgcaagtaaccattttcaacattgcctgcttgaaccaatgcggacgctgccatttcgatcgcttgttgtttatcaattgcattagcatttaaatgaatgttgctttccgaaagttctaacattcttgctccttaataatttaaaaagaaagctgcggatgaaacaaatcgaccagcagcttattgaaaaacaattatttagatgtacaggctttcagcagcgcttcactaccttgcacaatatattcatcattttctccgcgcgcttcgcctttttgtaaatcacgcatcgcatcataaataccttgagccatactttgcgaatccactttttcccaacaatttgcgctcaaacgtttaaggttcgcttgcaatgcttccgcatgtaacacgccgctataataggcatatacatcagaatcatggccgccagtgtaaagtttatcctgaatttgtttcactggaactaaaatacggcttaaataccagtcattcgcaccacttgcaaaattatctacaaagaaattttcattccacgcgacctttatatgtcgccacagtcgcttcataagcagctgcataagatttttgatcgattttatctttatctaaatcaatcacttttttatcgttccccataaatggaatatggttagtaaccgatgaccaagaagaacaacctgccaatattaacgtaaaaaataaaacagagatttttttaaacatagtcatacctgattaaagttaataaaacgccgccattatactgtctgaaggggattaagcaaggaagcctgtaaggcttatctaggcaaatgttaatttcgtataaaatcagtaaaatcagaccattgctcaatacgaaaagcgcgaatatctcgtaccgactgagaaatccacgccaactgttttagtgcattcattgcctgaaagagattcgccatatcttcattcatgttggtatataaacttccttgtgttctaacaaaaccaaattttgctaaaactgcgccaatgtctgtataagcctcttgaacgccctttggatgataatcttgagtgtcttttacaactaaatcaaaagcaatcgcgtacataattttccttattcagcttcgggatcttcaagtaggtaagataagcgataaatgtctttttctccagattgtaacaatgtgatatttaccaacacatcaccatctggcaaaaattccgcaacctcgccaaccacataaggcacgccaaattgcccgaattgcttaatacagcctgttggaatttgttgtcttagttccatatttaacctcaaattttttatggttttataacataattttgtagagaaatggataaaaatttaccgcacttctactcctgctcttttactaaagacaccaaaatctgatcgattttaaagttttccgtatcaatcacttcaaacttgtattttccgtaaaccacagaatcggtttttttcgggattttacgtaacatatacatcataaaaccactgatagtttcgtagttttcttcatcgggaaaataagcaatatctaatactcgagttacctcttttaatggcgttgcgccatcaatcagccacgagttttcatcacggctcacaatatattcttcttcgttagaaaccaattcccccataacaatactcatcacatcatttagcgtaacaatacccaccacaagagcatattcattcacaataatcgcaaaatcttcgccagtagatttaaacaattccaacacttcgtaaagagaaagcgtatcaggcacaaataaggctttacggagtagtttaggatctgtgagcaccacattttcattctgcaaatacatagttagcaaagtatgggattcgatataacctaagattttgtcgaggccattgtcacaaatcacaattttagaatgagaatcacgagaaagcgtatccatcacttcttggcgagaaaaagtgcggtctaaatatacgatgttttcacgggttgtcattgtggaagttaccgtacgggcttgcatatcgaaaatattttcgatcaaataatgctcttgagtttttaatacaccagcttctgcgcctgcttcaactacggcgaaaatatcttcagaggtcatgccatcttcacgcacagtagaaatgcgaaataagcggaaaaatacattagcaatagtatcaaaaacccacacaagcggtttaaacacatacatactaaaattcataatacccacaacgctcaacgccaccatttcaggataagtaatagcaatacgttttggaataagatcagcaaataaaataaacaaacaagtcactaatataaaagcgattgtagaggcggttggctcaatccaacttccttcaaaagaacgatttaaaatatctgcaatgtaaggacttagtgcactttcgccaattcccccacccaaaatcgccaccatattcaacaaaatttgaaccaccgtaataaaacgaccaggatgctcttgtaatttaagcacttgaagcgcacgcacgtcgcctttatttgcaagagattgcaattttaacttacgagaactcgccagagaaatttcagcagaagaaacaactgcactacttaaaattaaagccacaattgccaaaatagtatgaaataattccataatcattactcaaaaaataaaagaaaacgggtaccgaggttgatattcgtataac

SEQ ID NO: 538 - DNA, 6686 bp, H. influenzae
  misc_feature (6628)..(6628): n is a, c, g, or t
tgttatacgaatatcagcctcggtacccccgtccaaatctttggtaatacgaacgtcgtgattcgtggtcatgccagtgccataacttgaagtagtcataaattcaatttccacaggtaaatttatctgacgaacgatatccgccataaacataaaggaaccacgtaaaagccctacgacaacaaggctatcgatctgtttttcttgataaaattttgtaatttgagcacctaattcagcaatacgcgcatgaacatcattctctgagattaaaacatctacgtggtgttttttcattgtgtttccttatgaaatgataggggataaaatcgtttgctattttacaaaaaaaaggctgaagtttaaaccttcagcctttgtattcctgccctacattagcccacgagtttgttatatcccgcgacaccacgtttttaattagttgtagggtgggctaaagcccagcctataaactgaaaaacttcctttggcgaataaaaaatcaaaaaataaaaaagactgaagtttaaaccttcagcctttttgaaccctaacgaatttactttctactctacctgttggagcaacctgcaatcgcttaacagatgtgtgtatagtaacagatatttattcattgtcaataagaattattctcaatttcaaaaatattcttaatttcctgaaattttcattttatctaacaaaatagaacccgtttgaatgttagaacgatgctctatatcatcggctacagcaaccatatttttcagcatatcttgtagttgccctgcaatggtaatttcagccactggatactgaatttcaccattttccacccaaaaacctgatgcaccacgggaataatcgcctgtaacgatattgacaccttgtcccatcacatctgttactaacaatcccgttcccatttgatgtaaaagtgcggtcaatcctcccgttaaatttggcttaacaagccagttgtgaatgcctccagcatgccctgtacttggcataccaagttttttaccactgtagcttgtcactaaataagtttgtaatatcccgccttcaacaatttcacgatcttgcgtacgaacaccttcactatcaaaaggcgttgaagccaaacgacgtaataaatgtggtctctcactgatattgaaccaatctggtaagacctgtttgcctaaatgatcgagcaagaaactcgattttctatataaactgccaccacttattgcagcggcaaagtgagaaataagaccagttgcaacatcatttaagaaaatgacaggcacttctcgtgtactcaatttttgaggatttaaacgagaaacgactttctttgcacaattttctccgacccaaattggcgattggagtttgtcgaattcacgagaaattgtatattcgtaatcattttctaaggcagcttctacgccaccaataaccgaacaagataaagaataacggcttgataaataactttgcaacataccgtgactattaccatacactttcacgcctgtatgtgaattaaaacttgcgccattactatttataatacgttcatccgcctctaaagccgccttttcagcctgaagtgcaagttctgttgctttatcaacatccacatcagcagcatgataaagctctaaatcaggcgcatcaaaagccattagatctttatcagccaaccctgtgcaatcatcaggcgaggtgtattttgcaatagcaagtgcggcttccactgcatttttaattgcgctttcgcttaaatcggaagtcgaggcattgcctttttgttgccccatataaacagaaatccccaatgcaccatcattagtaaattctacgttttcaatttcttgcaaacgagcagatacagataaaccgctcactttagtgaccgcgacttctgcactcgcgccagctttcgttgctaacgccactgcaaaactgacggcttgacgtaattcttgttcttgtgcttttaaaagtgcggttgaattttcagctgttttcattattttttcctattaaaaattttcaacattttatcttattttcaaagtttatggtaaaatgtgcaccaatttttataaaggataaaaaatggcaaaacgtaagaaaaaagaagttttcgattgggaagatgaagatcaagaagaaattatttgggtgagtaaaagcgaaatcaaacgcgatgcggaagatttaaaacaacttggcgaaaagattgtcaatttaaccaaagctaatcttgccaaaatcccacttgatgaatccttacttgatgccattgaacttgcacagcgtttacaaaaagaagctcgtcgccgtcaattacagtatatcggcaaattatttcgaggaattgatgttgaacctattcgtgaagccttagataaaattgaaaataagcataatcaacaacaagctatgttgcacaaaatcgaaaaagtgtgcgatgaattggtggaaaaaggtgatgtggctttaactgatttactaaatgattatcctgatggcgatcgtcagcaactacgcaatctgattcgttctgcacaaaaagaactggaacaaaataaaccatcaaaagcctatcgagaaatttatcaaatgctcaaggtattaatgttggaagattaaaaacattgaaattttcatccgcactttgtggataagtgattgaaataaaatgaatattcgttggaatgtaattttgggcgttatcgcactttgtgctttggcgtggttttattccttaaatcaggaaaccgcagatttatctgaacttgtgaaaaaaccagatagtcctgattatgtgggttataaaatggaaacaacggttttttcccctgagggtaaaaaacaatatttggctttatccgataaaattgagcattatacagtcaatgaacaaaccctttttaccgcgcctttagtttatttatatcccacaacatcaaatgaaaaggaacaaaatcccaatcaaaatgtagatttttttagcacacaaaactggaaattaagcgcaaatcaagcaagattgacaaaagatcaaatattgtatttagagggtaatgtcgtcgtgcaaagtttaacatcagattctcgtttgcaacgcattgaaacagaatcagcggtcgtcaatttaaaaacacaggatatgacttccgaaacacaggttaaaattaaggggaaaaattttagttctacaggattaaaattagtcggaaatttacgccaacaagtggcgacattaaaggaacaggtaaaaacatattatgaagttagtaagcaataaaattctttttcttgcaacgatggtattagcatcaagttcagcttttgcattgaaagatgacgttaatcagccgataaatatcgtttcggataatcaatccttagatatggaaaaaagtgtagtgacattcacagataatgtagtaattacacagggatctatcatcattaaagcaaataaagttgttatcactcgtcccgctgaaaaatcagggaaaaaagaaactgtagaagcatttggtacgccagtcacattccatcaacagctagataatggcactccaatagatggaaaagcaaataaagttcattatgatcttggcaacgaatttttaacattaactaacaatgccgaattaaagcagcttgatagtaaaattaatggcagtgttattacctatgatgtgaagaaacaacaacttaaagctaatggtaatggaaaatcacgggtaacaacagttcttattccatctcaattacaacaagctaaagggaagtaatctatgtcaattttgactgcagagaatttagctaaaagctacaaaagtcgtaaagttgtttcggatgtcagtttaaccgtaaattctaatgaaattgtcggtttgctcgggccaaacggtgcaggtaaaacaaccacgttctatatggtcgttgggcttgttcgccaagatcaaggcaaaattgttattgatggcgaagacattagtttgctcccaatgcataatcgtgcgcaacgtggcattggttatttaccgcaagaagcctcgatttttcgccgtttgactgtctatgaaaatttgatggcggtattggaaattcgtaaagatttaaccccacaacaacgtcgcgaaaaagcagatgaattaattgaagaatttaacattagtcatattcgagataatttagggcaagccttatcaggcggcgaacgtcgccgtgtagaaatcgcacgtgccttagctgcaaatccaaaatttattctattagacgaaccttttgctggtgtagatcctatttctgtgagcgatattaaaaaaattatcaccgacttacgtaaccgaggattaggtgttttgattaccgatcataatgtccgtgaaacccttgatgtttgcgaacgcgcttatattgttggtgcaggtaaaattatcgcaacaggtacaccggcacaagtgatgaacgatgaacaggttaaacgagtttatcttggcgaacaattcaaattataaaaatgaaaataactgaactattaagctctgagaatattcgtcagggcgttagtttttctagcaaaaaacgattatttgagtctattgcgcattttgtagaagaacaaatccttgcagaacaaggcgaacaagcctgttttgaatgcctttttgaacgtgaaaaactggggaattctggtttaggaaatgggattgcaatgccaaaagcaaaaatccccgtaacagtatcagataaagcaatcgcagtgtttatgcaactcgataatccgattgattacgatgctgttgatagtaaaccagtggacttaatctttgccttactgattccagaaaatcaatgtgaaagctacattccagttttagcatcattaatagaaaaactgactgataaaaatgtgttgaaacaattacgatcagccaaaagtgcggatgaaatttggcaagtttttgaaattaccgatcaatcagaaacgacacttgaagaagtgaaagaataattacagtggggaaatttatggaaattatcattattagtgggcgttctggtgcaggaaaatctgtagccttacgagcattagaagatacaggatattactgtgttgataatattcctttagatttgcttcctcaattgactgatattctgtctcaatctcaatcttcggtcgccattagtctcgatattcgtaatattccaagctccgctaattctcttgagcaaaccctttcaacgttacaaaagcatcatcaaattaaaatcattttcttagaggctgatcgcgctaccctgattcgccgatatagcgattcacgccgtttgcacccgctttcattaaaagatctatctcttgaagctgcaatagatgaagaatatcgctatcttgagccattgattcaacacgcaaatcttattcttgataccacccatctttctacgcatattcttgcagaacgattacgcgaatttttacgcgataatagtgaaaaagaattaaaaattattgttgaatcttttggttttaaatatgggattcctttagatgcggattatgttttcgatgtccgctttttacctaacccccattgggatccaacattacgcccaatgactggattagaagcccctgtcgcagaatttctaaatagtcatacagaagtcaatgaatttatttatctcactcgtcattacattgatacttggttgccaatgttagaaaaaaataaccgtagctatttgacgattgccattggatgtactgggggaaaacatcgctccgtttatattgcccagcagttaggcgaatattttcaagccaaaggaaaaacggtacaaattcaacataaatctttagaacggaacaaaaaaatataaaaagtgcggtcataaaaacatcatttttattgaccgcactttttttacacgctcactggctttacaatctcactaggataacagcctaaaatctttaagtaattactataattttttagttcttccaaagcctgtttcgtatctggatgatggatatttgcttcaatttctagataaaacatttcttcccaaggcttaccgtaaatcggtcgagattccaattttgtcatatttatttgatgctttttaaacaccaataaagcatccactaacgcgccagcttgctgtgaagttgtcattaataataaggtctttgtgggaatctgtgatgaaacttcgcgaggatctttagccaccacaataaaacgtgtaatattgttctcttgattagcaatattagtttttaatacactaagtccatacaattttccaccatcttcattacccaatgctgcaatattaggtttattcaaacttgcgactaattgcattgcgtgtgaactgctttcgcaatattcaatatgcacacgatcaagactatgaataaattgactacattgttgaatcacttgaggatgactatacaacgtatcaatttgactcaaatctgttttatcattgacaagcacacagtgtttgattggataagccaactctccaactaatgataaatcagtaggctgaagtaaatcataaacttcattaatgcacccgatgntgtattttctaaagcatacaccaaatcagcttcccagtctgaatttttcaatacttgc

SEQ ID NO: 539 - DNA, 4285 bp, H. influenzae
  misc_feature (4280)..(4280): n is a, c, g, or t
cataatagactttaggatcgctcgctaaggcacgtgcaatggctacgcgttgttttgcccgccagaaagattgcttgggtaagcatcacgtttttcacttaaaccaacaagatctaaaagtgcggtaattttttcttggatttttgcttttgactcacttccaatttctaagggtaatgccacgttttcaaatacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagcgcagtcaattttttgttcggtagctcaaaaattttcgtaatattatttagcttaatcatataagccctttttatttattgtttttaaatctgttttggtattctagatgtctagattgctatgtcaatatgtcagattatcttttttagacagattagttatgacttatatttgctaattgcttggattaaatagataattttcgtcaatttgacatgtataaaaggcaagagaatgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagggggatnccata

SEQ ID NO: 540 - DNA, 9341 bp, H. influenzae
gccagattgctgcctgcggtcgactctaggagaccccttttataaaagtgcggtcaaaatacaataattttccaattattattattttttccaatagcttggaataaacagcacgattaatgaaaacatttctaaacgtccacagatcatagcaaaactaaagactaatttagcactttctggaacaccaataaaactttcgtgaataaaaccaagtcccggtcctgcattcgttaatgtggcgaatacggctcccatcgcatcaaaagtattcattccacaaagaataacagcaaaaacacacccccaataaaccagtataaaaataatgaaaaatgcccaaatactttctatcattcttggtgctagacgatttttacctattcgaattggttgtactaaatttggatggattaaactatgcagttctcgatcgatttgtttccacaatataagtgtccgtatcgcttttaatcccccagttgttgaaccaccacaaccaccaattaccgcagaaattaccagtaaaagcccaataaaaggcggaagattatcaatatcaaaaatcgtataaccagcagtcattgacattgatgttaattgtaatgcaccttttgttactgcctcgtttatatctgaaactaaaccataaccatataaagatagagatacaataccaataaaaataatttgcatcgttagaaaaaaacgaaattcgggatctttccaataatttcgccaaatatttcttttacctagtgcaagaaaagcggaaatatgtaaactaaaattaacaccaccaatcagcataaaaattgttgtaacccaataaatggaagcttgattaaaatagccaatacttgcatcgtgcgttgaaaatccgccatttgaaattgttgaaaaactatgcccaatggcatcaaaaagattcattcctgatagccaatatgcaatggcacaaagaacagttaatgaagcataaataatccatagcgctttcgccacttctgaaattttaggcaaagatttttgatctttaagaggcctgaagattctgctcgatataattgtgtcccaccaattcccaacagcggaattatcgccacagccaatacgataatccccataccacctaaccattgtaaaaactgacgataaaacaaaatagatttaggtaaattatccagccccgtcattaccgttgcaccagtagtagttaagccagaaaatgcttcaaatacggctgaagcaatagttaaatgtggtgaatcgaacaataaaagaggcaatgttgccaagcttcctaaaactaaccaaaaagccacaacaatcaaaaaaccatcacgggatcgtaattcttgtttatggtgatggcatggccaccaaagcaatgtgcccgctgtcaagctcaacataaaagcctgcataaatgccttgccgcccccatcaccataaatcagagcaacaaatgcaggaactagcatcgtacctgaaaaacacatcacaagaataccaataattcggataatcgataaaatacgcacaactattcgcctatctctaaaagttgaataaccaatctacctgaagacttttccgttaattctgaagaaaacgcctctattgttttttcactaatacctaaaatcaaatgaatatttgcctgaaaaccttgagataaaatctcaacctgatatttttcacaaagttgttgaaccaaccttaactgaccatagtcacaatcaagtttgaaaggggttcgttcaactttaatttcgctttcaatcagctttaacgcttgttgtacgccattgccgtaagcacgaactaatccgcccgttccaagcaaaatgccgccataatagcgaaccaccaccgcactgatttcacctaattgactaccttgcaatgcactcaacattggctttcctgccgttccagcaggttcgccatcatcagaaaaaccaagttgtagagaatctgttggcttgcctgctacggcagcccaacaatgatgccgagcatttggatgttcttgtttaatctttgcccaaaaagctcttgcgtcttctaaaccttcggtgtgctgtaaataagtaataaaacggcttttcttaatttcttcttcaaaaacaaccgcacttttaggaacgaggtattccgccatttcttttttcaaggtaatttcaatgacactagtctatcactgatgactgggatttgtcgaaattttgccgtaagtgcggtatgatatggctctgtttttcaaaagaaaaaagaatatgtctgaaatttccgtcacacaaaccctaaatactttaggattacgttgcccagaacctgtcatgcttgttcgtaaaaatattcgtcatcttaacgatggagaaatacttttgattattgctgacgatcctgcaacaacaagagatattccaagtttctgtcaatttatggatcacacattactgcaaagtgaagtggaaaagcccccgttcaaatattgggtgaaaagaggaaaataaaacatcgacctcattaaagtgcggtcgattttttataatttttaaagattacgtaaggcttcaatacgcttttcgagtggtggatggctcataaagagttcactgcgtttaccattaatcataaaggcatttaaagaaccttcgagattttgtggttcgtgaagttgttgcaaacgttgcagtgccataatcattttttctttgcctactaaacttgcggaaccagcatctgcacgaaattctcggtaacgagagaaccacattgcgataatactcgcaagcacaccaaagagcatttccaataccatagaaaccaagaaataaatacctgaactgcgcgtttcctctccattattgttacgcgaacttgctaccgccgttgcgataacgcgagataagaaaatcacgaaagtattcaatacgccttgcaataacgccatcgtcaccatatcgccattggaaatatgagaaatttcgtgcgctaaaacagcttcagcttcagcctccgtcatgttgtttaataatcccgtactcactgccactaaagaattgcttttcgttgcacctgtagcaaaagcattcacatcgggtgaatgataaatcgccacgtctggcatcggaattcccgctttctgtgcttggcgactaacagtatcaattaaccaacgttcagtttgattacgaggttgagtaatcacttctccatctacagaacgtaatgccatcgttttagacaggaataaggaaattaatgaaccagcaaaaccaaatagcaaagccataattaaaatgccgccagtgctatttcctgcaataccagtcacatttaaaataatccccaataccagcattacagccatattggttgccaagaaaagaagaattcgcatcataatgtgttctctcaaagttagggttaagtatttcctttgtggggaaaattcacaaaaaattcaaggtgtaatgtaaaatttttgttatcagcagataaacaaaaagtgcggtcaaaaacatgcgagtttatgaccgcacttttaagcagggattaccaaacagaaaattattttcttacagcaatcgcttcaatttctaatcccacatcttttggtaaacgcgcaacttctacgcaagaacgagcagggaagttaggatgattattttctttaaagaaacgttcgtattctgcattaaccgcagcaaaatcattaagatctttcacgaaaaccgttgtttttacaatatcggctgcggttaaacctgctttctcgataatcgctttcacgttttctaaagattggcgtgcttgtgcaacgatgtcagctggcacttcgcctgttgcaggattcactggaatttgccctgaggttaaaactagattgccaagatcaaccgcttgaacataagggccaatggctgctggtgctttttcagtatgaataatttgagtcatcattttctccttagttgataaaaaattgggtaatttttaccgcacttttctgtttattaatcaatttcttttagtatgtcatcgggaagtgattctttgctttcgactaatttcccatcgtttactttaaattgtaaattttggtaataagcttctcggaacgtgatatatggatcttgagcttgacgtaacaattctgcattattgagatttttcgcacgggcatccactgcttgcacaccatatttcactaatgcccacggaccaccaacccattgccagaatggatacatataagccgcatcaaccactgcacccgttaattggcgtggtgttgttgcattataaatcggtagcacaatataagtgccagcatctacgccgtagctacctaaagtttccccaaatccacgttgattatctatgcgtaattctttgcttgcgctcgcaaaatcaataaaaccacctagtccaaatacagtgttaatccaaaagcgattaaagtgaacaaatgcttttttcggttcaccttcaattaatcggtttatgaaactgactggctcatcaagattatttgcgatgccagcaagaccagaagaaatcggcttaggcacatagttattccaaccttttgcagcgggttctagcacatagcgatctataacattatagttaaatttccacattgttcgattgaagtcttcaagggaatcattacgctcacttgcttgtttcgtggcgttgtgatttgcacaacctgttagtgcaatggcactcaaaagtgcggtcaaaattacctttgttttcatttttgatccttacataaatatgggattattctacctaatttgtgaaataacaacaaattttgcgtataaaaacactcttttatgctgtttcaacaaacattaaaaacaaaaaaccgcactacaaaagtgcggttatattttaatcatttcttagtgtattttttcaacttgaccaaattcaagctcaactggtgtagcacggccaaagattgatacagacacttttaagcgacctttttcataatccacttcttctactgtaccattaaaatcagcaaatggcccttcagtcacacgaacttcctctcccggatgatattcattacgatgacgaggtttatcagtattttgttcaagacgatttaaaatagtatccgcttcacgtttggaaataggtgcaggtttatctggtgtaccaccgataaaacccatcactcttggcacactttttactaaatgccaagtttcatcattcatttccatttctacaagtacataacctggaaaaaatttacgttcacttttgcgacgtttacctgctacattttccaccacttcttcagttggcactaaaacttcaccaaattgatcttccatttgttgttgttttatgtattcacgtaaagttagagctacacgactttcaaagccagaaaacgcttgtaatacataccaacgtttttttgatactgttgtttcttcagtcattttagaatctcaaatcagttaagaaattaatcactgtcacaataatcgaatctactgcccaaaagaagagagaagcaatcattgttaccccgataacgatcaatgttgtttgacgcgcttcagcacgggttggccatacgactttacgcgcttctgtacgagagtcattaaagaacgcacgtgcttttgttccttgattagtaattgccgctaaaataaatgcaatgactaatgcaatagccataccaataacacgaatcggtaaagaatagatttgttggaaataaatattcccaattgccgcagcagcaaaaaagatcacaactaaaacccaaaggaatgtatttaaacctttagatttgccttcaacgatcacttcttgcgtatttttctttttatcaacattttcggttgccatagaattgaatccgttttaaatggaaatgtaaaaaataatgccataagacgtgcgattgtagcaatttcttttcgccttgcctattgaaaataagcatcaacatagaaaatctgggcgaaacaccgcacttttgcgattaaatctaatattctaattttggcgcaagattatctacaattgtcgattcatcaacgataactttttgtaaattctcaagagacggtagatcatacattgtatctaacaacactgcttctacgatagaacgtaagccacgcgcacccgtttttctttcaagtgcttttttcgccattgcttttaatgcttctggtgtgaaatccaattctactttttccaatccaaataaggcttgatattgtttaattaatgcgttttttggttttgtgagaatttgtatcagcgcatcttcgtctaattcacttaatggggcaatcattggcaagcgtccgataaattctggaattaaaccaaatttcatcaaatcatcaggttcaacttgacggaataattcagaaagagattgttgtttttcatctttttcaactttggcattaaaaccaatactcgtactggtttgagtgcgtttatcaataattttatctaatcctgcaaatgcaccgccgcaaataaagagaattttagacgtatccaattttaccatttcttgttgtggatgtttacgaccgccttgaggtggaatggaagctattgtaccttcaataagttttaataaagcctgttgcaccccctctcctgaaacatctcgagtaattgatgcgccttccgatttacggctaattttatcaatttcatcaatataaataatgcctttctctgctttttcagtatcgtattcacaattttgcaaaagtttctgtaatacattctctacatcttctcccacataaccagcttccgttaatgtggttgcatctgccatcgcaaagggtacatttaaacgacgagctaatgtttgcgcaagtaacgtttttccgctacctgtagggcctataagtaaaatattacttttaccaagctctacatcattgctttcatagttagttcgcaagcgtttataatgattataaactgccacagaaagcacttttttcgcataatcttgaccgataacataatcatctagatgagcgcgaatttcgtgaggtgttggtaatttttcttcattttctaccgcactttcctctaaatttttatcatgactttcttcaagcattgagtgacaaagttcaatacattcattacaaatataaccgtctgtgccagcaattaatctatctacttcgcctttttcctttccgcaaaaagagcagtgcaaatctttatctttgtctgtcattatatacccttaacgtttaaccaagacttcatccaccaaaccatacgcttgtgcttcttcagctgacataaaattatcacggtcagtatctttctcaatacgctcaataccttgtccagtatggaatgctaaacgatcatttaaggtgtgtttaattttcaaaatttcttgtgcgtgaatttgaatatctgatgcttgaccacggaaaccacccaaaggttgatggatcatcactcgcgcattgggtaacgcagctcgtttgccagcggttccgccagcaagtaagaatgcgcccattgaacaagcctgaccaatacaaagagtgcgaatatctggcttaataaattgcattgtgtcgtaaattgccatacctgcggtcacagaaccgcctggagagttaatataaatattaatatctttagttggatcttccgattctaaaaaaagaagctgtgccacaattaaatttgccatacgatcttccacttctccacttaggaaaatcacacgttcttttaataaacgggaataaatgtcgtacgaacgttcgccacgcgaagtctgttcaacgaccataggaattacactcattttcttacctttttcattaaaactgctaattattttatcgtaaataacccacaaataaaaatgcgatcgcttttattaaaaagagcgaccgcacttttattcaatcataataatattacttattatgcttgtggattcataatttcatcgaatgaagaaactttttctgttacttgtgcttttgcaagtactgcatcaacagcttgttcttccaatactacattgcgaatattattcattaactcttcgtttttgctgtaatattccacaacttctgctggctgctcgtaagctgatgcaatatctgcaatcattgctttagcgcgttcttcatcagcttttaattcattagatttaatcacttcagagaataataaacccacttgtacacgacgagttgcttcagcttcaaataattcacgcggtaactgtgcagtttgttgtgcattaccgccaaaacgttgagctgcttgattgcgtaatacattaatttcttcttctactgcagaagctggcacatcaatcggattttgttcaattaaaccattgattacttgttgtttaacacgagaaactaacgcatttttcaattcacgttccatatttttacggatttctgcacgcaaatcagcaacagacttagtattaggaccaaatttagcaacaaattcatctgttaattcaggcaacaccatattttcgatttttttcaaagtgatcgcaaattttgctgctttacctttcaagttttctgcgtggtattccgctgggaaagtcacatcaatatcaaattgctcacctgctttatgaccaacaattccttcttcaaaacctggaatcatacgaccttgacccataaataatacaaagtcagtagctttaccaccttcaaattcttcgccatctacagagccaacaaaatcaatagtgacacgatcatctgcttttacaacatcttgactttcagcccaagtagcttgttgtttacgtaacacatcgatcattttatcaatgtcagcttccgtgatttcaacagttggtttttcaactttgatattttctaaaccttgtaatttaacttctggataaacctcgaaagttgcagtgaaaactaagtctttaccttcttcaaaagtttcaatagcaaaagttggacgacctgcaatattaattttttctgcaataacagcatcaaaaaaatgacgtggtaataaatcgtttaatacatcttgacgaattgacgcaccaaaacgttgttcaatgatatgggcaggaacatgacctttacggaaaccatctacgcgcacattttttgcagcacgtttaattcttcacgaacggctttagagacaatttcagttggaacgggaatcgctacgcggcgttctaaaccttgagttgtttcataattaatgacatttggtacctcaattaatttgcactcgggcaaaatcaaccgaccatt

SEQ ID NO: 541 - DNA, 6363 bp, H. influenzae
gaaattcggctcggtacccctttaagtgcggttttatttttcattctttctagctaaaaattacgctaattttttgatttgtgcagctaatttagatttgtggtttgctgctttattagcgtggattaagcctttagaagccatacggtctacaactttttgcatttcaacgaatgctgattcagctgctgatttttcgcctgctgccacttgagcatatacttttttgatataagtacgcatcatagagcgttggcttgcgttgtgttggcgacgtttttcagattgaaccgcgcgtttttttgctgacttgatattagccaaggtcaaactcctaaaatttctgttgattgatagacaaaataaagggcgtcaatatgccgattttttatacttttgtcaatggaaaatttgtgttgatttcggtgagacacaaccgaaagtaagtatcgttatttttacaagctctttcaatatgggctcacacaaacgatgtgtggcggattttatcagttttttttcacggaatatagcgtaaaaacaaaatttctatacaattaggcaaaaattttagggtagagaagaatattttgagtaaacgacttttaaaatctagcattgttgttagttctatgacgttattatcaagagtgttaggtcttgtacgcgatgtagttatcgctcatctcattggggctggcgctgcggcggatgtttttttatttgctaatcgtatcccaaattttcttcgtcgtttatttgctgagggggctttttcacaggcttttgtccctgttctcgcagaatatcaaaaatctggcgatatgaataaaacccgtgaatttattggaaaagtttctggtacccttgggggattggtgagtattgttacgatccttgcgatggttggatcgcctgtcgttgccgctttatttgggatgggctggtttaccgattggatgaatgatggccctgatgcacataaatttgaacaagcctctcttcttcttaaaataacttttccttatttatggtttgttacttttgtcgcgctttttggagctgtacttaacacgattggaaaattcggcgtgatgtccttttcacccgtgttattaaatatagcgatgattgccaccgcacttttccttgcaccacaaatggataacccagatcttgcactggctatcgggatttttcttggcggattattacagttcttattccaaattccatttatgaaacaagcaggtttactggtgaaaccaaaatgggcttggcgggatgaaggcgtaaccaaaattcgtaaattaatgatccctgcgttatttggtgtatcggtaagtcaaattaatcttttgctggatacagtgattgcgagcttcttaatgacgggctctattagctggctgtattattccgaccgcttactggaatttcctctcggtttatttggcattgcgatttctaccgtaattttaccaacgcttgctcgccaccacgttaatcgtgaaggcgattcagctaaaagtgcggttgattttcgtaatacaatggattggggcgtgcgaatgattttcttacttggcgttcctgctgccattggtattgctgtattggctcaaccgatgttacttacgctctttatgcgtggaaatttcatgctaaatgatgtttatgccgcctcttattctttatgggcgtttaatgcgggtttgcttagctttatgttgattaaaatcctcgccaatggctattacgctcgccaagataccaaaaccccagtaaaaattggcattattgccatggtgagtaatatgggctttaatctattggcgattcctttcagctatgttggtttagctattgcttcagcaatgtccgcaactcttaacgcctatttgctctatcgcggcttagccaaagcggatgtgtaccatttttcacgtaaaagtgcggtcttttttgtcaaagttttattggctgcaatcgcaatgggtgcggcagtttggtattacgtgcctgaaatcaaccaatgggcaaaaatggatttctttatgcgtgtttattggcttgtttggttgattgtcttagccgcaatagtttatggcacaacgttgattttattaggcgttcgcaagcaccatttgctgacaaaaaactaacttctcgctataatgccgaaattctcttcttttcatggataaggacatgcaattaattcgtgggcttcataatgcaaatcgtgttttacaaggttgtgcgctaacgatcggcaactttgatggtgtgcatttagggcatcaaaccgtcctccgccatttgcgccaaaaagctgacgaattaaatttacccatggcggtattgttatttgaatcacagccgcgtgaatattttatgggggaaaatgcacctgcacgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagcattggcgatgatttcaaattcggctcaaaacgccaaggcaattttgccatgttgcaagcagctagtaagcgttttggttttattgttgaagataaccgtagtttttgtctagatgcacagcgaattagtagcactgcgattcgcgaagcgttagcgaatgatgatttacaacttgcagaaaatttactcggtaaaccttatcgtattttcgggcgtgtgattcatgggaataaattaggtagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagtccatttatttgatttttctcagaatatttatggccaaatggtggaagtggaattctgccacaagattagaaacgagattaaattcccctcttttgatgatttgaaagtgcaaattgagaaagacgtagaaactgcgaaagcgttttttaacagttaattttaaaatgtaaaaattggaaaataaaatgacagtcgattacaaaaacactcttaacctaccggaaaccagctttccaatgcgcggtgatttagctaagcgcgaacctgatatgttgaaaaattggtacgagaaaaatctttaccaaaaaattcgtaaagcgagtaagggcaaaaaatcttttattctgcacgatggccctccgtatgcgaatggtaacattcatattggtcacgctgtaaacaagattctgaaagatattattattaaatccaaaacggcgttaggttttgattcgccttatatcccgggttgggactgccacggcttgccaattgaattaaaagtagaaggtttagtgggcaaaccaaacgagaaaatttctgcggctgaatttcgtcaaaaatgtcgtgaatatgcctcggaacaagtagaaggtcagaaaaaagactttatccgtttaggtgtgttgggcgattgggataatccatatctcacgatgaatttcgataccgaagcgaatattatccgcactttaggtaaagtgattgaaaatggtcatttgtataaaggctcaaaaccagttcactggtgtttggattgcggttcttctttagcagaagcagaagtggaatatgaagacaaagtttctccgtcaatttacgttcgtttccctgcggaaagtgcggttgaaattgaagctaaattttctgcacaaggtagaggacaaggtaaattatcagccatcatttggactaccacaccttggacgatgccgtctaaccgtgcgattgcggtgaatgcagacttagaatacaacttagtccaacttggcgatgagcgcgtgattttagctgctgaattagttgagtcagtggcaaaagcggtgggcgtagaacaagttgaaattctgggttctgtaaaaggtgctgatcttgaattaagccgtttccatcatccattctatgattttactgtaccagtaattttaggcgatcacgtaaccactgatggcggcacgggtttagtacataccgcacctgatcacggtttagacgactttatcgtgggtaaacaatatgatttaccaatggcgggtcttgtatcgaatgatggtaaatttatttcaacgaccgaattctttgcaggcaaaggcgtatttgaagcaaatccgcttgtgatagaaaaattacaagaagtaggtaacttattaaaagttgagaaaatcaaacacagctatccacactgctggcgtcacaaaacgccaattattttccgtgcaacaccgcaatggtttatcggcatggaaacgcaaggtttacgccaacaagcattaggcgaaatcaaacaagttcgctggattccagattggggtcaagcacgtatcgagaaaatggttgaaaaccgccccagactggtgtatttcacgccaacgtacttggggtgtgccgatgaccttgttcgtgcataaagaaaccgaagaacttcatccgcgtaccttagagctacttgaagaagtggcgaaacgtgtagaaagagcgggtattcaagcgtggtgggatttagacgaaaaagaattattaggggcggatgcagaaacctatcgcaaagtgccagatacccttgacgtatggtttgactcaggatcaacctattcttctgttgttgcaaatcgcctagaatttaatggtcaagatattgatatgtatttagaaggttccgaccaacaccgtggctggtttatgtcttctttaatgctttctactgcaacaaacagcaaagcaccatacaagcaagtattaactcacggtttcactgtggatggtcaaggccgtaagatgtcaaaatctatcggtaacatagtgacgccacaagaagtcatggataaattcggtggtgatattttacgtttatgggttgcttcaacagactatacaggcgaaatgaccgtttctgatgagatcttaaaacgtgcagcggacagctatcgtcgtattcgtaacaccgctcgtttcttattagcaaacttgaatggttttgatccaaaacgtgatttagtcaaaccagaagaaatgattagcctagatcgttgggcggtagcttgtgcattagatgcacaaaatgaaattaaagatgcatacgataactatcaattccacactgtggtacaacgtttaatgcgtttctgttcggtagaaatggggtcattctatttagatattatcaaagatcgtcaatatacaaccaaagcagacagccttgcgcgtcgtagctgtcaaactgcgttatggcatattgctgaagcattagttcgttggatggcaccgatcttatctttcactgccgatgaaatttggcaacacttgccacaaactgaaagtgctcgtgcggaattcgtatttactgaagaattctatcaaggcttatttggtttaggcgaggatgaaaaattagatgatgcttactggcaacaactgattaaagttcgttcagaagtaaaccgtgtattagaaatttctcgtaacaataaagaaataggcggcggtttagaagcagaagtgaccgtttatgctaatgacgaatatcgtgcattgttagcacaattaggtaatgaattacgtttcgtattaattacctcaaaagtagatgtaaaatctttatcggaaaaacctgctgatttagcggacagcgaattagagggtattgcggtaagcgtaacacgttctaacgcagaaaaatgccctcgttgctggcattattctgacgaaattggggtaagcccaggacatccaacactttgtgcacgttgtgtagaaaatgtagtgggcaatggagaagttcgatactttgcataattaaattcattgtaaaacaaaaagtgcgattgatttgctctgtccttaaaagttagactaaataagcaacaattatggacaggttaattcgccgcactttttatagggagcaaacaatggcagaagaaacaatttttagtaaaattatccgtaaagaaattccggcaaatatcgtctatcaagatgaattagtcactgcatttcgtgatatttcccctcaagctaaaacacatattttgattattccaaataaagtcattcccacagtgaatgatgtgacggagcaagatgaagtagcgctaggtcgattatttagcgtagcggctaaactcgctaaagaagaaggcattgcggaagaggttggggtctc

SEQ ID NO: 542 - DNA, 9280 bp, H. influenzae
  misc_feature (835)..(835): n is a, c, g, or t
aggcaacttataccactaaagtgggaatgaagccaaatcttatattaaagaaggtttagcaagttattatcatcttaaatttgatgggcgaaaaacagcaagtggcgatgtttataactcaaaacaatttactgcagcacataaaacattgccaataaattcttatgctttagtgacaaatttacataacaatcgtaaagttatcgtacgtattaatgatcgtgggccttttagtgataaacgtttaattgatctttcacacgctgcggcaaaagaaattggcttaatttcccgcggcatagggcaggtaagaattgaggcgttgcacgttgctaaaaatgggaatttatcaggtgcagccacaaaaacactggctaaacaagcaaaaactcaggaagctgccgatcgtttagtattaaaatctaacacgctttttgataacgcatctaagtcaataaatgctctaaaaggaaccgaattttactgtttgaaaatgcttgaattaacctctcatagccaagcaaataaattaattacgcagcttgcgttagcgaatattcagactgaagtaaatcgctcaggaaataaatatgaaatttatattgggccttttgatgacaaaacaaaaatggcacaagtgagaactaaattacaaaaaatggcaaataataagccattaattgtttatacgtataaaaattaattgtaggaacacactatgttgaaaagaacaacaaaaatcgcatttttatcaagttttgtggcacttagtgctttttcggtatctgcagaggatatgcagtttggcgtaactccaccacaaattacggctcanacgtatgtattgatggattataattcaggtgcaattttgaccgcacttaatccagatcaacgtcaatatccagcatcactgactaaaatgatgacaagttatgtagttggtgtcgcattaaaacaaggcaaaatccataataccgatatggttaccattggtgaaagtgcgtgggggcgtaatttccctgattcatcaaaaatgtttttagatttaaatacacaagtatctgtagcagatttaaatcgaggtgtgattgttgtttctggtaatgatgcgactgttgcattagctgaacatatttctggcaatgtaccgaactttgtagaaacaatgaataaatatgttcaacaatttggtttgaaaaatacaaatttcaccacgccccatggtttagacgatccaaatcaatattcttccgcgcgtgatatggcaattattggtgcgcatattattcgtgatttacctgaagaatataaaatttactccgaaaaagactttacatttaataaaatcaaacaagctaaccgtaatggactattatgggataaaactatcaatgttgatggaatgaagacagggcatactagccaagcaggatataacttagtcgcttcagcgactacatcaaacaatatgcgtttaatttctgtagtaatgggtgtgccaacttacaaaggtcgtgaagtagaaagtaagaaacttttacaatggggttttgctaatttcgaaacatttaaaactttagaggctggtaaagaaatttcagaacaaagggtttattatggcgataaaaattcagtaaaacttggtgctttaatggatcactttattacgatacctaaaggtaaacaaagtgaggttaaagctcgttatgaattagcagataaaaatttacaagcaccattagcaaaaggtcaagtgattggtaaagtggtttatcaactggatggtaaggatattgcaagtgccaatttacaagtgatgaatgatgtgggagaagcgggtatttttggtaaactatgggattggttagtattgactgtgaaagggttattctcataaaaacaagttgaaaattgaccgcactttttgatttattttatttttaggaaagaaaatgacaatagaaaacgattatgcaaaactcaaggaattaatggaatttccagcaaaaatgacttttaaagttgcgggaattaatcgagaagggttagcacaagatcttatacaagtggtgcaaaaatatattaaaggcgattatattccaaaagaaaagcgcagtagtaaaggcacttataattcagtttcaattgatattattgctgaaaactttgatcaggtagaaacactctataaagaactggctaaagttgaaggcgtgaaaatggttatttagtatgaacaattcccttatcgttcgtcagttaggattgcaagattatcaagaaatttggcacaaaatgcaggattttactgatactcgaaatgctgaaacgcaagacgaaatttggttagtacaacattatcctgtttttacccaagggcaagcaggtaaaccagagcatcttttacaacgtagtgaaatccctgtggtgcaatcggatcgtggtgggcaaattacctatcacgcacccggtcagcaagtgatgtatgtgcttattgacattaaacgccataaaaacttaaatgtgcgtcaattagttaccgcacttgaacaaacggtggttaaaactttggctgaatatggcattgaaagctatccaaagcctgatgcgccaggtgtttatgtggatggaaaaaagatttgttctcttggattacgtattcgtcgtggttgctcttttcacgggttggcattgaatattaatatggatcttaatcctttccattatattaatccttgtgggtatgcagggcttgaaatgtgtcagttagcggattttgttaatcaagatgaagctgattgcgataatgtttcagcaaaattaattaaacacttcgccgatcttttaggctataatataacaactttataacattttataaaaactaaatgcccaatttgggcatttttatttaggaaaatactatgtctacgcctttcaaaatggaacgcggtgtaaaatatcgcgatgcggcaaaaacctcaattattcccgtaaaaaatatcgatcctaatcaagagttattaaaaaaaccagaatggatgaaaattaaacttccagcaagttcagctaaaattgaaagcattaaaaatggaatgcgccgtcacggattacattctgtttgtgaggaagcgtcttgtccaaatttacacgaatgttttaatcatggcacagccacttttatgattttaggtgcaatttgtacgcgccgttgcccattctgtgatgtggctcacggtaaaccattaccgcctgatcctgaagagccacaaaaattggcagaaacgattcaagatatgaaacttaaatatgtggtaatcacatcggtggatcgtgatgacttgcctgatcgtggtgctggtcatttttctgaatgtgtaaaagctgtgcgcgagcttaatcctaacattaagattgaaattttagtgcctgattttcgtggtcgcattacacaggctttagagaaattaaaagataatccgccagatgtctttaaccataatttagaaaacgtaccgcgcttatataaagaaattcgtccaggtgcggattacgaatggtcacttaaattattgcgtgaattcaaagaaatattcccaaatatcccaaccaaatctggtttaatggttgggttaggcgaaaccaacgaggaaattttgcaagtgatgcaagatttacgtgataacggtgtgactatgctcacgttgggtcaatatcttcaacctagccgccatcatttgcctgttgcccgttatgtgccgccaactgaatttgatgaattccgtgataaagccaatgaaatgggctttgaacatgcggcttgtgggccatttgttcgttcttcttatcacgctgatttacaagccagtggcggattagtgaaataatttaaaattctgctaaattaaaccgcactttttgcttgcaacaaaagtgcggtttatttttacaactcagaataaccgccaatattgcctataaattattcaatgtataatgcagtgttaagataatattagattataaagttgggaaaaatatgagcttatcttgtatcgtaatttgctcatcgcttataatagctctatactactaacttggtagtgatgttatgttttcttcttttttggagagtcgatgcaatttgagcgaatttctactgaacaaaaaaaactttccctcattcagacatttttacatcaaaatgcgcttaaattagatgaacaaatcgagtattttgttgttggctataatgataacgaacaaatcgttgtctgtggcggtttagcaggcaatatcataaaatgtgttgcgattgatgagtctttgcgtggtagcggtgttgccttgcaattaattactgaattggttgatttagcttacacgctaaaacgcccacacctttttatttatacaaaacccgaatatgcaacgttgttcaaatcttgtggtttttatatcatctctgatgccaatccttatgtagtattgttagaaaatagtgctacgcgtttacaaaaacaatgctcattatgggagaaaatgcgtgtggatggtaatcgaattggctcgattgtaatgaacgcgaatccatttaccttaggtcatcgttatttaattgagcaagcattacaacaatgtgatcatctgcatttatttattgtcggtgaagacgcatcgcaattttcttacactgaacgatttgaaatgattcaacaaggtattttcgatttatccaatatcactcttcattctggctctgactatattatttctcgtgcaacatttccaaattatttcctaaaagatcaattaattacagatgaaagttattttgagattgatctgaagttattccgtttacatattgctcaagctttgggaataacacatcgctttgttggtactgagctaaattgtcccatcactgccgaatataatcgccaaatgcattattggttaatggatgccgaaatgaatgcaccaaaaataaatgttatcgagatacctagaaaaacagcaagcaaccacattatttctgcttctacagtacgaaagcatttggctgaaaaaaattgggctcaactcgcagagtttgtgcctatgactacgttaaattatttacaaaagtgcggtcgtttttaaatacatttttattcatcaatatacggaaggaaaatctatgaaaataacaaaagtagccgttgcagggacactggaatccagtgatgttcaagtacgggttcaaccttttgattcactcgatattgaaatcaatagctcagtagcaaaacaatttggtgaacaaattgaagcgacagttcgtgaagtattagcaaaactaggcattacagcagcacaagtcattgtagaagacaaaggggcgttagattgcgtgttacaagctcgagtaaaagctgctgcaatgcgtgcaactgatgaaacgattaactgggaggctgtgctatgaaattaagaagaagtatgttatttgtgccgggctcaaatgccgccatgttgagtaatagctttatttataaaccagattccattatgtttgacttagaagatgcggttgcgctcaaagaaaaagattctgctcgtttattagtcgctcatgcacttcaacatccgctttataaagaaattgagaccgtagttcgtgttaatccgctagattctgaatttggtttattggatttgaattcggtagtgcgtgcgggtgtggatgtggtacgtatgccaaaaactgaaagcgcgcaagatgtgttggatatggatcacgccattactgagattgagaaagcctgcggtcgagaagcaggttcgactaaaatgctagcagccatcgaatcgccattaggtatcactcaagccaaccaaatcgctttcgcttctaaacgtttaattggtatcgcattgggtgcagaggattacgtacgtaacttaaaaaccgagcgttcaccagaggggattgaactgctttttgctcgttgttctattttacaagcggcacgtgcggctggcattcaggcttttgataccgtatattctaacgcgaacaatgaagaaggcttcttaaaagaggctgcgttaattaaacagcttggttttgacggtaaatccttaatcaacccacgccaaattgaattgttacacaacttatttgcaccgacacaaaaagacgtggagcaggcaaaacgcattattgaagcggcagcagaagctgaacgacaaggggctggtgttgtttcgttaaacggtaaaatgattgacgcaccgattattgatcgcgcaaaacttgtattagaacgtgcgaaatcaggtattcgtgaagagtaaagggagataaaaagatgacaacaagagaacaacgtattgaaaaatatcacgctgatcgctcagtctatcaggcggtgcctaaatctgaatccctttctcgtacagcgaaagatcgcaaactttgtacctctctagaagaagcgattaaacgctctggcttaaaagatggtatgactgtttcatttcatcatgcttttcggggcggagattttgtggtgaatatggtgatgaataaaattgccgaaatgggtttcaaaaatctgacccttgcatcttcatctttaattgatagccacttcccgattgtcgaatatatcaaaaatggcgtggtcaccaaaatctattcttctggtttacgcggtgaacttgcagagcaaatctctcgtggtttattgaatgaacctgtaaatattcattctcatggtggacgtgttcacttagtaaaatctggcgaattaaaaattgacgttgcttttttaggcgtgccttgctgtgacacattcggtaatgccaatggatttactggaaaaagtaaatgcggctctctaggctatgcgcgtgtcgatgctgaatatgctgaccaagttgtgttgctcacagaggaatttgttgaatacccgcactacccaatcagcatagctcaagatcaagtagatttaatcgtgcaagttgaagcagtcggtgacccgaaaaaaattggtggtggtgcaacccgaatgactaccaatccacgcgaattactcattgcgcgtaaatgtgcagaagtaatttttgccagtggttattttaaagatggcttctcattacaaactggttctgggggggcagcattagctgttacacgctttctagaagaaaaaatgcgtcgtgaaaatatcactgcagatttcgcacttggcggaattactgcaagtatggtggcattacatgagactggtcttattaaaaaattattagatgtacaaagctttgattctgttgcagctgaatcacttgcccgtaacccaaatcatattgaagtctccgctaaccaatatgcgaattacagttccaaaggcgcatctgttgaacgtttagatatggtgattctttctgctttagaaatcgacactaaatttaacgtgaatgtattgactggctctgacggtgtgattcgcggtgcatctggtggtcattgtgataccgcagcttctgcacaagtagcaatcattgtggcaccattagttcgtggtcgtattccaaccgtggtggaaaacgtgattacctgtgtaacacctggtgaaaacgtcgatattctcgttaccgatcatggtgtagcagtaaatcctaaacgtccagatttgattgaagctttaagcaaaacagacattccattgtttactattgaacaactttgtgaacgtgcttacagcattactggtaaaccaaaagaaattgagtttactaataaacctgtggctgttgttcgttatcgtgatggttcggtgattgatacggtgtatcaagttaaagactagaatcagcattacaagcgatctactttcaatagccaaaattaactcttgtcttcccatgattatcaggaaagaaacccaaagagttgaaagggactcaattagctctttcagctttcgccaacaccctataaatggaaagcgttaagaaaatttatttttatacaaaagagcggtcaaattttgcagcatttttttacgacattctctacaaagggttcagaaatttcacttgaagcattacttaatgctcgagaggaacgtgcaattttacaacaacagcttataacacaatatggacaaaccttactttgcatcactttaactgctgtgggtggagtaaaaaaaaatgctttgttggattatgtttttagaaaagctctagaaaatctgaccgcactttttactcagttaaacattacagcagtaaaagaaataatccgtccgttagaaacggggcatgaagcctattttgtattaccgatagatgctcgtacgctaaaagtgctgatgattgaattggaagaaagcattcctcttgctcgtttgtgggatttagatgtgtttaatgctaaaggcaatctactgagtcgtacagattttgatctttctccaagaacttgtttagtgtgcggagaaaatgcaaaaatctgtgcgagaacccgcaagcacgagattgatgagattgtagataaaattcaatctctcgcacagaagcatgatttcgcagaacatattggtgaacaagtttatctggcattaatacaagaggctcgcttatcgccaaaacctggtttagtggatgccatcaataacggttcgcacaaagatatgaacctacatacttttgagcaaagtgcgattagtttaaaacctttttttacgcagtttgttctcaaaggcatgatgaccgcgcatttgtctgaaaatcaaattctcgctgaaattcgtcctttaggtttattagcagaaaaagcaatgtttaaagttactgatggcgtaaacacccacaaaggtgctattttttcttttggtttagtgtgtacggcaattggacgattattggcacaaaaaagtttggttcaaagtgcggtagattttgatgttaaattaatctgctcacttgttgcacaatttactcaaggtttaacggatgaactgaaaaattatcctgaacacttgcctagtacggctggagtgcgtttattccaaaaatatggcttaacaggtgtccgtggcgaagcagaaaatggttttaatctcattcaaacgttgttgccacaatttgatgagtaccatcagttagaatgggaacatcgtttactgattttgttgttgaatttaatggcaattaactccgacactaacgtggttctcgagtggttagcgggatactttctagggacgagccgaatcgaaca

SEQ ID NO: 543 - DNA, 6980 bp, H. influenzae
  misc_feature (6969)..(6969): n is a, c, g, or t
ccagcggtaatatttaaaaaacccgtaccaagcgtaatatttttatgaacgtcaacccatccgccggagttaatggttaaatttccgccttcagaagtaatatctccatcaatctgaacgcctccgtccccctgaccttcactatggagaattaagtgggatctacttccgatactgattgagctattaacggtaagttttctctttgccgttatgttcatcactttggcattttgcagaaaatttgaaatggtttcattggtcagtattgttttgtcggcgttttttttagggctgttttcagtaccgtcaccgattggaaattctgaactaatgtcagtgtcagcgcgagaaaggctaggagcttcaattgttacattatcagggtccagtagccactcttttgttttaacaattgcattgctgtcaatggataagtaatgccccgacgtctccacaaagccaccagttttagcgatatcgctaccttgagcattaatattgccgtcaattaacgcaatatcgccccatacaatagcgcgcccgcctttttctttacctgatacattaattgttgagcctttttctaaagaggttttctttgctaattgaatgccgtttttaccttcgccgcgctcgtcgccgccaagataggtctctccccctcctttacctgaaggtcgataactgcacccgtttttaatgtaactttatcgcctgtaatcatcaacttaccacctttggcttgctgattttgagcggaaatcacaccgctaatttctgcttcaccctctttggcggaaagaataatgttgccgcttttatctttgcttacagaatcggcagaaagtttacctttattgcgaatagtggcggcgcggacattgatgttaccacctttggcaaaaatatcgcccagattgattgcttcattttcaggggcagcaatgctgtaagtaatgggttgggtttattatgtcgctgatggttattttttgccctgcaagtaaagaaatgctaccgccatttacgctaattacaccctcattttttactttgccgccaataaggtttacgctaccgtctttaccaacggtaattaaaccgtgattcacgatttcagcgagtgctttatccttggtttgttcaagggtgaaattacgcgccttgatgttttcgttagaaatgtctagcgtagaagcagtaaagccattagtgttaataattgcttctttacctattgtgataccatttgggttgattaaaaagacctgtccgttagaatctaaaatcccttttaattgggaaatctggtcagatgtaacacggttgaatacggcggagttgttgttttcttgtaaaaactgcaccatttcattttggtcaatgttaaattgtttccaattaatgatagcattgacactattgcggatggtggttttattgccgtctacttgcatggttgctgtaccgtgtacgacgctcattccctgtaaaccgctcgctaaaacagattgcggaatggatgccatgcccaaagatagcaatatagcggaaagtggctttaacgctaagtggcgtacttttgtacgaacaggtttttcactgcctttttctgtggaatggtcacaaccccgtgtcaattcagacacagcaaccaaagcattcaggcgtttgctgaatttgagacgatatatcttgttcatattttctcctaaggttagttgaacaattaaattactttatcatttgcgttcattcatccctctctttattctcgcttccctttccctctctctcacggttcatcatgtgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagattataccattttatatggcggatttatactatttttttaaaatatttgcatatagattgcaaagaagctgttgtaattgttgtttgtcatcacaaaaatcttgatttatttttattgtattgtatattcaaacagttaatttgagtaaggaatattatgctacaagaaattgaattaaaattggcgatttcgccacaaataggtattgaattgccacaatatcttgcaaaatttacgattttagaacatcaaaatttatttttgggtaacacctattatgattatcccgatcattttcttgctaaacaaaaaatgggattacgtattcgccaagaagagcaagaacttacattaacgcttaaaaccaacggtaaagttgttggtggattgcatagtcgtccagaatataatttactattaaccgaaaaagaaacgccaaccaatgcccaattaagagagctttatccttttgaacaattacctcgttcttcactacaacctattttctccacagattttaaccgcactttttggttagttgaatttcaacaatccaaaattgaagtggcgttcgatcaaggcaaaattattgcaggcgaatctgagcaaccgatttgtgaaattgagtttgaattgaaatctggcaacgtgcaggatctttttgattttgtagaaaccttgccttttgaaagggatatttattttaatagtggaagtaaagcgaagcgaggttatttgctgggctcaaaacaatttttaacagattggttaaataaatggcgtgatttcttaaaagaagaacgagaagaaagtgcggtagatttttgtgtaaaatttaattccgtgttgaaaatggaacagaaacttttggaagaaaccttatccttttctcccgcactttttagccaagattttatgaaaacagtagagcgagttggggtattttttaatctttatcattattatgatgaaaatggaaaaatcctagaagcggtggcaacagagaaacaaaaagaaacgctattgctagctttgttagaaagcaatcagaaaatctttgctgaaattcgtgacttgattcgttttcatagtgaaaccaaagacaatgaaaaaactattgaaaaattgaccgcacttttgaaaagtcgagtttattttaagcgaatgatcaaattaatggaattatcttatgacctagggtaggtataccttaggctagtctaagtgctactccgttgaggtggtttgatgttcttcaaagggggatagtataaccataattaactatgggtatataaagtgacctaggtgtaggtataccctaggctaatctcagtgttaccccgttggggtagtttgatgttccccagatggaactactataaacataaattaactgtgggtatacttacccacggcaaatacggagaatgaaatggctaaagccccgaaaacagcttatgtatgtaacgattgtggtgcagagttttctcgttggcaagggcaatgttcggcttgtaaagcgtggaatacaatcacggaagtgcggttaatttccacggcaaaatcaaaaaatgatcgttttagtggctatgcgggggaaactcaggcaaaaattcaaaccctttctgaaattagtttgcaagaaacaccacgtttttccagtggctttaatgaattagatcgggtattgggcggcgggatcgtaccgggcagtgcgattttaattggtgggcatcctggtgcagggaaaagtaccttgttattacaagttatgtgtggtttggcgaaaaatatgaccgcactttatgtgacgggagaggaatcgttacaacaggttgcgatgcgtgctagtcgattgggattgccaaacgatcaattaaaaatgttgtcagaaacctctgtggaacagatttgtaatttgtcggatcagttaaaaccgcaaattatcgtggtggattctatccaagtaatgcatttggcagatattcaatcatcgccaggcagtgtagctcaagtgcgtgaatgtgcttctttcctcactcgttatgcgaaaactcgccaagtggcgattattatggttggacacgttacgaaagacggaacccttgcagggcctaaagtgttagagcatgccattgactgttcattattattagaaggcgaagccgattctcgttatcgtactttgcgtagccataaaaaccgttttggtgcagtcaatgaattaggtgtatttggaatgacagagcagggtttgcgcgaagtgaaaaatccatcggcgatttttttaagtcgcggagatgaaattacgtcaggcagttctgttatggtactttgggagggtactcgtcctcttttagtggaaattcaagccttggtggatcattcaatgctggcaaatcctcgccgtgttgcggtgggattagagcaaaatcgtttgtcgttgttattggcggttttacatagacacggaggtttgcaaatggcggatcaagatgtctttgtaaatgtcgttggtggtgtaaaagttagtgaaacaagtgcggatttagccttattgcttgcgttaatttctagtttccgtaatcgccctttgccacaagatttagtgatctttggtgaggttggattagcgggagaaattcgtccagtaccaagtggacaggaacgtattagcgaggctgcaaaacacggttttaaacgcgccatagttcctttcggcaataagccgaaaagtgcggtcgaaaatatgcaggtttttactgtgaaaaaactcacagatgcgctcgctgtgttagataatttataaaaaatcattgcctactgaaaatgaaagtgaaattctgtagaatagttgttccttttttatgtgcaaagaaataaagaaaatggaaaaaaaacgaaataaagcattggatgcgatagatataaaaattctgaatgaattacaacgcaacggtaaaatttccaatatcgatttgtcgagaaaagtggggctttcgccaacgccttgtttagaacgcgttaaacgtttggaaaaacaaggtgtgattatggggtatcgcgcactgttaaatccagaattattggatgcaccattgctagtaattgttgaaattacattagtacgaggtaagcccgatgtgtttgaagaatttaatgcggcgattcaagagttagatgaaattcaagaatgccatttggtatcgggcgattttgattatttattaaaaactcgtgtggcagatatggctgaataccgaaaattgctggggacgacattattgcgtttaccaggtgtaaatgacactcgcacttatgttgtgatggaagaagtaaaacaaaccaatttccttgtattgaaataatatgattaaacaaattacagaacgatttacgccaagacagtatttagctgaatttttgctaggattgaccgcactttttggattttatttgattgttgcttggtcaagttatacgccccttgataattcttgggctacagccagcgcgtatggaaacacaattaataaagtggggacatttggagcgtggataatcgatcttttttttgttttttttggctatgtcgcccatattattcctttcaccgcttttctcgtgcctatttatttattgaaaacaaaagcagttaaacagctttcctgtactcgaattattttacgtagttttggctttaccatgctgattattgggctttgtgtagtgagtatgttgcttttatcaagtaatactttttatttgagtggcggcgtattgggcggatcgcttgttgtaaattggttttatcctgtattaggtaaatttggttcaattttaattggttttgtgcttgctttaattggttttattttttgttctggcgcatcattaattcgattaattgttgcattttatcattggctaacaatgaaaaatgagcaatcagaaaatgctgagcaagaaaaatcaacggaagaattagagcaaattgtgattgtaaaatcagatcgttcagaaacagaaaatctagatcaaaatcatctcaatgtagaacaaaatagtgagattgaaactcaaaaatcatctttagaggcagaagaaagctcagttgagcaaccttcgcatttaattaatattcatggtttaaatccagaggtttctataaaatcagaatatgaactcgctaacgaagatagtgaaaaaccgcaattttcttttgggtttgattctgaaagcttgcctagtgtgaatttatcgagtgattcagatgaacaaagagtgagtaaaaatgattttgtagtagtttggaataagcctgtaaaaacagttgttcaagaagatctagcaattaatcaaagtgcggatgattttacgcaagtttctttgctgacaaatgatgaaatgccaacagtttcattaaaatcaacctctgatactgaaatggcagataatcattttgctgctcaagttgatgaaaaggtagatttagaaaaagatgaagtgaaatttagcgtatctttacagaataatgtgggcgtaattgaattagacaaaaatcaagagcctaattataaaggttacagtggtagtttgattcatcctgcatttcaacagcaaacaacaaaacgtgaaaaaccgagtacaccattacctagtttggatttgcttttaaaatatccgccaaatgaacaacgtattacaccagatgaaataatggaaacctcacagcgtattgaacaacaattacgcaattttaatgtgaaagccagcgtaaaagatgtgcttgttggccctgttgttacgcgttatgaattagaattacagcccggtgtgaaagcatcaaaagttacgagcatcgataccgatttagcaagagcattgatgtttcgttctattcgcgtggcagaggttattccaggtaaaccttatattggtattgaaaccccaaatcttcatcgtcaaatggtgccattacgtgatgtattagatagcaatgaatnccgtgatagca

SEQ ID NO: 544 - DNA, 6308 bp, H. influenzae
  misc_feature (6305)..(6305): n is a, c, g, or t
ccgcggagggggaggggtaccgggcgggggggcaaaaaaggggggaacgaattggggggtgggaaaaccagaaacaatccgggcaggaccgggaaccttctgtccttcgcccggaaccttggtggtaggatagaaaaaaagtaatcagttggctctcattataatggcctaaaagcggaaaaaaagtgtatgcttatcacaattttggaaaatggtaagaaaatatatcaagatagctctggtaataagtcccagtatgatttaaccaattcaaatggatcaattctcttattctacagatctcagtgcacaaatgcgtgataaatcatctattacggcaacacgaaatccaaatggagggggaatttatgagtaatttctttaattctttattttctgataaaggagaaattaaaggtattgataatcaatattctgtatctgaaatcgtagatattcttaaggaagaaggttattctattaatgtaatacaagataattttttggtgtttagattacaaggtacgaatgttgtagttgttccccatgatggaggtgatattcaattttttatcatgtatgacgatgatgagaaccgcttttcattaagaaaagtgaataaaataaatattgattatagactcggaaaattttatttaacagatgatgataaattaggaatcgagcttcttttgcgcaatgatggtaatggtgtaactaagtctcaaattattcaaggactatcagatatttctttattaaatggattagctaagaaagaattttggtaagttattagttccatatcctaagatcaaatcaaatatgctgcaggttattttacatctgtcttagagggaattaaaaaagtctcccaaattcgaatattaatctaagccccatttggggcttttctacacattctttcttagctgtgctataatcccgctaaaattctacccttaaaaacaagagaaattatgaccgcacttaatgtattaatttatcctgatgatcacttaaaggttgtctgtgagcctgttactgaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgcggatggtttgcttgcgatctgtattcagcacgagatcgatcatcttaatggaattttatttgttgattatctttctccacttaaacgccaacgtattaaagaaaagttgattaaatacaagaagcagattgcgaaaagctaaaacgtagggtgggctttagcccagcaatcatttcaaaaaacggtgggcttaagcccaccctacttcctttttcctatcaattaccataacgtaggacattatgaaatcacttaatattatttttgcgggtacgccagattttgctgcacagcatttacaagccattctaaattctcaacataacgtgatcgctgtttatacgcaatctgataaaccagctggtcgcggtaagaaattgcaagcaagtcctgtcaagcaacttgctgagcaaaataacattcccgtttatcaacctaaatccttacgtaaagaagaagcacagtctgaattaaaagcgttaaatgcagatgtaatggttgttgtcgcttatggattaattttaccgaaagctgtattagatgcccctcgtttaggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagtattaatcgatgttttagataatcttgaaaacagtaaatttatagcggaaaaacaagatggcagccaaagtaattatgcagaaaaactttccaaagaagaggcacaattagattggtcacttcctgcaatgcaacttgagcgtaatatccgcgcttttaatccttggccaattgcctatttttcaacagaagacaaggatggcaatgcacaaactttaaaagtgtatcaagcggaagtgttgcctcatcaagataaaccagcgggaactattttaagtgcggataaaaatggcattcaaattgcgactgtcgatggcgtcttaaacttattgcaattacaacctgcaggtaaaaagcctatgtctgcacaagatttattaaatggccgtgcagaatggtttactattggtaaggtgcttgcataatgaaaaaattttcttctaaaactatcaaagtaaaaaattcagtaaaaatgaccgcactttcgaccagggctattgcagcaaacttaattttgcaagcattggatgaaggtaaatccttgtcggcgttaattccagaagtgcaactttctgtaaaagcccaagatttgcccttgctacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaagttgtgaacgcaacaaaatcattaaaatctgatagttttagaggattagtgaatgcggttttgcgtagatttttacgtgaacaagatgaaattttggcaattatcgataaaaattggcaaacgcttcatcctgaatggttcgtgaataaattaaaaaaagcctatccgaattggcgtgagatcattgaggcgaacaatcagaaaccaccaatgtggctacgtgtgaattcacaaaaaaatgccctcgaaacttaccgcactttacttgaggaacaaggtatttctgcaaaaacaagtcaccatcctaatgcgctatgtttagatataccgattgcggtgcaaaaattaccgcactttgaagaaggtgctgtaacggtacaagatttgagtgcgcaatgggcggcaatgttgcttgagcctaaaaatgaggaatggatccttgatgcttgcgctgcacccggtggtaagacgacccatattttagaactggcacctcaagctaatgtgattgcattagatgtagaatctcatcgcttaaaacgagtagaagaaaatcttgcacgtttaaatcagcaagcgatagtggtttgcggcgatgcgagtaaacctgacgaatggttagctgaaattggtaaaagtgcggtgaaatttgaccgaattttacttgatgcaccttgttctgctacaggggtaattcgacgccaccccgatataaaatggttacgcaaagaaaccgatatcgctcagcttgtcgaattacagaagaaaatcctgagtgcactttgggaaaaactgaagccaaacggtgttttgctttatgcgacttgttctgtattgccagaagaaaattgcgaacaaatccaagcatttttaaatgctcacgcagatgcggagttattgccattacctgttagtgatgataaaagtgcggtgggttttcaattcattccgcaaccaaatagtggcgatgggttctattatgctaaattgcttaaacgagcataaaggagagcgataatgaaaatcatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgccgtgacagcctccgatgaaatcaatatggtcgcttgccaaatgggctatacattatttaatacgccaacgcgaattgcacgtatccgtaattcagaatatttacgtgaaaaagacaagttgttcaacaatgaaaatatacctattgatcatttaatttcgcctgaaaatcttgtcactgatgaaattacgcgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgtattatgtctattttacgtaatggcaaaccgattcgtccacaaggctcaaccattgtagaagctggcgatgaaatcacgtttatttgcgctactgaacatattaaggcggtaatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaaccattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttagtttttttacttttcagagtgatttattataatagtcgctctttttatgtaatttttgaaggggaacattattatgaattttattaaagaatttcgcgaatttgcaatgcgtggcaatgtcgtagatatggctatcggtgtgattattggtagcgcatttggcaagatcgtaagttcacttgttagtgatatttttacgcccgtgttggggattttaactggtggtattgatttcaaagacatgaaatttgtattagcacaagcacaaggcgatgttcctgctgttactttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataatatttaaagaatgaaagttagcagaaatgctgactttttttattactattttttaagctataatcagccctcaattttagggaaataaaatggaaaaatataataaacttcgcattgaatgggattgtcgccgaggaatgttagagttagataaaatcataatgcctttttatttgaagcattttgatgaattaacagatgacaaaaaagatatatttattcgtttattagcaagtacagatctgcagctgttttcttggttttttaatcgtggtaaatcatcagattcagaaattcaatctatggtagagtatatccaaaacgtacaaaaaatcacaactaattaaaattattaagatacgtatgaacttttttcacacacctgtgtctgagattgcagcaagagcttgctgtcttgaatattaaggcgtgttagatattggcataggagaaatatggctgaacagctaacagatcaggctttggtagaaagagtgcagcaaggggataagaaagccttcaatttgttggtttcgcgttatcagaataaaggggatncct

SEQ ID NO: 545 - DNA, 6854 bp, H. influenzae
  misc_feature (6821)..(6821): n is a, c, g, or t
aaaattgctcgcacgaaaccagagggaatgtggaaaagaagggcggataagggggggggaaataaaaatgtggggattggcggacgggactcaggcgaaatacgggccagaaaaactgaagaaacaatttggcactcgtctcgttaaagcaaatgcaacacttcttttccggaccccgaaatgggcaatttccgaagaaggggccttaagatgattagttctgcaacgctggttgacgctgattttggtttcctccccctacgttaacgcagaccacattctcaataaatataatatcaacccagattccgaaggtggctttcatttagcaacagacaactcttctattgctaaattctgtattttttacttgcccgaatccaatatcaatatgagtttagatgcgttatgggcagggaatcaacaactttgtgcttcattgtgttttgcgttgcaatcttcacgttttattggtaccgcatctgcgtttcataaaagagcggtggttttacagtggtttcctaaaaaactcgccgaaattgctgatttaaatgaattgcctgcaaacatccttcatgatgtatatatgcactgcagttatgatttagcaaaaaacaagcacgatgttaagcgtccattaaacgaacttgtccgtaaacatatcctcacgcaaggatggcaagaccgctacctttataccttaggtaaaaaggacggcaaacctgtaatgatggtactgcttgaacattttaattcggggcattcgatttatcgcacacactcaacttcaatgattgcggctcgagaaaaattctatttagttggcttaggctctgagagtgtcgatgaaataggtcgagaagtgtttgacgagttttttgaaatcagtagcaataatataatggagagactgttttttatccgtaaacagtgcgaaactttccagcccgcagttttctatatgccaagcattggcatggatattaccacgatttttgtgagcaacactcggcttgcccctattcaagctgtagccttgggtcatcctgccactacgcactctgaatttattgattatgtcatcgtagaagatgattatgtgggcagtgaagattgtttcagcgaaacccttttacgcttacccaaagatgccctaccttatgtaccatctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatacattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgccttgaactccgtcgttacatcatagaaaacaacggcttacaaaagctttttacaggcgaccctcgtccattgggtaaaatactgcttaagaaaacaaatgaatggaaacgaaagcccttgagtaaaaaataacggtttcttaaagtaaaagtgcggccaattttcaaagcgttttaaaaaactctcaaaaatcaaccgcacttttatatttataacgctcccgcgcgctcacagtttatcagcctcccgccgtaaaactctgccttttatggcagagattttagccaaaactggcagaaattaaaggctaaaatcaccaaattgcaccacaaaatcaccaatacccacaaaaaaacgacttgcatcaaaccccacaccgaatcagcaaaaaaacacgcgatgatttatgttgaagatttacaggtagagaatatgtctaaatcagccaaaggcacagcggaaaaacacggcaaaaacgtgaaatagaaatcaagtttgaaccgagcgatattagaccaatcttggtatgagttcagacggcgattggattacaaattacgtagtatgataaacatccatttaccatcctatcgaaaaatgacccaagtcgcagatatatcgcaaagaatatgatatagtcggtgcgataaatgcatcgaggagtagccaagaaattttggcggtacaaataagcggtcaaattagagcggaacacacccgtagcgcgtgagaagaaaacgattcagcaagattgccactgtcgaagttggttgacaaaacattactaaccacggcatggaatacacaacccaaacatagtttgcatcttccctaaggcatcgtttacattcattagcttatttatgccacagtgtggcaaatttaatttccttggcatcaaaactgcccagtaaataaaagcgataataaatatgtcaaacgccttcgtgtgaacgttcttcattgtattctcgtaagaattggttgaataatatctgttgagcttcaaagctattttgaggttgaagcgccgcttttaagctacagtgcattcgctcgtgtcgtccgttttgctctgggtgtgatagctgaattcgttcaggacgaatacctaagccaatccaccatttagaaagttcactgattcactaatgcttgcgatgcaaaaggtgagccgttatcggtacgaatcgaatacggcagaccaaattactcaaaaagacgttcaaactcagcaataacaggcactgattttgtattcggcaaccccttacagcaaaataaaaagcgactgaaattatccgtaatagttagcgaatagcaaaacttctgattgctgagtaaagctatctaaaagctttttggcacccccagtgaggacgtttaagtttctcactgataagccagtcataaatccattatggcgtggcattagggctatgatgaggtttagccctcaaagccaagctgttggtggcgtttaatccatttatctgccgttggacggctaatattaaactgctgacacagttcagttttagtatagcgttggcttagccacgcttttaagaaaagtacacgctgttgcatcgcatcggtctctatccaaggcatcatcaatctccagtggattaggtattttgatgatgagtttacgggaaaaatgtaaacgatgtcctcgggttagaatgtaaatgatgttatcaggttgtgctcctctttgagaaagagggggtagaaaaattatcttgttctaatcttgctataagctaatgctataacaaaaaatgtggcttgcagaagaataatacaagcacctgttgaggcatcaaaatgatagctcaatattacaccaattaggcttgatataattgaacttataatagcaatccataacattttatcaaaagatttgtgagcgtaagtgcggtaattcttgacgcaattaacattaccaccaccaaaataacgcctaccacttgcatcgtacttacaatggttaaagcaagcagcattaacaaaccatatagcggtcgaatttctgaacttctctgacaattgttcccaaaaatcaacggacaagttaatacctttggcttgcttgatatcacgtaagtcatgctacaactaggatgccttgaatgtgtatatgccgaaatcaatatcgcttttcgcctgcaaacgtgaaaagcagattttcaacgaatttacaagtaataatcacgtctcccttgctaagaagtatgctttatcgttgcaatggatctacaaaatcgtcaaacgtgtgcagaaagaagaaattgccaaacggccgtttaatatattcgcccaatcctaaaaataaacctagtaactgtaaaaaagtctctaggttttctttttatctatgtgtaactccgcttcatttctcctttctcatttcttccccacttcccccaaattcttctcattgatgttggattatgcgtgagagttatgttggatggctttatctacaaacaaatttttatttattgtgattaaaatattgcgacttttaaataaaaaaataatccgaaaaacataaacagatttcatcggataatattgataattttaaataacaaagccagattaaaatgtgaatatttactaatctaaattagcaataattgtgaaatgtcaattaaaataagtaagatgaaaatatgaatattttcatcttactcagcattttcaaaaattttatctttgttcggggtaaattacttcagatgtaacccatttcatccatacttgctctaataatgggattattgacgtactatcttcaaccattgtattaagagcagacaaaacattttctaatgaatttggttgttcttgtagataacttaacaaccagtaatctaactctgaaaggatttgttgctgaatcctaaaatcactatcacgccatataataacttgaattggcgtatcatcaaattgtttaaagtcacttgataaaaaatcaacttcataactttttaaataagctgcaccagataattgcattacgctatgtctattccactcaaatttttcaggcactttggctaaagaaacttctgcgagtaattgtgtattttcaaaatccatcaatgccaatatatttgtatcaaatatctctttttcttgacaaaacaagagaaattctcctgcaatatcttggaaataaggagaatgggcattaccattttgcacaaaattttctttagcatttttccaatactctagctcaatatgcaatggtgcttcaacaaaacaacgatcaataaaaccaaaagcattattacgaactaaacgtgtatataccgctaaacggctttcagcataaccatttaaaggatctgcattacctaaccgaatagcatttgccaatgcttgctgagtttctttcaatgatgacttaggctgcataagacattacctctgtgtgagcgtatttttgctgtaattgtgcaatatgctcaacttcggcgtaaagttctgcaaatggtgggaagttgaaatcacgctccaataatgttggaggaatcgtaggtagtcgttgataggcatattcgagtaaatcccatacagtgccttttacagcttctccgtgtgtatcaattaataattcaggtaaatggcgatatgctccttttactttattaaatgattcatttgctgaattctctacaacttgtgcagcagaatgttcttcatcgtgccctgcaatatgaatgtaattaacacgtttaacatcaacttgatctaaaaagatataaggatcaagcaatccgtgattaacaccattaacataaatattattcacatctaaatgaatgccacaatcagcctcttgtgcgatagcatttaaaaattccacttcattcattgtgctagtaggagaatgcaaataataagaagtattttctaatgaaatttgtaatcctaagaaatcttgcacatcacgtattcgttgtgcaacgtgttttactgcttcttctgtaaatggcataggtaataaatcatataaatgcccttcacattcacaataacttaaatgttcagaaaagaaagacgaattatattgattaattaatgctttcgtattacggagtaattcgcgatcaagtggtgcttgcccacctaaagaaagtgaaagaccgtgtactgctaacggaaatctttctgctgcttgatcaaattgataacgtgccattccacccattttactccaattttctggtgcgacttcaataaattgaatagcgttatttgagggaagttgtaaaaaatcctcagctaaattccgacgataacctagtccagcgccttgtaatttcataattaactcctttttaataaaagctggcataaattgttacgccagcataattattattcttatttagaaccgcatttaccttcgccacatttgccttcagcagctttcggtttgctcgcaccacatttaccctcgccacatttaccttcagcagatttagctttatctgcaccgcatttgccttcaccacacttaccttctgcggctttcgttttgacacatttatcgcctacacaaggtgttgctgtattatcagtattgcttgactttgattcagcctgtactgctgtcgctactgccatcgttaatgcacttgctaatgctgttaatgttgctaattttttcatttgaataatctcctagagtttgaattttgaataaataattagagaaatttcaaccagcttttagttggataaaccttcttaataagcgtgtctaaagagagtttccccgctccctgtgtaattaagattaataaagtcaccacataaattaatggtaatttataaccattatcacatacgttataacctgaatcggcgtgaatgctataccacgcgacagagattaaaatcgttaaacttaatgcactaaaacgtgttagcactccaaatatcagcaaaaatgggaaaattaattctgatcccattgcaacgtgccaattaatatcagctggaatatgattaaatggaaaaggaaaacgatcttgtatttcagcgaaccaattttgtccatccatttttctaatctgctcagtaaaactcccacgcaagaaaaaagggagtcccntagaagacaaccggcaggtcaggcaagtaaggc

SEQ ID NO: 546 - DNA, 7814 bp, H. influenzae
atataatgacgcaacgcacaatttacgccaaaccaatcttccgtttgcaagaaaaagtagtgcctcgaccttttgcacttcctatcactcgttcttgtttttgccaaaattccgcttggaaaaactcggttgcttgctcaaaagtgcggtcaaaattaaagataaaatattggttatcttgttggaattggtgcattagaacgttgttatgaatagaaaatggggtcattctactttaaaataggcacaaattaaatgataaaggaacgtcaatgccattttttaccgaagctccaaaatctctttgtattctccgattgtctgctgtaggcgatgtttgccacgccttagcggtggttcagcacattcaggcatattatccacaaacagaaatgacttggattgtaggcaaaactgaaatgggtttgctttcgggcattcctaatatcacgctcattccttacgataaaaaagcgggatggaaaggcgttttattattctggaaacaattaaaaaataaacaatttgatgcactattaaatatgcaaacagcatttcgtgcatcaatcctttctttaggaattaaagcaaaattcaaaattggatttggagaaaaacgttctcgcgaaggacaatggttatttgtaaatcgtcgtattacagatcctttttcccctcacgtattggatggatttatggctttcgctgaatatatcggcgtaccaaaatcagaaccgaaatgggaattagctatctcacaagatgatgataaatttgccgatcaatttattgatttttctcgtaaaaatttattgatttccccttgttctagcaaagcagaaaaagattggctaattgaacgttatgcagaaattgccaatattgcccatcagcataatatcaatgtgattttctgcagttcgccagcgaaacgtgaattagaaatagtcgaaaaaattaccgcactttgccatttcacgccaaccaatattgcaggaaaaacaaacctaaaacagcttaccgctttaatttctaaggtcgatctggtactttcgccagattctggccctgcccatattgcgacaacacaaggtacacccgttattggcttgtatgcctatcacaatcctttgcgtactgcaccttataataatttagataacgtggtatcagtatatgaagaaaatgcccaaaaagaatttggcaaaccgtcttctgaactaccttgggcaaccaaactaaaagggaaaaatttgatggcagagattcaagtcgaacccgtcattgaacaaatgaaaaaattgggattattttgaacaaataatctgtatctcaaaacttagatggttttaatatagccaacttgaaagttgtttttggaaagtaagaactttagttttttttaagttaaaaatcaataacttgttgtcaaaataattatatttagtcataaaaatctataccttaatctcttgcttatttagtccaatttttgcaggtacagattgaaatccaaaattagtttgaattttacgcaattaaatgcaaatgattataaataaacctattgattattataatcatcattattatcatcgccattctcctatttttaattattacaataaggaaaacagatgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttctaaatttactttggaaaaacgccctaaagctgttttccctcaatttttgtaattttatcaattaataggacataaggaatgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttctaaggaggtatgctatgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcattaacacggtggaagagggtaccgaggctgatattcgtatacca

SEQ ID NO: 547 - DNA, 10509 bp, H. influenzae
  misc_feature (5462)..(5462): n is a, c, g, or t
attaatacaaaccatgaagcccccgtggggataaaatccgctagccttggttaccagagaagatctttgtagccttaaaaaaattcatttttttggatgaaataatgattttgcggattagatcgaaaaaataagtttgagtggttggatatttccagaatatgtttttcttgcgtaaacttaatagccccttatttttcaaaaaccccaaagaaattttcccgcactttgggtacttttctttgctagttcttttgctttggctacctcagatttaaggcttctttcatacctataataatcaacccatagagggttgggtaatgtctgaaaagttagatggcgtacgcggttattggaatggaaagcaattattaacccgacaagggcaacctttatcgccgccagcttatttcattaaggattttccgccttttgcgattgatggcgaattatttagtgagcgaaatcattttgaggaaatttcatcaatcacaaaatctttcaaaggtgatggttgggcaaaactgaaattgtatgtttttgatgtgcctgatgcagagggcaatttatttgagcgtttagctaaattgaaagcctatttacttgaatatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagctcacaaattttaaaattgaaaacagcacgagatgaagaatgtacggttattgcacaccataaaggcaaaggacaatttgaaaatgtgatgggggctttaacttgtaaaaatcatcggggagaatttaaaatcggttcgggttttaatttaaacgaacgagaaaatccccctccgataggatctgtgattacttataaatatcgaggcattacgaatagtggaaaacctcgatttgcaacctattggcgagagaaaaaatgagcctatttataaatctgacaaaatgaatttaatcaatatggaaacaagcgattaattttccatcagtatattgttccaagtgcggttgattttcacgacatttttctgtcgctttccaacaacgaggattaaatgcacagccttttggcggattaattgggcttggcaattcgcctgtcagcttaatacgctcacggcgcaagtttggcgacaaacgtggtgtcgctgaaagtaacgctttggtataaggatgctgaggattagagaaaatttgttctgtcgtccctttttcaatacaacgacctagatacattaccatcacttcatcagcgatatgttctaccacagaaagatcgtgtgaaatgaacacgtaagacaatcctagttcatcttgtaaatccatcattaaattcagtacttgtgcacgcacggaaacatccaatgcagaaacaggctcatcggcaacaacgacatcgggatctaacattaaaccacgagcgatggcaatacgttggcgttgtccgcctgagaacatgtggggataacgatcataaaattcagcgcgcaagcccactttttccatcatcgataaaactttttctcgccgttctttggcggaaagttttgtattgatgattaatggttcttccaaaattgaaccaatctttttgcgtggatttaacgatgcgtaaggattttgaaaaactatttgaatttttttacgacgtagtgcttttgtttcagaatcattttctaaaaaattatgccctttgtaataaagttcgcctttggttggttcttcaatcattgtcaataaacgacctagcgttgattttccacaacctgattcacccacgactgctaaagttttacctcgttcaagctgaaaagagacaccatccaacgcttttacttgctgtggttttgcaaacaagcctttttttacagggtaatatttttttaagccaatggcatttaataatggcgtattttcttttacttcattcgtcattattaagctccttgatattcaactggattgccttgctcgttcagcggagtatggcattttactttatgcgaaccgatatgatgcaattgaggttcaacttggcgacaatattcggtggcataagggcagcgaggatttaataaacagcctgttgggcgatcgtattttccagggacgaccccttgtaatgattctaagcgagattttccctctgcaaattcaggtaatgaacgtaacaaggcttgtgtgtaagggtgttttggctcgcggaaaatatcttttgcggtgccttcttcaacgatttgtccagcatacatcacgataattcgctctgccgcttcagccacaagtgctagatcgtgagtaatcaaaattagggacatgcattctttcttttgcaattcaagtaagagttccataatttgagcttggatagtcacgtccaatgccgtggttggttcgtcagcaatcaataatttaggtctgcaagcaattgccatcgcaatcatcacgcgctggctcattccaccagacagctgatggggataaacatcaatccgagattcaggatcaggaataccgaccaattttaaaagctctaaagtgcggtcttttcttgccttttttgtgccgccttcgtgagttttcaacgcttccataatttggaaacccacagtataagcaggattcaaacttgtcatcggatcttggaaaatcattgctacatcagcaccaataagctggcgtttagctttactctctaaagtgagtaaatcagtattttcaaattgcaaggattcagcagatacacgtccaggatgatcaattaatcccataattgcgagagaactcacagatttacccgaacctgattctcccacaatgccaagcacttcgccttgtgcgacttgatagctaatgcgatccactgctttaaatggcgtttttttatcgccaaagtgaacagaaagttcttttacgtctaataatgccattctgttttcctattgtttgagttttggatcaagggcatcacgcaagccatcgcccattaagttgaaagctaataccaaagataaaatcactaagccaggaattgtaactaaccagtttgccgcttgcataaaaccacgagcttcggaaagcattgtgccaagttctggtgttggtggttttgcaccaatgcctaagaaaccaagtgtcgcgagttctaagatagcattggatattcccatagtcatttgcacaattaaaggggctaaacagtttggtaaaatcacaataaacatgaggcgtaaaatacctgcccctgccactttagatgaagtcacataatcacgatttttttcattcatcatcgctgctcgagttaaacgcacatagctaggaatcgataccacggcgatcgctaaagtggcattggcgagtgatggctctaaaatagagacgacaacaatcgtcaaaagtaagtttggaattgcgagcataatatcaattaggcgaatgataattgtatctagcacgccgccataataaccagaaatcaagccaaggctggtaccaaaggcgcaagatagtaatacgatgataaatcccgcaaagacggaaattcgcgttccataaataatacgcgaaagaatatctcgcccaatatcgtctgtgccgagtaaataagcaggattaccgccctcataccaagcgggtggcagtaaaagtgcggtacgattttgttctgttggatcaaaaggtgcaatataaggtgcgagaatgctgattaaggcaacaatcaaaataaaaattaaaccaattagcgcaccacgattttgtttaaagtaaaaccaaaattcttgtaagggtgtttttggcgcaaaagttaaaggcgtgtcagacataatttctcctacaattaatgacggatacgcggattgaccacgccgtaaagtaaatcgacggttaaatttaccacaataataatcgtcgcaataatcagtacagaaccttgcaacacaggataatcacgggcttgaatggcatcaataatccattttccaatccccggccaagagaaaatagtttctgtgagaactgcaccagaaagcaattgacctacaattaacccgaccacagtgacaacaggaattaacgcattacgcaatgcgtgaacaataacaattcgagtatagcttaaaccttttgcttttgccgtgcgaatgtaatcttcgcctaatacttccaacatcgcagatcgtgtcatacgcgtaataatggcgagaggaactgtgcctaggactattgcaggaagaattaaggatttcaccgcattttcgaaggcacctggcataccagaaagccagctgtcaataagcataaatcctgttggtgtatcgatccaaaattcattatctaaacgtccaccttgtggcaaaccgagttgtggcgaaacatataaaattaaaattaaaccccaccagaaaatcggcatagaataacctgtgagcgatgcagctgtaacggtgtgagaaatccaactgtctttttttactgcggcaatcgtgcctaaaattattccacctaataatgaccaaaataacgcaaaaaaagctaattcagcggtagcaggaaaaagcgtaaaaaattcagtaaggacaggttgttgagtgcggaacgatgcaccgaaatccccttgaattacattgccaatatagtggaaatattgctgataaagaggtaaatctaaacccaattggtgcatcatttgttgatgtacttctgccgttaagccacgttcccccatcagaatttccacaggatcaccgggaataaaatgcacaagggcaaaggtaataagagtaatggcaataaaagtagggatcaccattaagattcgtttgaatacaaatttaaacattccatcactcgtagataataaaagtgcggtaaaaattcaccgcacttttcaaagaaattaatcggtaaaaaatataatactcttgaattctaccgcactttttccaattttgccaaatgcgcaatcaaccatttaatgccttgagcttggaacgctatttgtaaacgtgtgttattttcagatccttccacattaatcactgtgccgaaaccaaatttttcgtgtttaactttttgacccattttccattcattttcgaccgcactggtattcgacaatgaaccgacttttgctaggttcatcgcacgcgtgactgtccctcgtaaacgaatttcttggatacattctctcggtaattctgcgataaaccgtgatggcaaatggcgttcttctttggcatataatcgacggctttccgcataagagatggtcagttttttctgcgcacgagtaataccgacataagctaaacgacgctcttcttctaaacgtccgggttcttcaaaagaacgaaaactggganataatccttcttctacgcccaccataaatacacgaggaaattctaagcctttcgcagagtgcaacgtcatcatttctacacaagattgatgcggcgaggcttgttcttcgccagcttctaaggaagcgtgcgttaaaaaggcagtgagttcggtcatatcttccgcattatcaggtttgataaattcacgggttgcggtaactaattcttccaaattttcaatacgcacttcgcctttttcgcctttttcttgttgatacatttcatataagcccgaatgtttaatcacaaaatcagtttgtgcgaaaagcggcatttctgcggtatcaagttgtagtgaattaattaattcttggaaacgtaataaggctgttgaggctcgccctgccaacatattttcttgtgttgcgacttgtactgcttgccataaggtaatttggcgttcacgtgttaagttacgcaatatatctaaagtgcggtcgccaatgccacgggttggcgtattaattacacgctcaaaagccgcatcatcttgacgattattaatcaaacgaagataggctaacgcatctttaatttcttgacgttcgaagaaacgcataccgccataaatacggtatggaatttgacaacgaattaaagcttcttcaataacccgtgattggctattactacgataaagtacagcgcaatcatcaagttttccgccatgttccacccaatcctgaatttgtgaggcgacaaattttgcttcgtctaattcattaaaggcagcatagatgcccacaggatcgcctttttcaccctctgtccataaatttttaccaagacgatcactattgtttgcaattaattcatttgcgctgtttaggatattggcggtagaacgatagttttgttcaaggcgaattgtttcggctttgaaatctttcaagaatttttggatattttctatttgtgcaccacgccaaccgtatatagattgatcatcatcgcccacaatcatgactttgcctgtttttccagaaagaattttgatccatttatattggattttattggtgtcttgaaattcatccaccaaaatatgctgaaaacgttgttgataacgttgcaaaattaatggttttttctcaaataattcatagacccgaattaataattcagcaaaatcgaccaaccctgcgcgatcgcaagtgtcttgatagatctgataaattttaatccattcacgttcttggcgatcattaaaatcttcaatatcatttggtcgcaagccttcatcttttttgttattgatgtaccaacaagcctgtttaggcggaaaagctttttcatcaaaattatgtaattttaataatcgtttaattaaacgaagttgatcttctgaatctaaaatttggaaatcttgtggcaatcccacatctaaatgatgagctcgtaataaacgatgggcaatgctgtgaaaggtgccaatccacataccaactaattgatgttgtgcgtgtttggcaagggtagattgaatacgatgacgcatttctgctgcggctttattggtaaaggtcaccgccataatgctgccttcagaaatattttcgaccgcaattaaccaagcaatacggtgcgtcaatacacgcgttttgcccgatcctgcaccagctagcactaggtgattaccaagaggagcagctacggctttgcgttgtttatcgttaagcccgtcaagtaattcagaaatatccatcataaactatctttaatctgtttaaatttacagttattatagtctcatctatcttgtgaaacaataagatttgtgagtatatcaaaagtagggtagaacattttaagaataatattaagcgggattctcctatatccttaaactcaacatcaaaaccatatgctttgaaagctatttttatactatctataaacaaatttttaattcgtttacctctcattcctaaaatgcaaggtttctcatttttccaaaaatacccatgatgtaatagtataggaatgttgtttaatgacttaatcaatacttgatttgctaggattcctgtaatgattttataaacatttgcttttccttctacttgcacgccattttacgcatagtcggtgattttgtccgaattaagttttaggttaaaaagttactcaaattcaatgttattcataattaatacaaataagaaagagtgagatatggtacaaaatttcaaaaaatggttagcacaaaggaatgggagaagtgtgctatccaagtttcattatgatcactctctaaagtagaaaacgtcatatactaaattatatactgatcaaaaaataatatttccttctattactcaataccaatcaatttatgtgtttgtaaacttagctgccatttaggtttatttgaacgttgattcaattgaccaagtaaagtgatagtctcaagtaaattcattttcccatcaatttcacaaggtgaaagatagtaattctttgcttttattttttgctcgatcaattcacaaaatgatggcatattactgtccattacaatacgtacttcatttgcaaatggaatgcaacgcttttcatacttatgagcataaaggctcttaggactcgtcgcaatataatctatttgtgcaggaattgcttttagaccattggtttcaattgcaagaaaatagccatctgatttaaattgctcaagtaagtattcaatttttggtacaattgttggctcaccacctgtgatgataatattctttgacgaaaatgaccgcactttttctagaatttgtgatacagaccagcgtttaaaattattataaggtgtatcacaccaaggacagtctagattgcatttaccaaatcgtacaaaaacacttggcattcccgtattgaagccctccccttgcagactttcaaaaatttcgactatgttaaagttcggttcaaaatcatgatatttttccatcaacatttactcctgatactcgcaaaatgaagctggggtttcccataaacgaatggatgatatggacagttgttcatcatgttttaaacgattaaaaataaaacgagctatttcttctgccgtagttctaaagggaacaccaaaagtttttgagtttaacttttgcaatagagtggcaatttggctttctcgctcattggtttgatcataaataaaggcgtgatccatcggatctaaaataacttttttcacaatagactttagatctgaaaaatcaatgaccattgctttttttgcacctgattcatataagtcacccgaaatttcaacttgtaatttatatgtgtgtccatgtaaattttgacatttcccatcatgtccatctaataaatgtgccatgtcaaagctaaattctttggaaattttaaacattttttctacctttttgagtcaaatatttctttagacctttattgcgtaaaatacagcttgggcattttccgcatccaccttcgatgccttcatagcaagtgtgagtatgtttttgtacataatctaatacgcctaattcatcagcaagctgccaagtttgggctttagtgagatacattaatggtgttttgatattgaattgataatccatagctaaatttaatgtgacattcattgacttgataaacacatctcggcaatctggataaccgctgaaatctgtttcacatacgccagtgataatatcttgaatgccttggcctttcgcataaatcgctgcataaagtaaaaatagggcattgcgaccatcaacaaaagtgtttggcaattcattctctttttgctcaatatgcgcctgttcatccattaatgcattatgtgtgatagctttcataacagatgtatcaatcaaggtttgtttaatgccgagatcttgcacaatggcgcgcgccttttctaattcaatagcatgacgctgcccatattgaaaggtaatggcttctatgttttctttgccgtattcagcaatagcttggaataaacaagtcgtggagtcttgtccacctgaaaagatgacaatcgctttacgatcgtggtttggattgaaaatattcatattttacctagttttttattgtaggaggtttgcgaactacggggggtattctagtggggaagttctattttagcaagacaagtgaaatatttcgttggatgtgaagtcgttgtgctacaattcgcaggtttttaatttagcaaaaaggtttacttatgaaaaaatggttgttgattatcgcaggcgcgttgattatttcagcttgcgcaaataaggatgtgtattttaacggtgcagaaggttcgcattcaggtgttaaatttgataaagattctcgccaatggggattgaatcaataaaaaagtgcggttgatttttaaccgcactttcgtttttctattggtagaaattattctactttcacaatccagccttcaggtgcttcgatatcaccgaattggatgcctgttaattcatcataaagacgacgggtaacagggcctacttcagtttctgaatagaatacgtggaattttccgttgtgttgaatgccgcccactggagtaatcaccgccgctgtaccgcacgcaccagcttctacgaattgatcgagttgatcgatatacacatcgccttcaatagcttccatacctaaacgctcttttgcgatatgtaaaagagagtatttagtgatacttggtaaaatagattctgattttggtgtgatgaatttattgtcttttgtgatcccaaagaagtttgccgcaccgacttcttcaattttagtgtgagtttttggatctaaatagattgcatccgcaaatttacgttctggcgtaccttgttctgcggctaattcgtgtggaagtaagcttgctgcgtagttcccacccactttcacaccaccagtgcccattggtgcagcacggtcataatcagtcgtgataaagtttgatggagccaaaccaccttgaagtaagcacccacggataccgagtcgatatagtataaca

SEQ ID NO: 548 - DNA, 8538 bp, H. influenzae
  misc_feature (8489)..(8489): n is a, c, g, or t
  misc_feature (8511)..(8511): n is a, c, g, or t
tcccttacccgctttttggccggcagaataagcgatgttaacaatggatcaatttttccccaagttttagaggacaggaaaatatcccgcacccatatagcgagattgccaaaatacccagttgaaaatcattaacaatggtttttataattttcagaaaaactttgcgatatagatcgcaaaaatcaacatcaagtgatttttctacccattatttatggttaaagtgcggtagaaaattggagcgttttatgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaattaatgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaatgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaataaaggaatgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcagtaaaatggcgttgttttttctaggttaaatcatcaaaaggtcgccattgtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaatttgctgattattttagacaagcagaagtaaaaggcgtgttaccgcgcgcagagtttggaaaggtttatgctgaaatattcgcgataatgttttagaatttaaagagaaaatagccgatcttggcgagcctaaacaggcttctatagattttaatattgccgtagattggcaaaacgaaaatcaaaaaatccgtttatttggttatatggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaattatgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaggaggggatttcagccagagaaatgatgcaaattatcgcaaatacaaaacctaattcaaaagttctcgtcaccattctacgattaggcaaaatcttacaaattccagttgttattgaagaatttnccagtaaattaaaaatagcggncgggtaccgagtccgaattcgatacca

SEQ ID NO: 549 - DNA, 9048 bp, H. influenzae
  misc_feature (7917)..(7917): n is a, c, g, or t
gattcgactcgtacccattaaagttgtgcaaatatagacttttcctgaacacgccaaaagccttagctttattttgatagccttgatgcaattgcaacatcatttgttctacttctggtgtaatggacagcaactcgtcgcgtaatacgctttccatttttatactgtcgccatccacatttttgactaactgatgcaaaacaatttgattaacggtaatactcatttttgtcacctttgaaaaatttgccgcaaattataaccgcactttttaagcaagaaaaaagaaattatttaggttctaccaaataatcgggtatcataagccaaattttttttatttttaacattatggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgttaatatgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaattacgtagtcttgaacgccaaaaatggctaaaaggcactggtatattcttaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaacccaaataatgaaagtgcggtaaaaaatctcaatgattttattaaagcacaaaaaactgactcaccttggtttgcttatttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagcgtattaaaattctcgaagttaccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcactttttgtcttttctagagctgttagcatgccacttaatggcccttgaaaatcgggcagttcatcggagaaaacaggaaagccaaattttgcatattctgtttgatttcggttagtgttaattgaaatctgatgaatttgtggttgtaagcgattaataacatgttcaattaaagattgtttacctaaaatctgtaatcctttatcttgcccgcccattctgcgtgctttgccacctgccaaaattaccgcacttattgtaattgtcatattttaatctatcattatttcaagtatcatttgcctattttttacgattaaaacggaaatagcaatgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctatggattancccgcactttctttcatttttgtaaaatcttatagcagaaaattagggcaacaaacagaatttcagcctgttttattgcgcatattatcttaagttttttattcgctttttattatttctgcgatctagatcgcaaactataaagctagttatttaaattacccattgaaaaaagctctttagaggcttggtcaaacttagtgatgatgtggcaaaagttgctattctagcaatgcctgttatactctatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgtagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcacttttatgcaaagcctcgatgcgacgggtaccgagtcgatatcgtataaag

SEQ ID NO: 550 - DNA, 7991 bp, H. influenzae
  misc_feature (982)..(982): n is a, c, g, or t
gtcaactgtacgaataacccatggtttgatacaagagtctacccctctgaacgaaacgtagtaaaccagtacatcaacagccgctcccttcggcagcggatagaacttcacgacctgaggtacatgcaagagcgagatagagggacacgaaacccacagaatcgcgaaggtccacagaacgaccctgacccgcagttggggggccgttcatccgaagccgggtaaataaagatattaaaaacatccgcatggcttgttcacctctcatctaataagatccctgaatatgggggacgccgacagccctcagttaaatacccgctttcttcatagccacattagcctggaggcgcacccactaaacgagagacactgtgcttttccataaactctgacatatcaatgcgcaccatcgcatcttcactatcaaacaagaatttagccaaagttttgcaaagctctgttttacccacacctgttggccctaggaacaagaatgaaccaattgggcgattaggatcggaaagaccagcacgactacgacgaatcgcgtttgctaccgcatcaactgcttcttcttgaccaatcactcgtttatgtagttcatcttccatgcgcaagagtttttctttctcgccttccatcattttggatacaggaatacctgtggctttagaaagcacttctgcgatttcttcatccgtgacacgatagcgtaaaagcgtcatttcttttccttcgctggtttcagcttgctcgagttgcttttcaagagcagggatgcgtccatattgcaactctgacattttcgctaaatcacccgcgcgacgagcttgttctagttcggtttttgcagtatctaattcttgtttaatatgttgagagccagaaagcgttgctttttcagatttccatacttcttcaagttcggcgtattcacgttctttttcagccaattctttctctaacatttctaaacgtntgcgacttgcttcgtcttcttctttttgtaatgcctgttgttccaattttaattggataattcgacgttcaaggcgatcaagcggttcaggtttagaatctatttccatacgaatgctagacgccgcttcatcgatcaaatcaatggctttatccggcaattgacgatcggaaatataacgatgtgaaagcgttgcggcagcgacaatcgcagggtcagtaatatccacgtgatgatgaatttcatagcgttctttcaaaccacgtaagatagcaatggtatcttctacacttggttcgtccacaaatactttttggaaacggcgctcaagtgcggcatctttttcgatatattgacgatattcgtctaacgttgttgcacccacgcaatgtaattcaccgcgcgctaaacttggttttaataagttacccgcatccatcgcaccatcggttttacccgcgccgaccatagtatgaatttcatcaataaagaggatcacgcgaccttcttctttagaaagttcattgagcaccgcttttaaacgttcttcaaattctccgcgatattttgcaccagcaatcaatgcgcccatatctaatgaaagcacacgtttatttttcaaaccttctggcacttcgccgtttacgatacgctgtgccaagccttcgacaatcgccgttttccctacacctggttcaccaattaacacagggttatttttggtacgacgttgtaatacttgaatggctcgacgaatttcttcatcacgcccaattacaggatcaagtttgccactttctgcacgagcggttaaatcaatcgtatatttttcaagagcttgtctgctttcttctgcattttgatcgttcacgttttgtccccctctaatgtgctgaatagcttgcgaaatttgttcttttttcgcaccgcactttttcaaaatatcgctgatcgttcctcgttcttctaaagctgcaagcaaaaacaattcgctcgaaataaatttatcttggttttgctgtgcgaatttatcgcatagattaagtaaattaataagctggcgtgaaagttgtacatctccaccattgccaatcacttgcggcaatttatttagttctgtctttaattcattacgcaataaagccacatttacgccacttgctgtcaaaattggcgcaatagagccgccctgttgatttaaaagtgcggtcaataaatgcacgggttcaataaattgattgtcttttccgatagcaagtgattgtgcttcgcttaacgcttcttggaattttgtcgtaaatttttcaatgttcatacgctttcctcaatttgatttcggctttcgccattcgcataaactaagtaagctcggttgaataaatttcaagagaaaaaatgaaatattttgattttatctatcaataagattttgatgataggttttaatccaccaaaatatcaaacagtggcacatcccaatgctcagtgggaagattttctacttgctgacattggtgcgctaaaccaactggaataaaagacttattttgccaattctgcaacgtgcgatcataaaatccaccgcccataccaaggcgatttccttttttatcaaaagccaccaatggcgtaaataaaatatccagttcatttaatggcaaaacattttgaacatttagctttggctcccaaatgccaaactgattttgtttcattggcgtatcaggtaaatagcgtaaaaccaataaatagtgtttagtaaaaggatgtaaaccaggcaaatacccatttttattttgcatccccagggattggattaaggcttttgttgaaatttcaccatcaaaagaaaaatataatgcaatatttttggcttgtcgttgctcgataagatttaacgcctgttgggtcactgattgtgctgcttgttgctgttgaagtgcggttaaatttgcgcgtatttttcgaatttcagcgcggatttgctggcgtttttgagtattcatagaaatgaaaggagaagataggacccagagtgccgctgcgggcagtagtccttgaacccgacggttcaaggaaatcagttgataccgttttcaggtttcttagcccaatgaacgagtcaaaggttaagcctacacaccaacgataggaaaccaatttataagatttaaagtatcggctcagggacatagcctactgacgaacactccaggtaattcttatgggtttatactagcccaaattcccagtattgactagcatttatttgtcaaatttaacgagttgcttataaaacgacaaaatgactctaatttgatcattaatttaatgcggttcttttgtaacacgaatattttctaatgaatgatctaattgttggatacccgttctcaatacctcttcaattttagccgttttatttttttcttggcttaattcaaaactcaaattgagtgccacaatagagagcacacgatcaagctgaataaggcctgtcttttctttcatttcggaaaccaatatatctaaattacgcgcagcttggcgcagtaattcttcttgttcaatgggtacatttaaacgcaaaacctgacccaaaactaaaatttcgaccaattttaacgacatttgatttccttaaattaaatatttgaatggctgatattatgccatagcaaaaaatattcgtcataaattttacattaaacccgccattcgctcatcaccataaattacgctataatgcccacatttttcagtttaaaacgagatttttatggcccaaattgcaacaaatccgcttgtgctagtggatggttcttcttatttatatcgtgcatttcatgcctttccttctttaactaatgccgcaggtgagccaacaaacgcgatgtacggcgtgttaaatatgttaaaacgcctcatctcacaagtacagcccactcatatagccgttgtttttgatgcaaaagggaaaacatttcgcaatgaaatgtttgaacagtataaatctcatcgcccgccaatgcctgatgatttacgcaaacaaattcagcctttgcacgatatgattcgtgcattgggcattccgcttttagtggtggaagggattgaggcagatgatgtgatcggtactctcgcactacaagcatcaagtttgggtaaaaaagtgctcattagtactggcgataaagatatggcacagttggtggatgacaatattatgctcatcaacacccatgaataatagcctattggatcgtgagggtgtgattgaaaaatacggtattccacctgaactcattattgattatctcgcacttatgggcgatagtgcagataacattcctggcgttgctggcgtgggcgaaaaaaccgcacttggtttactacaaggcataggaagcatggctgaaatttatgccaatcttgaaaaagtagcggaactgccaattcgtggggcgaaaaaactaggtgaaaaattattggctgaaaaacccaatgccgatctttcttatacattagcaaccatcaaaacggatgttgaacttaacgtgacaacagatcaattgttgcttggagaaagccaaaaggatcaactcattgaatattttgctcgctacgaatttaaacgctggcttaatgaagtgatgaatggtgctgactccataacccaaaccactgaacagccagtgaaaatgaaccagtatcaggcgacctcacaagatcaaagtgcggtggaaaatacgcctaaaattcaaatcgatcgtacaaaatatgaaaccttactcactcaagcggatttaacgcgctggattgaaaaactcaatacagcaaaactcattgcagtggatactgaaacagatagcctcgattatatgtctgctaatttagtgggtatatcttttgctcttgaaaatggcgaagccgcttatttaccattgcaattggattatttggatgcgccaaaaacactcgaaaaatcgaccgcacttgcggctatcaaacccattttagaaaatcctgacattcacaaaattggacaaaatattaaatttgatgaaagcatttttgcccgtcatggcattgaattacaaggtgttgaatttgatacgatgttgctttcttatacgctaaatagtacgggtcgtcataatatggacgatttagccaaacgttatttaggtcatgaaactatcgcatttgaaagcatcgctggaaaaggaaaaaatcagcttacgtttaatcaaattccattagaacaagccactgaatacgcagcagaagatgcggatgtgacaatgaaattacaacaagcactgtggttgaaattgcaacaagaaccaacgcttgttgaattgtataaaacaatggaattaccattacttcatgtgctttctcgcatggaacgtacaggcgttttgattgatagtaatgccctctttatgcaatctaacgaaattgccacaagattaaccgcacttgaagaacaagcttacgaattagcaggtcagccatttaatttggcttccaccaaacaattacaagaaattttgttcgataaacttggcctacctattttacaaaaaacgccaaaaggtgcgccatcaacgaatgaagaagtattggaagaattagcctatagccacgaattacccaaaattttggtcgaacatcgtgggttgagcaaacttaaatccacttacacggataaactgcctcaaatggtcaactcacaaacgggacgagtgcatacctcttatcatcaagcggtgacagcgacaggacgtttatcatcaagtgatccaaacttacaaaatatcccgattcggaatgaagaaggtcgtcgtattcgacaagcatttatcgcacgtgaaggttattctattgtcgctgctgactattctcaaattgagctacgcattatggcacatctttctggcgatcaaggcttaattaacgccttctctcaaggcaaggatattcatcgctccacggctgctgaaatcttcggtgtatcattagatgaagtcaccagcgagcaacgtcgcaatgctaaagcgattaatttcggcttaatttatgggatgtccgcgtttggactttcacgccaacttgatatttctcgtcctgatgcaaaaaaatacatggatttatatttccaacgctatccgagtgtacagcaatttatgaccgatatccgtgaaaaagcgaaagcacaaggctatgtggaaacgttatttggtcgccgtttatatttacctgatatcaattctagcaacgcaatgcgtcgtaaaggggcagaacgcgtagcgataaatgcaccgatgcaaggcacagctgcggatattattaaacgagcgatgattaaacttgatgaagtaatctatcacgatcccgacattgaaatgattatgcaagtacacgatgaattagtgtttgaagtgcggtcagaaaaagtcgagtttttccgtgaacaaattaaacaacaaatggaagatgcatcggaattagttgttccgttgatcgtagaagtcggtgtaggtcaaaattgggatgaagcgcattaattggataagtaagaatgaatttagaaagacttaacgaaattgaaaaaccattactccacatcgttaaacacgatgttgtgccagccctaggctgtaccgaacccatttctcttgcactcgcatctgctacagcggcgaaatatttaggcaaaacacctgaacgcattgaagtaaaagtttcgcctaatctgatgaaaaatggattgggcgttgcagtgccaggaacaggtatggttggattgcctattgctgcggcaatgaaggtattgtcgaacacgatcttgatcgaactattgataatctctgcgctattgcatcaaaaagtatgcagcatatcgacagacaggttatcgaaattatagtaagcaagccttgtccttaatgaaaataaagtgcggtaaaaaaataaagaaatttcaatttcactcgaacttatcgtaaacaaaaggggtgagtataaatttacactcaaccctttatcttcattaagagacaatattatttatcactttctttttcatgtggattgcctttgacaccaatatgagaaatttccccattagcatcaatcaaataagcttggccaaaacctcttacaaaacgacctgttccaaatgtaagttcaactaaatcaaaatcagtaaattcacgaattgttttaattccgcctacatcattcatagtttcggctaatttatctaagactttttcaacaattggatcttcacgaggaataaaacgtgcacttgctttataacgtaagcgagtacgcacaataattgacttcgctttgttttcatcttctaaaaacatcacttctacttgatttggattgcgttttaaattctcataatgctctgcaatggcactgatataaatataatattttccatcaaagaaaataattggtgcataagacgccatcggtaagccatctttatctaaagtagaaagcacacagcttttaaactcttgacgaaattcatcaattttagccttaatacgatcgtaatttgctactggtttattttctacacaaagattgatgatagcttgcttaattgaacctgcgtcagcttgttgtggaaattccacacgtaatgttttgccaccattatatttaaaatctaaaccagcaaaatctacattaactaacgtcacatctgtgatttccttttcgccaccaaattttttacaaagggcagccatatcatcttgatgatgatcattcatatgagtgataattcgattgaaatccatttttgttccttatattaacaattaatttttattattctacggaatcatatccgatagaaataatgcagagcattatactcaagttaaagttatttaacatattttttacagaataattcttgataaataaaaagcccttataataaggggtaccgaggctgatattcgtataccag

SEQ ID NO: 551 - DNA, 8341 bp, H. influenzae
ttttgattcccctcaagggacaaaaaaataggtttcatagatctcctaaaatttgcctcacgcaatattctcccaagaatttaatactaaggaatagaacaggcccgggctcatcacggatcttttaagtaatatttagttatatcgccgtaagtgaatttcctctaaggtatggtttttaatggtgttgttatggcgatgtatttaaaatttggtggagctggggggagttgaacccccgtccgaaattactctaccttcagcactacacgtttagtctcgtctttaatttcacttaagcatgcggacagacacgctaaacttaagctagtttgattcaatttagtgcttcgatcctcaaacggtggcttccacacgatctcgttttggtttgactccgcgttatccccgtcttacgagcggaagctggagcgcgaaggctaaatgcaggttattaagctgctaaagcgtattgttcgtcgtttgcgactatttttttgcggtttatttacgaggcctaccgcacctcgacgtgcaccttgggcttcgctaatcccgtcgaatccagaatcagccccaaaattgcgtgttagtctagcaaaaaaagaaagctagggaaagtcgagattgattgaatttttgtatgaaagctagaataaccttaaatattgtctatttattattggcttattaccttattaacaattcatctctaaattgattggagacgatcattgattttttatggacgggaggcttgataatggcgttaattaattggcattatttcacgctttatttttgatgataggagctatagatttgtaaattatggcaaaattaaagatatttacgaattcctaaaaatataacacagcatatatgctataattagctcctaaactttttggaaaatgttatcttattctagtatttatcatcaatgattttataaaatttcttgcatattaaatttttatcactataatgtagcacatatttcggacgcggggtggagcagcttggtagctcgtcgggctcataacccgaaggtcgttggttcaaatccagcccccgcaaccaataataagttcagtaaaagaaccccagttttggggtttttttctataagaaatttagtaactgggcttaggttcttatgaacctaaccctttttttatgcctgagatttaataaactatcttcttactattactaaaatagagggataagtattgtttaggataaggtttcataaggttatgatatagtgcggtgaattacaccctatataggagtagaaattggctacattagaacaaaatttacaagaaatgctacaagatgcggtaaaggatttaggctgtgaattgtggggaattgagtgtcagcgcgtgggtcgttttatgacagttcgtttatttatagataaagaaggtggtgtgacagttgatgattgtgctgatgtaagtcgtcaagtgagcgcaattttagacgtggaagatccaattgcggataaatataatctagaagtgtcgtcacccggtttagatcgtccgctatttaccttgccgcaatttgaacgctatattgggcaagatatcgctgtgcatttgcgaattccagtgatggaacgccgtaaatggcaaggtaagttagagcgtattgaaaaggatatgattactttaatcgttgatgatcaagaacaaattttagtcttcggaaacattcaaaaagcgaatgttgttgcaaaattttaaaaggagaaaaagagaaatgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacggcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcacgtgaagatatgttaccacgtgaaaacttccgtccgggagatcgtgttcgtggggtgctttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatccagttggtgcttgcgtaggaatgcgtggtgcgcgtgttcaggcaattacgaatgaacttggtggtgagcgtgtagatatcgtgctttgggatgataatccagcacaatttgtgattaatgcgatggcacctgcggatgtttcttctattatcgttgatgaagataatcattctatggatattgctgttgaagctgataatcttgctcaagccattggtcgtaatggtcaaaacgtgcgtttagcaacacaattaacgggttggacactaaacgtaatgacgactgatgagttaaatgctaagcatcaagcagaagataataaagtgttaaatttatttattaacgcattagaacttgatgaagaatttgcacaaatccttgtagaagaaggattcacaagtttagaagaaattgcttatgtgccaatgaatgaattgacagcaattgatggtttggaagatgaagatcttgttgaagagcttcaaactcgtgctaaaaatgcgattacagccgcagcagtagctgaagaagaagcactgaaaaaagcgaatgttgaagatcgtttattgaatttagagggaatgaatcgtcacgttgcaatcaaactagcagaaaaacaaattaccacccttgaagaactcgcagaacaaggcgttgatgatttaactgatattgaagaattaaccgcagaacaggccgcagatttaattatggctgcacgtaatatttgttggtttggcgaagaataaggagagcagtaatgactgaagatgttaaggctgatgcgccaaaaaaattaagcattcaacgcagaacaaaaacaacagtgagcagcaccacaactggcggtaaaagcaaagaagtacaagtagaagtacgtaaaaaacgcacagtaaaaactgatattgctcaacaagaagaagcaaaattaaaagcacagcaagaagcggaagcgaaaaaaattgctgaacaaaaagcagcagaagaaaaagctcgtttagaagctgaaaaagcggcaactaagaaagaagctgatgaaaaatcaaaagctgaaaaagcgaaagcagaaaccgctaagccagcaaaaagtgcggtagattctaaagctaaatttgttgatcctgaaaaagagaaacgtaaagcagaagaagctgaacttcgtcgtaaagctgaagaagtggctcgtcaaaaagcagaagaacaagctcgtcgtgcagcagaagaagctaaacgttatgctgaagcagatgattcagacaatgaatcttcttcagaagactattctgattacaatttaagttcaagatatgcacttgaagcagaagatgaagaagatcgtcgtaatgaaaatcgtggtcgaggtaaaaataaagtagcaaaagcaaaaaaaggcggtcgtgacgatgaaaatagcaaaaactcgaaaaacgagcgcgaatctaatcgtaaaaatcaaaaagatgctaagtttggtaaaggtaaaaatggaaaaaaaggcaccgcacttcaacaagcctttactaaaccagttcaagtagtaaaagcagatgttgtgattggcgaaaccattaccgttgcagaacttgcgaacaaaatgtcggtgaaagcgacagaaatcattaaagtgatgatgaaaatgggtgaaatggtcaccatcaaccaagttatcgatcaagaaaccgctcaattagtagcggaagaacttggtcataaagtaattcttcgcaatgaaaatgagcttgaagaagcggtattaggtgatcgcgatgtaaacgcggaaaaagtaacgcgtgcgccagttgtaactattatgggacacgttgatcacggtaaaacttctttacttgactatattcgtaaagcgaaagttgctgcaggcgaagcgggtggtattactcaacatatcggtgcgtatcacgtagaaatggatgatggcaaaatgatcaccttcttggatactccaggacacgcagcgtttacttctatgcgtgcacgtggcgcaaaagcaacagatatcgttgttcttgttgttgcggccgatgatggtgtgatgcctcaaactatcgaagcgattcaacacgcaaaagcagcgggtgcacctttagtggttgcagtaaataaaattgataaaccagaagcaaatccagatcgtgttgagcaagaattattacaacatgatgtcatttctgagaaattcggtggtgatgtgcaattcgttccagtatcggcgaagaaaggtactggggttgatgatttattagatgcaatcttacttcaatctgaagtgcttgaattgactgctgtaaaagacggcatggcaagtggtgtagtcattgaatcttacttggataaaggtcgtggccctgtggcaactatcttggttcaatcaggtacactacgtaaaggtgacatcgtactttgtggttttgaatatggccgtgcgcgcgcaatgcgtgatgaaaacgggaaagaagtggatgaagcaggtccttcaattccagttgaattattaggtctttcaggtgtgcctgcagcgggtgatgaagcaaccgttgtacgtgatgagaaaaaagcacgtgaagtggcattatatcgtcaaggtaaattccgtgaagtgaaattagctcgtcagcaaaaagctaaacttgaaaatatgtttagcaatatgtctgaaggcgatgtggctgaattgaacgttattgtgaaagcggatgtacaaggctctgtagaggcgattgttcaagcgttaaatgaactttctaccaatgaagtaaaagttaaagttgttggttcaggtgtaggtggtattactgaaactgatgcaactttagctaccgcatctaatgccatcattgttggctttaatgttcgagcggatgcaacagctcgtcgtgtcattgaagctgaaaacattgatttacgttactactcaatcatctatgaattgttgaatgaaattaaagcagcaatgagcggtatgttagagcctgaatttaaacaagaaattattggtttagctgaagttcgtgatgtattccgtcatccgaaatttggtgcaatcgcaggctgtatggtaactgagggtgtagtgaaacgtaacaacccaatccgtgtattacgtgacaacgtcgttatctttgaaggggaattagaatctcttcgccgtttcaaagatgatgtatctgaagttcgtaacggtatggaatgtggtatcggcgtgaaaaactacaacgatgtaaaagttggcgaccaaatcgaggtgtttgaagtggttgaggttaagcgttcaatctaacctttaacaaaataaagggcggttaaaaatcatagtgtttttaatcgcccttttgttattaaataaaccgcatcaaaattataaaccagttaaatcctcagcaatttcttcagcttgtttaatcacataagttaccgcttcttcctgtttatcaggcgggtatttatatttttgtaaggcacgtcgaacgagtaatctaattcttgcccgcaccgcttctttgtactgccagtcgattgtgaccgattttctaagtgtttccgtgatttctttcgccagtttagaaagcacttcatcacccatcaaatcttttgcactttgattttgagatagagcttcatagaaggctagttcttccttggttaatcctagttttttccctaatgctaaacgttcttggaaatcttggctcattttaaagagttcgtccaaaatctctaccacagtcaaattgtgattgtggtattgattcaatgcttccttcaaacgccgttcaaaatctttttgcaaggttaagtttgtgcctgatttaactttaatttcacttgccaaataacgctccatcgcgctaacccataaatttttagttgggctattttttacagtttgtaaaaattcctcggaaagcaaactgatttgtggttgtggtttttctagcagatcgaataaatcaatcacgccttcagaatacacagtttgattgaccaattttttcaataaaatctgtctttcatttgtgcctgtgcctttttgttcacgtttagttaaaattgcccgtacggcatcataaaaggcgatttcttggttatacggctcaacttcagccaatgtgccgcacagcatatagcctttttttaccaagcctgccgttttcaaaaaggcttttttgcgtggctcggtttcttttttattaaaccaatgctgctcgtgcgctttgccatcaaacgataattgatcaaggcttaaaatatggttggcggcaaaacgaatcgccatcaaaagatcattcggattatctttttctaaggcagcctgaacatcaaaggttttcccctcaactggcgttgcaaacaggctgcggataacttctaaatgctctttcattttaaagaatacatcaatcacgctatcagccagtttgcccttgccttgtgagtttgtatattgccgagtggctttttcgagctcgtcagcaatgcctacataatccacaatcaagccgccattttctcggcttttattgcggaatacacggtttactcgtgcgatggcttgcattaggttatgccctttcattggcttatcaagatacatagtgttacagcacggtgcatcaaagcctgtcagccacatatcacgcacaatcaccactttcagcggatcgttcgggtctttaaaacgacgttctaacgtttgcttttcctgtttactgtaaacgtgtttctgcatttcagacgcatcggaagcagaacctgtcatcacaattttaatcgccccttcgttatattgtccgaatgccattcagggtgcagagcgatgatctgattatacaaatcccacgcaaatctgacggctggaaaccacccatcatcgctttgctgtccaccacttcattgcgttttgcaaaatgttgcacaaaatcgatcgctaaatcatgcaatcgagcttctgagccgagcaatttttctcgcaagcgtaatttcgggttttcttcgccttccagcagttcatcaatttctgcaaataattcatcgtgattagcattctccgctagcttgatttggcgtgcttcatacacaatcggcacggttgcgccatcttccaccgcatcttgcaagtcataaatggacacataacgaccgaacacatcttgcgtgtccttatcttcaaggctaattggcgtacctgtaaaaccaataaacgaggcattaggtaaagcatcacgcaaatggcgagcataacctgtctgaaacttgccgttatgcagcttttgcgtaaagccatattggctgcggtgagcctcatcgctgatcacaataatattgttgcgctcatttaaaatagggaagcggctttcttcctcatttagggcgaatttctgaatcgtagtaaaaaacacgccgccgacttcattttgtgcgagcagttggcgcagttgatcacggtcttctacttgctgcggtgtttgtttgattaaatctttgcctgaagaaaaagtttggaaaagctgaccatctaaatcgttgcggtcggtaaccactacaatggtaggatttttcaattcaggctgtgcaagcagtttgcctgcataaaacagcatcgaaatcgacttacccgaaccctgcgtgtgccacatcacaccgatgcgtttatcgccttgctcgcttgtggcaaaaatcgtggattctactgcttcatttacgccgtaatattgatggtatgccgcgatttttttaatggttttgccaacggaatcccgttcaaacaagacgaaatagcggagggtaccgagtctgatattcgtataccag

SEQ ID NO: 552 - DNA, 9302 bp, H. influenzae
  misc_feature (5833)..(5833): n is a, c, g, or t
ggtaccgaaattcggactcggtacccataccggttaatacagagctgatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataaaaaatacaatttttaatcaaaaagtataaaaaataaaaatcaggcttgacttatttcttttgtactagtttaatagtacaaaattttccaaaaggataaatatgaacattcaaactcaagcctttattgcggtgacagctcaatcaattccctattatgctgataccaccgctatttttaatacactttgccaacctaattcaaattctcttctactcgactctgccgaaatagggagtaaaaatagtttacaaagtcttattttagttaatgctgcggttaaaataacgtgcttaggtcacaacgtcacatttaaagctttaaataagaatggaaaacaagttttaaaagaaattcatccaaaattaaccgcacttggaaaaataagtgcggtcaattttgaagacgaattttctgtacaattttcgccacttgataatcaactcgatgaagataataaattacagtctgctactatttttgatgggttgcgtgttgtttctactctttatcaacatagccaaacgcctatttttttaggcggattatttgcttacgatctcgtcgcaaatttcattccaatggatggcattacattaaaaaatgatggtatcaactgccctgattacagtttctatcttgccgaacacttaattactatcgaccatcaaaatcaacaagcgacacttaaaagtttctgttttgctcaagaagaacaagtcaatattgcgaaaacctcgctttctatcgcacaaaaactaaaaaatattgatcacgttctttctattaaatcggcaagtgatgaagttaaaacaaactttgacgatcctgaatttactggtatcgtaaaagccttaaaacaccatattaatattggagatgttttccaaattgtgccttctcgtcgtttttcccttgcttgccctaatacattagccagttatgctcaactcaaacaaaataatccaagcccttatatgttctatatgaatgatgaagactttattttgtttggtgcatcgccagaaagtgcgctgaaatatgcgccagaaaatcgtcagttagaaatttacccaatcgcaggttcacgccctcgtggttttgatgctcacggcaacattgatcctgaattagatgcacgtttagaactggaacttcgtcttgatcataaagaacaagcggaacatttaatgttagttgatttagcgcgtaacgacattgctcgagtttgccaaaatggtacccgtaaagtggcagaattaatgcaagtggatcgctattctcacattatgcatttagtgtctcgtgtggtgggtaaattacgccctgaattagatgcacttcacgcctatcaagcctgtatgaatatgggcacattaactggtgcaccaaaaattaaagcgatgcagcttatttatcaatttgagcaacaaaaacgccatagttacggtggtgcggtgggttatctcacgtctgatggacattttgatacctgtatcgtgattcgttctgctttcgtacaaaatgggatagcccatgtacaagcaggttgcggtgaagtattggattctgatccacaaatggaagccgatgaaacacgccataaagcagcggctgtcttaaaagcaattcgtcaagttaatacacaagcaaaataaggaagaattattatggctaatattttatttttagataacttcgattccttcacttacaatcttgtggatcaatttcgtgtattaggtcacaacgtcacaatttatcgtaatgactgcgacttagaaaaactggtagaaaccgcactcaatatcaatacacttgataccattcttgcactttctccagggccaggaacaccatcagaagcggggattttactgccattgatcgaacgcttaaaaaatcaagtgccgattattggaatttgtttaggccatcaagcgttgattcaagcctttggtggtaaggttgttcacgctggcgaagtgttgcatggtaaagtttctcgtatatcccatgataacgaagctatgtttaaagatcttgctaatccaatgcctgcggcgcgttatcattctttaatgggacaagatttaccaaaagaatttatcgtcaatgcggaatataatggcattatcatggcaattcgtcatcgtgatttacccatttgcgcattccaatttcaccctgaaagtattttaactgtgcaaggttcgcaattattacaacaatcaattgaatggttgttaaatagataagacagaaaaaagtgcggtgatttttaaccgcactttaaaggagaaaaaatgatcaccgtattcggacttaaatccaaactcgcaccacgtcgtgaacaactcgcggaagtaatttataacagtcttcatctcggattagacattccaaaaggcaagcacgcgattcgctttttgtgtttagaaaaagaagatttttactacccttttgatcgtagcgatgattacaccgtcatcgaaattaacctgatggctggtcgtatggaaggtacaaaaaaacgcttgataaaaatgctatttagcgaattagagtacaaactcggtattcgagctcacgatgtggaaattacgattaaagaacaaccggcacattgctggggtttccgaggaatgacaggcgatgaggcacgcgatttagattacgatatttatgtttaataaaatatagaaaattaacaaatccatatacaaagaaaaacaggaataaactatgcaacacaaccaattattagagcaactttatagcggacattcactttcaacctcagaaagcaccgcactttttaatgcagtcatccaaggtgagctttccaatgaacaaattgctgcaatgcttattgctttaaaagtgcgggaagcaaatactgaggaaattacgggtgcggttgccgcctcattacaaaatgccaaagtatttccacgtccagattatccttttgcggatattgtaggaaacgggtggtgatggacaaaacaccattaatatttccacagccagtgcgattgttgcggcatcaatgggagcaaaagtggcaaaacatggcaatcgtagcgtgtcgagtaaatcaggtgctagcgatgtgcttaccgcacttggcgttaatgtgaacgtcacaccagagcaagctcgacaagcattagatgaaattggtgtctgttttttatttgctcaacaatatcattctggcttccgtcatgttgcaccagtccgtaccgctttaaaaacgcacactatatttaatattttagggccgcttatcaatcctgctcgcccaacttatcatttacttggcgtatatgcgcctgaattagtaaaaacctatgctgaaaccgcagttgccttagaacatcaacattcctttgttgtacatggttctggcttagatgaagtcgcattgcacggcgaaacacaagtggcagaaattaaaaatggcaaaattgaatatttcactttaacgcctgaagattttggcttaaaaacgcaatccctcgaaagtcttcgcggtggtgaaccacaagaaaatacccaatatctgaccgcacttttacaaggcaaaggaaaggctgaacatgctaatgcggtggctgcaaatacggcattattattgaaattattcggttacgatgatttaaaacaaaatgtgcaaaatgtattggcgcatcttgcatcaggtaacgcctttaaaacattacagaaattaaccacatattaataaaaagctaatttgatacaccacaataagaagaaaaatgatgatcactcaagattttaccaaacccattgattccgctacggtgctacaaaaaatcgtgcttgataaagcacaatgggttaaagcaaaagaaaaggaatttcccctttcacaatttaaacaaaacattcaaaactctgaccgctctttttatgatgcgttagcaaaaggtacgcatcaaaagcccgcttacattttggaatgtaaaaaagcctccccttctaagggattaattcgtgctgaatttaatttggaagaaatcgccaatgtctataaacattatgcctctgctgtatctgttctgacagatgaaaaatacttccaaggcaattttgagttcttgccgttagttcgcggtatcgtgagccaacctgtgctttgcaaagattttatgattagcgaatatcaagtttaccttgctcgctactatcaagcggatgcgattttattaatgctttctgtggtaaatgatgaaacttatcgtgtgctggcagagcttgcacattctcttggcatgggcgtattgacagaaaccagcaatgaagaagaatttgaacgcgcccttgcgcttggtgcgaaaatcattggtgttaataatcgtaacttgcacgatttaactgtggatttaaatcgtgttgttaaactcactgaaaaatacgccgaccgaatccctgctgatgtacgtattattagcgaatcaggcatttacaatcacaagcaaattcatcaattacaaaaggtggcgcatggtttcttaattgggagtagcttaatgggcaaccaagatttgaataatgcggttcgctcggtgatttttggagaaaataaagtatgcggtttaacacgcacgcaagatgtcaaaatcgtttacgaaaacggggcactttacggcggattaatcttcgtagaacattcaaaacgttgtgtgagtttacgccaagcgcaagaattagtaaccgctgcgccacttcgatttgttggtgtttttcagaatcaagaaattgactttatcgtcaaaatagccaaccagttgcagctttatgcggtgcaattacatggtgcagaaactgaagcatttattaccgcacttcgccagcaactaccaaaaaacacgcaaatctggaaagcgatttcggtcaatactgaagcccaaagtacggtcgattttaccgatgatttgaatgtggatcgttatatttttgacagccagacagcgaaccaacaaggcggcacgggtaaaacctttgattggtcattaattcccgaacatcttaagcacaagattattttagctggaggtatctcgccaaataatgtagaacaagccattcaacaaaattgcttaggcttggatcttaattcaggagtagaaagttctgtgggcgtaaaagatcaagaaaaagtacggttagtttttaataatatttattaattttaataacatagaaatcactaaataatccgaaatgcgcaactattgatccagattgtaataatttattctatctaatagtaaaataaatctgtatttcagcttaaatgccaataggagtaaaaatattatgtgtttaggcgttccgggtcaaattgtcaaaattgatacaaattatcttcaacttgccacagtagatgtatgtagcgtacaacgtgaagtaaatatttctgggaaatccagccgatttacttggcaaatgggtggcttgttcatgtgagctttgcaatgagtgttattgatgaagatgaagccaagaaaccccaaaaggctctgatcacaatgaggcaactcgaacacgaagttggagattttttaggattaaatcaaaaataaaaaagtaggcataatgcctacntttttatgttttggtacaatgcctcaatcgccttatactgctcttggattttttctaatccagattggtattccgcttgtttttctcgttctttcgcaatcactgcttcaggtgctttagccacaaaagattcattgctaagtttattctcgatgcgtttaacttcgttttgatatttttcaatctctttggttaaacgggcaagctctgcttctttattgataaagccagccattggcacgagtaattccgcattgccaacgagtttcgctaccgcaagcggtgctgcttcgtttgcagctaacacttgaacgttatctaatttagccattgctttcaaaagagcggtctgtttttcaagaatctttgcattctctgcgcttaaattacggaataacagatctaagcctttacttggtgcgatgttgctttctgcacggatattacgtaccgcaacgatcacttcttttaaccactcaatttcagcttctgcttctagatcaaagccgttctcttccacttgtgggaaaggttgcaacataatgctgtcagccgtaatgccgacaaaacctttcactttttgccaaatttcttcagtaataaatggaataagcggatgtgctaaacgtaataatttttctaacacgtgaaccaaggtttggcttgctgcacggatttgtgctgcgttgccgttggcaaatactggtttagtcaattctaaataccagtcgcagaattggttccaggtacattcataaattgcattagcacaaaggtcaaaacgatattggcttaatgaattacggaacgtttcccactgtgcgattgaattccgattgaatccaacgatccgctaatgagaattcgatctcgccttcacttaaatctaatttttcattcgttaagacgaaacggcttgcattccacaatttgttacagaagttacggtaaccttctaaacgtttcatatcccagttgatatcacgaccatttgaagccaacgccgctaatgtaaaacgcaatgcgtctgtaccgtgagcagcaatgccgtccgcaaattctttacgggttgctttggcaattttctctgctaattgcggctgcatcatgttgccagtgcgtttttcaagtaaatcttcaaggctgataccgtcaatcatatcgattggatcaagtacgttacctttcgatttcgacattttttgaccttgctcatcacggatcaagcctgttacatacacagttttgaatggcacttgaggtttgccattttcatctttcacaaagtgcatcgtaaacataatcatacgcgcaacccagaagaagatgatgtcgaagcctgtgattaacacatccgttggatggaacattttgagctctttggtttgctctggccaacctaaggtagagaacgtccataagcctgatgagaaccatgtgtctaacacatcttcatcttgtttgagttcaaccgcagaatctaagttgtattttgaccgcacttcttcttcgttacgcgcgacataaacgttaccttctgcgtcataccacgctggaatacggtgtccccaccaaagttggcgagaaatacaccaatcttgaatatcacgcatccaagagaagtaaaggttttcatattgtttcggcacgaattggatttcgccgtcttctaccgctttgattgctacatcagcaagcggtttcacgctcacataccattggtcagttagcatcggctcgattggcacaccgccacggtcgccataaggcactttcaaatcgtgtggtttaatttcgtctaataaacccagtgcttcaaaatctgcgacaattttcttacgcgcagcaaaacgttctaagccacggtaatccgcaggaattgtcgcttcatagccagcaagtggtttgccgtcagtaccgataatttccgcttcatcacgaatatttgcgttcagcgtcaatacatttaccattggtaagttatgacgtttacccacttcgtagtcgttgaaatcgtgtgctggggtgattttcacgacacctgtaccgaattcacgatcccacatattcatcggcaataatcggaatttcacgattagccagtggtagaacaacagttttaccaattaaagattgataacgctcatcttcaggatgcactgcaacaagccgtatcgcccaacatggtttctggacgggtggttgccaccactaaataatctttaccatctgccgtttttgcaccgtttgctaacggataacggaaatgccaaagggagcctttgctctctttgttttctacttctaaatcagaaattgcggtgtgaagttttggatcccagtttactaagcgtttgccacggtaaatcaaaccttcttcgtgcaaacgaacaaacacttcttttactgcattcgataaaccatcgtccatggtgaaacgctcacgttcccagtcgattgagttccctaaacggcgcatttgttggctgattgtgccacctgaataagctttccaatcccaaaattttgttgatgaacgcttcacgaccataatcgtggcgagtttgccttcttcagccgcaaattttacgttccaccacattttgggttgcaatacctgcgtggtctgtccccgctgcccataagggtgtatgcccctcccatacggtaaaacgggttaaggtatccataaggtttgtgggaatgcgtgtcccatatgtaaagaaccctgttacgttcggcggcggaattgcaatgcaatagctcggcgcattttcattttcagacggtttaaaataaccgctctcttcccaatgttgataaagggcttgttctaccgcagacggattaaaacggtctgccatttcgaatttttgtgtcatttattttttctctttttgttgcgtgggaatctaatcccactaaagtactaaattatttttctataagatattttatttgttttccaaatttcgttaatgaaatttttaatctatttttatttgttacagtacataaataaattcctgaggcatcttgtaattcatcctcacaaaactcaatatttactaatcctttccgctttagctcttctaaattttggtattcattttccttatcgacttcaaattcaaaattattattttgaataaattctttatctgattcagaaagctctctaatcgttctacattcattaacgtatattctaatcagcttccaacattgccgtgaaactttacctacgataattgagataacaaaataacagattttgagaataacgtcctcaatagtaaaacttttaagttgttctaaaatataagaaaaattcattattaatgtttatttcctttataataattggcaaattttaaaactacccaataagtttaaaattaattatccaagactcatgttcatttggataaattgttttaatcactctttcagcttatccaaccccata

SEQ ID NO: 553 - DNA, 6701 bp, H. influenzae
  misc_feature (80)..(80): n is a, c, g, or t
atgaaatagcggttaatgaatttgtgggttatcttgaatttgcaaaatatttacaaccagattctgcaattgtattaacntgaaaaaaccaaagcgattattactttcgcactttgtggttttgctaacttcagctcaattgcaatcttaattggtggtttaggtggtatggcaccaagccgtcgtagtgatgttgctcgtttaggtatcaaagccgttatcgctggtactctcgctaacttaatgagtgcaactattgctggtttatttatcggcttaggtgctgcagcactttaatttatcttaatcaattaaaaagtgcggtaaaaaatgaccgcactttattcatttttattcattattaaaaataaggaaaaattatgactccacatattaacgcgcctgaaggtgcatttgctgatgttgttttaatgcctggcgatccacttcgtgcaaaatatattgcagaaacttttttacaagatgttgttgaagtaacgaatgttcgtaatatgcttggttttactggaacttataaaggtcgtaaaatttctattatggggcacggtatggggattccatcttgctctatttacgcgaaagaattaatcactgaatatggcgtgaaaaaaattatccgtgtaggttcttgtggcactgttcgtatggacgtgaaagtgcgcgatgtgattatcggtttaggtgcatgtactgattcaaaagtaaaccgtattcgtttcaaagataacgactttgcagctattgctgactttgatatggcacaagccgctgttcaagctgcaaaagcaaaaggtaaagtcgttcgtgtaggtaatttattctcggcggatttattctatacacccgatgtggaaatgttcgatgtaatggaaaaatacggcattttaggtgtggaaatggaagctgctggaatttatggtgtggctgcagaatatggtgcaaaagcattaacgatttgtaccgtgtctgaccatattcgtactcacgaacaaaccacggcagaagaacgtcaattaacattcaatgatatgattgaaattgcgttagattcagtattaattggtgatgcactataatatcttctatcggatttaagaagtgcttgaaaaacaaccgcactttttatataatccgcgcccattatgagccgtttgtggctcatatttttgtgtggtgcaatgaatcttgcactaaaaattatcggggagctatttaatagcgttattacccaattagaggaaaactaaaatggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaacaaagataaagtgggtaaagtaactttagatcaagttcgtcaaatcgctgaaactaaagcagcagatatgactggtgcgactatcgaaacgaaaatgaaatcaatcgctggtactgctcgttcaatgggcttagtggtggaggaataatacgatggctaaattgactaaaaaaatgaaagcaatcaaagctggcgtagattctactaaagcatacgaaattaacgaagcgattgcggtattaaaacaattcgcaacggctaaattcgttgaaagtgttgatgttgcagtaaacttaggtatcgatcctcgtaaatctgaccaaaacgttcgtggtgcaactgtattaccacacggtactggtcgtgaagtacgtgtagctgtgttcactcaaggtgctaacgcagatgcagctaaagaagctggtgctgatttagtaggtatggaagatttagcagagcaaatcaaaaaaggcgaaatgaactttgatgttgttatcgcttctcctgatgcaatgcgtgttgttggtcaattaggtcaagtattaggcccacgtggtttaatgccaaaccctaaagttggtactgtaacaccaaacgttgctgaagcagttaaaaatgctaaatctggtcagatccgttatcgtaatgataaaaacggtatcatccacaccactatcggtaaagcaaacttctctgaagttcaattaaaagaaaatcttcaagcattattggctgctttaaataaagcaaaaccaactactgctaaaggtattttcatcaagaaagtaagcatctctaccactatgggtgcaggtgttgctgttgatcaagcttctttataatttaaagaattgatagattttaaaccgcactttttgaaagtgcggtttttttgtttcataaaatttctatataagttttaaacttgacgagaaagctgcattcatttaaaatttaccgccttaaaattagcaaagatttagattgatttttaatcaatcttgaccttttattgcttaatttaaccgtgtttttgatagaaagcacatccacacaatgacaaattcaccgttatttgtcgttgttttgctcaagttgtcgttctatgtaatttgagttgtcaccccactatagaagtaaggttcagagtgcggtcattttaacggtcattcacgtcacagttagtttgtggctaggtcactgaacagttagcagaggaaaaccaatgggttactcctattctgaaaaaaaacgaattcgtaaagatttcggtaaacgtccgcaagttttaaatgttccttatttattaaccattcagttggattcttttgataaatttattcaaaaagatcctgaaggtcagcaaggtttagaagcggcattccgttctgtatttcctattgtaagcaataatggctatacagaattacaatatgtagattatcgtttagaagagccagagtttgatgtacgtgagtgccaaattcgtggctcaacttatgcagcaggcttacgtgtaaaattacgtttagtgagctacgataaagaatcttcttcacgcgcagttaaagatattaaagaaaatgaagtttatatgggggaaatcccattaatgactgataacggtacttttgtaattaatggtaccgagcgtgttatcgtttcacaattacaccgtagtccaggtgtattctttgattctgacaaaggtaaaacccattcttcaggtaaagtgctttataacgcacgcattattccttaccgtggttcttggttagattttgaattcgatccaaaagataacttatttgcgcgcattgaccgtcgccgtaaattaccggcaacaatcattcttcgtgcattaggctacaccactgaagaaatcttaaacttattctttgataaaattacctttgaaatcgctggcgataaattgttaatgactttagtgccagaacgtttacgtggtgaaacggcttcttttgatattgaagcaaatggcaaagtgtatgttgaacgtggtcgtcgcatcactgctcgtcacattaaagcattagaaaaagataatatctcacaagtggttgtgccttctgaatatattttaggtaaagttgcgtcgaaagattatgttgatttagagtctggcgaaattatttgtcctgcaaatggcgaaatttcgttagaaaccctcgcaaaattagcacaagctggttacaccacgatcgaaactttatttactaatgatttagattacggtccatatatttctgaaacgctacgtgtcgatccaacttatgacaaaactagtgcgctttacgaaatttatcgtatgatgcgtccgggcgagccaccaacaccagaatcttcagaagcgttattcaataatttattcttctctgcagaacgttatgatttatctacagtaggtcgtatgaagttcaaccgttctttagcttttccagaaggggaaggtgcgggtattttaagcaatgaagatattattgcggtaatgcgtaaattgatcgacatccgtaatggtcgtggcgaagtagacgatattgaccatttgggtaaccgtcgtatccgtagcgtgggcgaaatggctgaaaaccaattccgtatcggtttagtgcgtgttgaaagagcggtcaaagaacgtctatctttaggcgatttagatgcgatcacgccacaagacttaattaacccgaaaccgatttctgcggcagtaaaagaattctttggttcttcacagctttcgcaatttatggatcaaaacaacccattgtcagaagtgacacacaaacgtcgtatttctgcattaggtccaggcggtttaacgcgtgagcgtgcaggctttgaagtgcgtgacgtacataatactcactatggtcgtttatgtccgattgaaacccctgaaggtccaaacatcggtttgatcaactcactttctgcttttgcacgtactaatgattatggtttcttagaaacaccatatcgtaaagtggttgatggtcaagttactgaagaaattgaatacttatctgtaattgatgaagcaaactacatcattgcacaggcaaactcaaacttagacgaaaataaccgttttactgatgctttcgttactgctcgtggtgaacgtggtgaatctggtttatataaacctgaagatattcactatatggatgtttcgacacaacaagtggtatctgttgcggctgcattaattccattccttgagcatgacgatgcgaaccgtgcgttgatgggtgcgaacatgcaacgtcaagcagttccaacattacgtgcggataaaccattagttggtacaggtatggaaaaaccaatcgcacttgactcaggtgttgcggttgttgcaaaacgtggtggtaccgttcagtacgttgatgcgtctcgtattgtgattaaagtaaatgaagatgaaaccattgcaggtgaagctggtattgatatttataatttaattaaatacacccgctctaaccaaaatacttgtattaaccaaattccttgtgtgaatttaggcgatccaattaatcgtggcgaagtattagcagatggtccttcaactgatttaggggaacttgcattaggtcaaaatattcgcgtggcgttcatgccttggaacggctataacttcgaagactcaatgttagtttctgaacgtgttgttcaacaagaccgtttcactacgatccatattcaagaattatcttgtgttgcgcgtgatactaagttaggtgcagaagaaattactgcggatattccaaacgtaggtgaatcagcgttaagcaaacttgatgaatctggtatcgtttatgtcggtgctgaggttaaaggtggcgacatcttagtaggtaaagtaacccctaaaggcgaaactcaattaaccccagaagaaaaattgttacgtgcaatctttggggaaaaagcttccgatgtgaaagattcttcattacgcgtgccaaatggtacatcaggtacggttattgatgttcaagtcttcactcgtgatggcgtagaaaaagataaacgtgcattagaaatcgaagaaatgcaacttcgtgaagcgaaaaaagatttaactgaagagttagagattttagaagctggtttatttgctcgtgtgcgtaatcttcttatttctagtggtgcggatgcagcacaattagataaagtagatcgcactaaatggttagaacaaaccattgcagatgaagaaaaacaaaaccaattagaacagcttgctgagcaatacgaagaacttcgtaaagagtttgaacataaacttgaagtgaaacgtaagaaaatcattaaaggcgatgatcttgcaccgggcgtattaaaagttgtgaaagtttaccttgcagtgaaacgtcaaatccagccgggggataaaatggcgggtcgtcacggtaacaaaggtgttatctcgaaaattaacccagttgaagatatgccatacgatgaaaatggtcagccagttgaaatcgtattaaacccactgggcgtaccgtctcgtatgaacatcggtcagatccttgaaactcacttaggtttagctgcaaaaggtattggtgatcaaatcaatgcaatgcttaaacaaaaacaagaagtggaaaaattacgtagctatatccaaaaagcatacgatttattaggtaatggttcacaaaaagtggatttaagcacttttactgatgaagaagtattgcgtttagcgggaaatttacgtaagggcttaccagttgcaacgccagtgttcgatggtgcagacgaagcggaaatcaaagagctattaaaacttggtggattaccaacttcaggtcaaataaccctttacgatggtcgtactggcgagaaatttgaacgtccagtaaccgtgggttatatgtacatgctaaaattgaaccacttagttgatgataaaatgcacgctcgttcaacaggttcttatagccttgttacacaacagccactgggtggtaaagcacaatttggtggtcagcgtttcggtgagatggaggtatgggcacttgaagcatatggtgcagcctacaccttacaagaaatgctaactgtgaatccgatgatgtgaaatggtcgtacgaagatgtataaaaatat

SEQ ID NO: 554 - DNA, 9456 bp, H. influenzae
  misc_feature (4075)..(4075): n is a, c, g, or t
  misc_feature (4157)..(4157): n is a, c, g, or t
  misc_feature (4165)..(4165): n is a, c, g, or t
ctttgacaggaaacaggcattaaagttacgctaaatagtcgggaaaagtgagcaacttgcaggtcaattaaaagaagaaggcgataaaacaccagccgatgttttctatactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgcgtagtggtttacgatcacactaaattatctgaaaaaatatggaaaaatcagtgcttgattatgcaacaccaaaatggaaaggcaaaatcggttatgtatcaacttctggcgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcttctaaaaatcaagctgaagcacaaaaatttgttgatttcttagcgagtaaaaaaggtcaagaggcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataatccaaatattgcgtgcgtgtatttgaaaaaattcacgcacgcgtttacaattctctaacaaaattaaccgcttgcgtgcgtgaactgaaaggttcacattcctaaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaataaaatgataaataatccgttattaaccgttaaaaatctcaataaattttttaatgaacaacaagttctgcacgatatttcattcagcttacaacgcggagaaatcctctttttacttggtgcttcaggctgtggcaaaactacattattacgtgccattgcaggatttgaacaccccaatactggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacgccacgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggaaaaattacctccattcaaattgaaattaatggctacgcaatatggattgagaacgttatttctcccgatttatctattggcgataatttgcctgtttatttacatagaaaagggcttttttacgcttaacaataaagccttatcttcacgataaggcttatttttaaacaatatattcggaaaaaatttgttcaagatgtgatattaaacagtctgcgcctaaaatattttcccctttccacgcctgttgcaaaatctctggagaaaattgctggcttgccaattcagctaacggcaaataactgatatgccaaggctcccgccccactttcttattggactgcatattcataaaaggcaaagcaaaatcaaagtgcggtaaattttcggcaagaaattcactcaattcaaagaagtagccgcctttttcatattcccaaggctccagttgtaaagattgcccttgtggcaaaagatcaggatcaaaaatatccacttccgttccccaatgatgacggctcgcccccggcaatgcagaccaacgtaaaatcgcctgacatttttgccagtcatctaattggttcaaatctaatgcctttcctgcatcatcgtgtactttccgctcgcccttaaatntactgttccaaataagttttggcgtcaaaaatcacgaaaactgctcgcaggctgtaaattaaagccattttttgccgcactntgttgcanagcttgaaatgcttgcatagcttgtgtttgcaaaaaatgatttgatgaatgagttgtgggtaaattgactaaatgctcacgagactttcctgtaagcatttctagggttaatttcattttagctatccaataaattcactaacattttgtgataaatttcaccgcacttgccaagatcttctatactgacacattcattgactttatgaatggttgaatttaacggaccaaattccactacttctgcgcccatcaatgcaataaaacgaccgtctgacgtgccaccacctgtttcagcctttggcgttatgcctatggtttcctcaatagcggaggttatcgaatctaataatttacctggttttgttaaaaagggtttgcctgataaattccattcaatacgatatttcaaattgtgtttttctagcatttcagcgactttttgcttaatgatttcatccgtgacttctgtgcaataacgcaaattaaactgaatatataattcagcaggaattacattattacttcccgtacccgcgtgaatgttagcaatttgtaggcttgttggcgggaaaaattcattgcctttatcccattggtaagtcgttaattcttgcaagaatggggctgctttatggattgggttttcagctaaatgcggataggctacgtgtccttgaatacctttaatatagagatttcctgtaattgagccgcggcgaccatttttgacaacatcgcctaagtttttagcactcgatggctctccaaccatacaataagtaattttttcatcacgcgccattaacgtctcaaccacgcgtatagttccatcttttgcggcagcctcttcatcagaggtaatcaataatgcaatggtgcctttatgattaggatttgcttttacgtattcttctgccgccacaatcattgctgcaagggagcctttcatatccgccgcaccacgcccataaagcatgccatcaataatctccgcagaaaacggcggagacgaccattgattttcatcgccagtaggcacaacatccgtatgacctgcaaaagcaataactggctcgctcgttccgtgttttgcccacaaattcaacgtgtcattaaaaggcatccattcaatttgaaaacctagcttttctaaacgttcggcaataatttgctgacagccttcgtcattcgggctaatagacgggcgacgaattaaatcttgtgccaacgaaaccactttttctctcataaaaactcctaagaaaataaccgcactttaagcaaaaacagcctgatattccttttcattaaagccaattaatgccttttcatcttgtaaaataattgggcgtttaattaaagttggattctcagccaacacggaaagtgcggtggttttatcaagggaatttttaacttgctcatccaaattacgccaagttgtactgcgtttattcactaacacatcccagccaaattgagtttccgcttgggttaaaaaattcaaatctaacccatcaacacggtagtcgtgaagtttgtgttcgatattgtgatccgccagccatttcaacgctttcttcactgtatcgcaatttttaatgccgtaaactgtaatcatatttcacctaaaaaagaaaaatcctcaatctaatcagactgaggattttaacccttatactacttcatctcaaatgaattaacctaacaacttattgatacgtttaataaacgcagctggattttccaaagatccgcgctctgctaacatagcttgttcaagcaacagttccacccaatcagcaaattcagtttcatctgcaatatcagccacttttttcactaaatagtgttctggattcagttcaaatgtgtattttacttctggtacaggttgccctgcggctgcaaacaatttcgccatttgggtcgtcatttgatcgttatccgtagaacccgccgctggtgtatccgttaaattgtgagttaaacgcaccgttttcacacgttcgccaagcaagtttttcacacgctcaataaaactaccaaaggctttatcttgttgtttttgtgtttcagattctttatccgctaaatcgcctaaatccaaatctgctttcgtgatactttgtaattgtttaccgtcaaattcagttaaatagcttaacatccattcatcaatacgatcggaaagtaataaaacctcaatgccttttttattgaataattccaagtgtgggctatttttcgctgcaacataactatccgctgtaatgtaatagatagctttttgcccctctttcatacgcaagatgtaatcttctaaagagacagtttgctcactaccatcattatgtgtcgaagcaaaacgcaataactttgcgatagtttctttgttagcaaaatcttctgcagggccttcttttaagactaaaccaaactctttccagaatttaagatatttttctgcatcatcttttgctaatttttctagcatttgtaatgaacgcttagttaatgctttgcgtagtgcagccgtaattttgttatcctgtaaaatttcacgagatacatttaatggcaagtcattactatcgattaaaccacgcataaaacgtagataattcggcataaattgctcagcatcatccataataaatacacgttgaacataaagttttaagccgtgtttatgttcgcgattaaataaatcccaaggtgctttagctggtacataaagcaaactagtatatgcttgatttccttccactttgttatgcgcccaagtcacaggatcaacaaaatcatggcttaagtgtttgtaaaacgctttgtattcctcatcggaaacatcatttttagaacgcgtccaaagggcatcagatttattgattttttcccatttttcgccgcactctttgccctcatcatcgtattctttcgtcagcatttccactggcaagccaatatggtcagaatatttaccaataatttcacgcaaacgccattcatttaaaaattctttttcatcttcacgtaaatgtaaaatcacatctgtaccacgagattttttctcaatatccgccacagaatattcgccttcgcccgcagattcccaaagcacagctttatccgcctcttcgccagccgctctagtttttacagtcactttatctgccacaataaaagcagaataaaaacccacaccaaactgcccaataagctggctattttttgcttgatcttggccaagtgcggttaaaaattcttttgttcctgattttgcaatcgtccccaaatgatcgatgacttgctcacgagtcataccaatgccgttatcgctaattgtgatagtgcctttatccgcatcaaagctaacacgcacacgcaagtcgccatcgccttcatataaagcagggttggaaagtgctttaaagcgtaatttatctgccgcatcagaagcattagaaatcaattcacgtaagaaaatttctttgttagagtacaaagaatgaatcattaattggagtagttgtttgacttcagattggaagccgcgagtttcttgattttgtgacataattttttccttcataaagataaaaattgaacgtcacagatataagaataaaaagaaagatttcaagggaaatttaagaggaaaagtgcggtaaaaaacacaaggaatttaaaccgcactttaaataaaaaatttcttatttccccttgatcgctataaatttatatatataatgaattctgttttagatactagatagtaatttaatagtaatgaaacttggctagtgcattcccccactcctttcgcactagccatttttttgggaattttgtaccatatcccgactttttccaatcaacgatccattatgaataatctcgaacttgaacaactcattaatcaaaaactttcttctgataaaatcaatgactatgcacccaacggcttacaagtcgaaggtaaaacagaaatcaaaaaaatcattactggcgtaacggcgagtcaggctttaattgattacgcaatcagccaaaatgctgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgacattgaaaatttacaaccattagaaaaaggcactgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgcactggtggcggacaaggttatattgatcttgctgcagaacaaggctgcgacgcatttattacaggggaagtgtcagaacaaacaatccattctgcccgtgagcaaggattgcatttcttctctgcaggtcatcacgcaacagaacgctatggcatcaaggcattaggcgaatggttggcgaaagaatatggctttgacgtagaatttaaagatatagataatccagcataaaatacaaaagtgcggtaaaaatatttcttttttaccgcacgctttcttctctataagatcctacaatcataactaataacaattagcttcctttaataaaagaaaaaattgaatgcccattaaaaataagcaacaatacccaaaaaatttcataatattaagtgggaacaaatatggagcattctgttcataacaaactggtttcttttatttggagtattgcagacgattgtctgcgcgatgtgtatgtgcgcggtaaatatcgtgatgtgattttaccgatgtttgtgcttcgtcgtttggatactttacttgagccaagcaaagatgccgtattggaagaaatgcgttttcaaaaagaagaattggcattcaccgaattggatgaccttccccttaaaaaaattaccggtcatgttttttataacacctcaaaatggacattaaaatccctctatcaaaccgccagcaatacgccgcagtatatgctggccaattttgaagaatatcttgatggtttcagcaccaacattcatgaaatcatcaactgcttcaagctgcgtgaacaaatccgccatatgtcccataaaaatgttttgctgagcgtgttggaaaaatttgtatcgccctatatcattctta

SEQ ID NO: 555 - DNA, 9573 bp, H. influenzae
  misc_feature (9284)..(9284): n is a, c, g, or t
  misc_feature (9406)..(9406): n is a, c, g, or t
  misc_feature (9423)..(9423): n is a, c, g, or t
  misc_feature (9477)..(9477): n is a, c, g, or t
  misc_feature (9491)..(9491): n is a, c, g, or t
catttttatttggggtatcgaatttaatgttagaagatatgggctgtcttggcgtattgatggttcaatagacaaaaaattttaatcataacccagtggatattctattaataatcacttcttgaaaaatattactagccttgcactttttccagtataatctgaccaattttctgacaaattaaaacaagacgatgaataaaaaacacactttaatttcacttgctattttgaccgcactttatagccaacaaagtttggcagatttgcacgaacaatgtttaatgggcgtgccaaaatttagcggtgaagtcgtgacgggtgatgtgaattctctgcctgtatatattgaagcggataacgcagaaattaatcagccaaatgatgcgacctatcaaggtaatgtagatttgaaacaaggccaatcgccatttgttagcacaatccgtgcaggtcaaacaatctggaaaccaatcaacacctttacgcatggcttatgtccgcaatggatttgattataaagataatcagatcaatatgttgggtaaagatgcagagtttaatttagatagtcacgatggtaatttaacaaattcagaatatgaatttgtcggtcgtcaaggacgtggtaaagctgataatataacactgcataataattatcgtgtaatgaagaatgcaacctttacgtcatgtttgcacggcgacaatgcttgggctgtagatgcgtcagaaattcgtcaatacgtgaaagaagaatatgctgaaatgtggcatgctcgctttaaaatacatggtgttcccgtcttttataccccttacttacaattacccattggagatcgtcgtcgttctggtttattgattccaagcgcgggaacatctaaccgagatggtctttggtatgcacaaccaatttattggaatatcgctcctaattatgatcttactttcaccccgaaatatatgtctcgccgtggttggcaagcaaatggggaatttcgctatttaacctccattggcgaaggtaaagtggcaggagaatatttaggtaaggatcgttactctgaatatgctagtgataatcgaaaacgtcatttgttctattggaatcacaattctagctttttacaaaattggcgtctaaatattaattacacccgagtaagcgataaacgttatttcaacgactttgattctatttatggacgcagtaccgatggttatgcgaaccaatatgctcgcatagcttattatcaaccaaattataatttttctctttctgcacatcagttccaaatttttgatgatattgtaaacatcggcccttaccgtgcagtaccacaattagatttcaactatcacaaatatgatttagcgaatggatggttaaatttcaaattacattcacaagcagttcgttttgataatgacagtaaattgatgccaactgcatggcgtttccatgcagaacctagcctaaattctttaatgtcaaataaatacggcagtttgaatattgaaacgaaactttatgcgactcgttacgagcagaaaaaaggttcaggaaaaaatgcagaggacgtgcaaaaaacggtaaatcgagttattccacaatttaaagttgatttacaaagtgtattatcacgcgatataacgttcttaaaagagtatacacaaaccttcgaaccgcacgtgcagtatttatatcgtccttaccgaaatcaaagcaatattggttcaacacttaataatgattatttgggatttggttacgattcagcattagtacagcaagattactattcgctattccgtgatcgccgttatagtggtttagatcgaatttcatcggcaaatcaagttaccttgggtggcacaacgcgtttttatgatattgctggcgaagaacgatttaatttatctgcaggtcaaatttattacttaagtaattctcgtattgatgaaaaccctgcgaataaaacaccaacttcatcatctgcttgggcattagaatctaattggaaaataagtaataaatggtattggcgtggtagctatcaatttgatactcataccaattcaacatcattagcgaatacatcactagaatataatcctgaaaaaaataatttaattcagttaaattatcgatatgtgaaccaagaatatattgaccaaaacttaggtaaatcggctaacgcctatcaacaagatatccaacaagtgggattagttgtaggctgggaaattgccaataattgggctgtagtaggacgctattatcaagatctcgccttacaaaaaccagtagaacaatatctaggcgttcaatataacagttgctgttgggctgcaagtgttggtgtaaaacgcaatgtcacaaaccaccaaaaccaaacacgtaatgaaattgtttatgataatagcattggcataaccttagaattaagggggctaggcagcaatgaccatcaaagcggcattcaagagatgttagaaaaagggaaactaccttatattcgagcatttagtttggattaaacattgttcaatataaacgttagatcaacaaaaagagcggctatttttaaccgctcttttgtcacaatatacaaaataaaatactgattagagattacctaacttttcgtttaaaacactgagcaatttatctttactaatcatttctttttcaccggtacgacgattcttatattcaatttcaccgttgtctaggtttttctcaccgattaccaccatatgcggtataccgataagttccatgtctgcaaacatcacgcctgggcgttctttacgatcatcaaaaatcacatctacgccttgcgattgtaaagtgcggtaaagttcttcagcgtatttttgcacggcttcagatttgtgcatgttcattggcacaatcgccacagtgaatggggcgatttcgtctgatggccagatgataccgcgatcatcatgatgctgttcaatcgctgaagccaccacacgagttacaccaataccgtagcaacccatcgtcatcacaagtggtttaccatcttcgccttgaacggtcgctttcatcgcttcagagtattttttacccagttggaaaatatgccccacttcaataccacgtttgatttgaagcgtgcctttgccatctggactaggatcgccttctactacgttacgtaaatcaaatacttcaggcattgctacatcgcgtacccagttcacattgaaataatgttttccatcaatattcgcaccacaactaaaatcagacattaacgccacagtgcggtcaataattgcaggaatattaagatttaccgcgcctaacgatcccacgcccgcaccaattttcgctttgatttcagtttcgtccgcaaactcaaggggatctgccactaacgggtgtttttgtgctttgatctcgtttaattcatggtcgccgcgaataatcaacgcaacaagcggttgattttcgtctgcacctttcacaatcaaagtttttacggttttctcgattggtaaattgaattgctccaccaactccgcaatagttttcgcatttggtgtatcaactaaacacatttcagcggttggagcttggcgttcgcctatagcaattgcttctgcaagctcaatattcgcggcaaaatccgattccgttgagaacacaacatcatcttccccgcttgaagctaacacttggaattcgtgagaagctgaacccccgattgaacctgtatccgcttgcaccgcacggaaatctaagcctaaacgtctaaaaatgttactgtatacttgatacatcacatcataggttgcttgcaaactttcttgtgtcgtgtggaaagaatacgcatctttcataataaattcacgcgaacgcattacaccaaaacgagggcgcacttcatcacggaatttagtttgaatttggtataaattaagtggaagttgtttgtatgaagaaacttctcggcggactaaatctgtaatcacttcctcgtgagttggcccaagtacaaagttacggtttccacggtcttcaaaacgaagcaattcagggccatattgatcccaacgaccagactcttcccataattccgcaggttgcacaactggcattaatacctcaatggcaccacctttgttcatctcttcgcgaacaactttttccacttttttcaatacgcgaatacccgtcggtaaccagttatataaacctgatgccattgggcgaatcatacctgcacgcaacattaattggtggctcacaacctgagcatcatttggcgtttcttttagggtggaaaataaatattgacttgtacgcattgtttaaccttaaattctaagaactgaaaaaattggcgcaagtataacaaaaagtgcggtcatttttaaccgcacttttaacacttagtcattattttgcgcattcgccaaaattgccttatgttcttgaatcaatgccataaacggctgcccaaaccgctctaatttgatagagcccacgccattaatttgcaacatttcaatattgcttgtcggcatatattgtgccatttcttgcaacgtcgcatcattaaagacaatgtacggcggaatattttctttatcggcaatttgtttgcgtaggaaacgcaagcgtgcaaataaatccttatcgtaatttgcaacaccttgacgttgtggattatgggcaattttactgattgaagaaatacgaggcattgccaattctaacggttcttcgcctttcaaaatcactttcgcactttcagtaagttgcaacgttggatttaattcactaataacctgttgcacaaaacccaaatgaataagctgacgaataacagactgccaatgctctttgcttttatcttttccaatgccatatactgaaagtttatggtgttggcgttcaataattttctgattgtgcatgccacgcaacaccgcaatcacataatgtgcaccaaaacattgtcccactcgataaatagtagacattactttttgcgcatcgactaagccatcatattttttaggaggatcaaggcaaatatcacagttattacatggtgtttgtcgatgctcgccaaaataattgagaagaactaaacggcgacaagtctggctttccgcaaattccccaatagcttctaatttatgctgctcaatctgacgctgtggcgtttctggtttttcgaagagaattttttgtaaccaagcgtaatcagctggttcataaaacaaaaccgcctcggcaggcaaatcatcacgtcctgctcgacctgtttcttgatagtaagattcaatgctacgtggtaaatcaaaatgggcaacaaagcgcacattggatttattaatccccattccaaaagcaatggttgcgactactacttgaacattatcacgctgaaaatcctgttgcacacgttcacgaattgccgtttccattcctgcgtggtaagcagcagcagagacacctttattgcgtaaactttccgcaattcgctcaaccttatttctgctgttgcaataaataatcccactcttacccttttgagccaacacaaaacgtgtcagttgctccataggtttgtatttttcttccaaggtataacgaatatttggtcgatcaaaactaccaatatatttgtgcagatttttcagattaagatgccgcagaatatctttttgagtcgcataatctgccgttgccgtaagtgccataatcggcgcatcagggaaactggcttttaaaccgccaagctgggtatattcagggcgaaagtcatgcccccattgagaaatacaatgtgcttcatcaatcgcaataaagcagactttgctataagaaataagttgaaagaaactgttcgtcatcactttttctggcgacacataaagtagtttaagttgcccagaaataagcttattttgtacttgttgctgctgttctaaagtctgactagaattaagaaaatccgcctcaattccattagcttgcagctgatccacttgatctttcatcaaggaaatcagcggagaaatcactaaagttaaaccatcaaaacaaagtgcgggaatttggtaacaaagcgatttgccattccccgttgccattaccaccaacgcatcttgtccatttaaagcagcattaataacttcttcctgccctttacggaaagattgataaccgaaaaccgatttcaaaacagaaagtgcggtcggtttttctattatttttgatggtaaaggagaatccagcattttagaactgcacgttctcgccatgtgcagcacaggcttcaacgaaacaatcccaaaaacgttgtccgtcattagaaacccagtcgccatttttaaaagcaaaatggaaaccgcctaatttacttgcaatccaaagctcaagcagcggttcttgcttgttaatcactatttgtgtgcgattatcaaaggtgattgtaaatactgaaccttgcgtttcacaatctacatctgcaccttggttttccaattcttcttcaattttttgccaaacttgttcaatattttggtgaaattctgcaatattcataaaatgttcctgtttaaatctgataaaatgtggcaaattataaagcctttctcaagcttgtgaaaggcggatttaccgataagtgagagagagaaaaatgaaaaaactactatcaattttagtgcttagtgcaatttgcattgtgacaacaggatgcggcgtaaaaggttctttatattttcctgaaaaagatcaagctcaacaaactcaataatctattatctaatatcattcccaaaataactaaaacaggcacacaacatgaatttcttccaatataaacataacaaactttatgccgaagatatgccagttcaacaacttgctgaacaattcggtacacctctttatgtatattctcgcgcgacactagaacgtcattggcacgcttttgactcagctttcggtaagcgtcctcacttaatttgctttgccgtgaaatcttgctcaaatattggcgtgttaaatattatggcaaaacttggttcaggtttcgatattgtctcacaaggcgaacttgagcgtgtactggcagcaggtggcgatgcgtcaaaagtagtcttttctggcgttgcgaaatctcgagaagaaattatgcgcgcattagaagttggaatccgttgctttaatgtggaatcagtttctgagctcaagcacattaaccaaatcgcgggagaaatgggtaaaatcgcacctatttctttacgtgtaaatccagatgttgatgctcatacacacccttatatttcaacaggattaaaagaaaataaatttggtgtaagcgtaaatgaagctcgagaggtatataaattagcctcaacgctaccaaacataaaaataacagggatggattgccacataggctcacagctcaccgaattacaaccattcttagatgcaacagatcgattaattgtcctaatggaacaattaaaagaagatggaattacattaaaacatctcgatctgggcggtggtttaggcgtgacttatacggatgaaacaccaccgcatccaagcgattacgcaaatgcgttattagaaaaactaaaaaattatcccgaacttgaaattattcttgaacccggcagagcaatttctgcaaatgcaggaattctagtagcaaaagtacaatacttaaaaagtaatgaaagccgtaatttcgccattaccgatacaggaatgaacgatatgatccgaccagcattgtatgaggcttacatgaacatcgtcgaaattgaccgcactttagaaagagaaaaagccatttatgatgttgtagggcctgtttgcgaaacgtctgatttcttaggcaaacaacgggaactttcaattgctgaaggggattatattgctcaatgttctgctggtgcctatggagcaagtatgtcatcaaactataattcaagagcccgcactgcagaagttttagtagatggcgatcaatcctatctaattcgtcgtcgagaaaccttacaggaactttgggcattagaatcgaccatttaatatttcttatcttaaaaaagagcggtaaaaaattatctatttttctaccgcactttttctatttttatccatcaataaacctacctcaaatagtaagtttgtgatataaatcaaatttttttctattctagattggcatagaattgaattctttataaaatgtcatgctttttaaagtggacttctaaccactaaaggagaaattatgcaagataagctaaaagttttattgattgacgaccatccgttaatgcgtcgtggcattaaacaacttgtagaattagacgataactttgaagtagtggctgacgtaagcagcggcacagaagggatttctgtggcattacaaacatcacctgatgtgatcattttagatctcaacatgaaaggactttctgggttagatacgctcaaaggattacgtgcagaaggcgttgatgcgcgaattttaattttaacagtgtctgatgcaaaaaatgatatttatactctaattgatgcaggtgcagatggttatttgttaaaagatactgaacctgatacattgctagaccaaatcaagcgcatagcacaaggcgaagtcattctgagtgattctattaaaaatttattattagaacgtactcacgaagataatccgttagacagcttaacggatcgtgaaatgggcgtacttcgtcaaattgcaactggcttatcaaacaaacaaattgcagcacaactgtttatttcagaagaaaccgtaaaagtacatatccgtaatttattacgtaaattaaatgttcattctcgtgttgcagcaacggtattattttttgaacaaaatcgttaaaaataatcataaaaaatgcgctaggagagacttagcgcatttttctttaaaattataatatttaaattagctcaatagatttaatatcttctaataaaatatacaattcttgtttaatatttttttcaaactgtgcttctgcactttctcgagctaaatccagacgcattctttctcttttctcaagtagtttacggtcatcatgtgtaggcatatcacgcaccacttcatataaattagccatcgcaggataagatgataaattcttaccaaaaggccttaatagcatagtaagacgaattacgccttcagaaagattacattctccagactgcattgcancgagcataatatcaatgctctcttttaatcgtataaccccgatattcttagctttagcaatcaattccttttgaacttttactgcttaataaacggatgcatatagagtcatccagttacangaaaagtgcgatgacanaaatatcccaatcatagattacctaaattgataaatatccatacgctcgaaggngcgggataatcatnttcgctttcatcttcggctcaatgccaagttctccattactcaaaattcgatctagcatcatcacaaatgggggacctgatc

SEQ ID NO: 556 - DNA, 8875 bp, H. influenzae
gagaccccatacgtttggttgcatgacgagccataggttgatctactgtgccgcctttagtcataatgcctgaagcgactgcttcatattcgcgcgtaattttgcgtttttgtaagtctcgcactaacttagtttgtgctggaatggttttagcaacaaccattagacctgttgtatctttatctaatcgatgcacaattcctgctctcggtacttctgatatcggtggataatgatagagtaacgcattgagtacagttccatttggattgccagcaccggggtgtaccacaagatcttttggtttgttaatcacaataatatcatcatcttcatacacaatattcaatggaatattttctgcttcaaaacgtgtttcatcttccacttcaacaataatctctattctctctcctccaaacactttctcacgcggaatattagtaatgcggtcgttaagttttacgagatcggcttcaatccatgtttttaatcgggaacgagaatattcagggaacaactctgcaagtgtttggtctaaacgttgtcccatttgttctggctgcacttcagccgaaagggtaatttgtggcataaatagctctcaaaaattttaaaagttggcttattgattaatgttctatacaatagcggacaattgtatcttatttattggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaactcaagattatacgcaagtattattgatggtagatagctttttacatcaatttccacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttatgctcaagatgctttagcgcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatagcaataactgcagaaaaatcgaatactctctgcacctaaaagttgaataaaatttaaactaattaaggtgcagatttttttattttttatcaactgaaaatgcttcaccatagttcgcacaaataatctgagcagcattataaagcgttgtatcaggtgttaaacttaacgtatgtttcttttgctttttaggtgctgcccgcaaaccctgtccccaaaattcatcatagaaatcagttcgtacttgagttaaatgataatttgcacaattcaagatcttatactgacgaacagaacgtgcataacgtttaggctcaggataaacatacaatcccttatctaaattcaccactgcatcaaaatgtacaatttgtggctcttggttatccacccagatcgattcactatcgatgtaataattcacattctttaccaaacgtatatatccgcttcgtacatcagtcggcggtgccagcttcacatcattttgtttagccttttggatttgagcagaacaggcagtaagtaacccaagtgataatgttaaaataatttttttcattatttactccttatgttagctgacatttattctagaattttacagtgtgcccataaccttctaggattgttttaatatgctctaaggattctttagttggcggtaatacatcttcaagctcataatctaacccaagggttttccatttatgtgcacctaatcgatgataaggaagaagctcaactttttcaatattggtcataccttcaataaactgacctaataaatgcacatcgtgatcgctatcagtataaccaggaaccacaacataacgaatccaggtatgttgattacgtttttgcaaatattttgcaaattcaagggtacgtttattgggtaccccaataagattttgatgaacttgatcattaagctcttttaaatcgagtaaaacaagatctgttacatctaataattcatcaataatatgattataatgacgtacaaaaccatttgtatccaagcaagtattaatcccttccgctttacaagctcggaaccaatcgcgtacaaactctgcttgtaacacagcctcgccaccagatgccgtaacaccaccgccagtagcattcataaaatggcgataagtcacgacttctttcattaaatcttcgacactgatttctttccccccttcaagatcccaagtatcacgattgtggcaatatttgcagcgcatcaagcagccttgcataaataaaataaaacgaatacctggcccatctacagtgccacaggattcaaaagagtgaattcgtccaagaactgacatacataaatttcctaaaattagatatagctaaattttaccaaatatttagtctataaaaaatgagcctgatttaaatcaggctcattatgttcccaccaaagtgcggtcaaaaataaaaatgtttttacattgactctgtgaaagttctagtaattacgtcttgttgttgctctttagttaaagagttaaaacgtactgcgtaaccagatacacggatagtcaattgtggatatttatccggattttccattgcatctaacaacatttcacggtttaacacgttcacatttaagtgttggccaccttcaaccgttgcttcgtggtggaagtaaccatccattaagccagcaaggttgcgacgttgtgcttcggcatctttacctaacgcatttggtacgattgagaaggtataagaaataccatctttcgcgtaagcaaatggaagtttagctacagaagttaatgatgctaccgcacctttttggtcacgtccgtgcattgggttcgcacctggtccgaatggtgcaccagcacgacggccatctggggtgttgcccgttttcttaccataaactacgttagaagtaatggttaatacagattgtgtaggcactgcattgcggtaagttttaagtttttgaattttcttcatgaaacgttcaactaagtcacaagcgatgtcatcaacacggttatcgttattaccatattgtggatattcaccttcaatttcaaagtcgattgctacgttagttgcaacaacattgccatctttatctttgatgtcgccacgaactggtttaacttttgcatatttgattgctgaaagtgagtcagccgcaacagaaagacctgcgataccacaagccatggtacggtatacatcacgatcatgtaatgccattaatgcggcttcgtatgaatatttatcgtgcatatagtggattacgtttaaggcagtcacatattgtttagccaaccaatccataaagctatccatacgagtcattactgtatcgaaatctaatacttcatcagtaattggtgcagttttcgggcctacttgcatacctaatttttcatcaataccgccgttgattgcgtataacaatgttttcgctaagtttgcacgtgcaccgaagaattgcatttgtttacccacaatcattggtgatacacaacatgcgattgcgtagtcatcattgttgaagtctggacgcattaaatcatcgttttcgtattgaactgatgaggtatcaatcgatacttttgcacagaaacgtttgaagttttcaggtaattgttcagaccaaagaatggttaagtttggctctggggaagtacccatgttgtaaagggtgtgtaaaatacggaatgtatttttggttactaatgtacgaccatctaaacccatacctgcgatggtttcagttgcccacattgggtcgcctgagaataattgatcgtattcaggtgtacgtaagaaacgaaccatacgaagtttcataactaagtggtcaactaattcttgcgcttcagtttcagtaatttttcctgcttttaaatcacgctcaatgtacacgtcaataaaggttgcggtacgaccgaatgacattgcagcaccattttgtgattttattgcagcaagataagcaaagtacatccattgaatggcttcttgagcattagttgctgggttagaaatatcataaccatagcttgctgccatttgttttaattgacctaatgcacggtgttgttctgcgatttcttcacgtaaacgaattgttgcttcaagatttacgccatcttctaaatctttttgtaaagaagagaattgtgcatatttatctttcattaagaaatctacaccataaagtgctacacgacggtagtcaccgatgatacgaccacgaccataagcatctggaagaccagttaataccccagatttacggcaacgtaaaatatctggcgtgtaaacatcgaatacaccttggttatgtgttttacggtattcagtgaagatttttttcacttttggatcaagttcacgaccataaactttacaagaaccttccaccattttgataccaccgaatggcataatggcacgttttaaaggttcatcagtttgaagaccaacgattttttctaaatctttgttaatgtaaccgggtgcgtgagagataatggtagatggtgtatgttcatcaaaatctaatggcgcgtgagtacggttttcaattttaattccttccattacagattcccaaagcttggttgttgcttcggttggacctgctaagaaagagtcatcgccttcataaggggtatagtttttttggataaagtcacgtacattgacattttcttgccaatcgccaccagcaaaaccagcccacgccaatttttgcatttcattaagttctgacatagtcatttcctttgttaattaataaataagtaaatctttaatgcgttttggttaaataacgttggaatacaccaatacaaattgccccgccgacaatatttcccaacgttacagggattaaattcttcacgatgaaatggtacaaatctaaatctgcgtatttcatcggatcaacgccgatttgttgccaaaattcaggtgtactaaaatgtgcggtaataattcccatcggaatcataaacatattagccacacagtgttcaaatcctgatgcaacaaacaaaccaatcggcataatcataataaatgctttgtctgtaacagtcttaccagaataagacatccaaaccgccacacacaccataatgttacataaaatacctaggttaaaagcttcaaaccaagtgtgatgaattttatgttgggcggttgcaagaattgttaaaccccattgaccatttgctgccattgtttgtccactaaaccaaataacagccgcaataaataaaccaccaacgaagttgcccaaatatactacgatccaatttcgaatcatttgtgtcgtggtgattctaccgcctacacgggcgactaaagttaaagtagaagaagtgaataattcagatcctaaaatcaccaccataattacgcccaaggagaatactaacccacctactaacttggttaatccccaaggtgcgcctgcactagcagtttgtgttgtcgtgtaaaatacaaaggctaaggcaatacaagcaccagcactaataccagacataaacgataaaaatggacgtttatttgctttataagttgctgtattttctgcataatccgttgcttcaacaggtgtgagcgcaacagaagatagtttttgattttctgatgccataatcaaactccaactattgacattgaaaaaattgatgaaaatttaatacttttaacaagtttacgactacaaatacttctataattggtgctattttactctcctcccctttcattgcaaagaaaagcaaaaattatttcaacaaactttgatattttgcaaggtttgtttaattaaagacaaaattcccatattaatattcgctcaatttcatacattcagagtaagtaaagcacttaatttgaaacttgttttattcgcgtaataccgtgaattcccccagataatcatccacttttccaaaaccttgattattcacaacaggcaaattcataattttttcaaacgaaccagattaagtgtatagacttgctattttgagtaattaatagcattattttgatctttttgaagaaaaaggcgatctttgtcataaaataatgatttaagtgcggttaaaattttggttaattttaagtgcacttctttatacaggagcagattatgtattatggtttagatattggtggcacgaaaatagagcttgccgtattcaatgaagaattagaaaaattatattctgaacgggtgccaacacctaaaaccgactatgaagaatggcttaacacgattgtggatttagtgaatcgtgctgatgaaaagtttggtgaagtgggcaccgtaggtttgggcgtacctggttttgttaatcaacaaactggattagccgaaattaccaatattcgtgtggcagataataaaccgattttacgcgatttgtctgtgcgtttaggccgtgaagtgcgggcagaaaatgatgcaaattgttttgcattatctgaagcgtgggatacggaaaatcagcaatatccgactgtacttggtttaattcttggaactggttttggtggcggctttgtcttaaatggtaaagttcattcaggtcaagtgggaatggcgggagagcttggtcatttacaactaaattatcatgccttgaaattattgggatgggataacgcccctatttatcaatgtggttgtggcaacaaggcttgtttggataattatttgtctggtcgcggttttgaaatgctttatcgagatttgaaaggcgaaacattatctgctcgtgaaattattgatttgttctatcaaggcaatgaaagtgcggtagattttgtgaatctttttgttgagttggcggcgatttctattggcaatatcattacggcatttgatcctcatatgattgtactcggcggtggattatctaattttgattacctttatgaggctttaccaaaagcattaccgcctcacttgatgcggacagcaaaagttccaccaattaaaaaagcgaaacacggcgattctggtggtgtgcgtggcgcggcagcgttgtttttaaccaaataattcaacaaactagtggggcgtattcaaataatatgccctttgtttttgaaaaatatttagaatattctaaatttattagattttttcttttttgtttttcttttctttagagaaattattaaaaaatctcgccttttcattgaaaaaccatacaatcaaattatttatcgcttgagggatgattatggactttgaattttcaaaaatgttagaagaagtgctaacttggatagtcgcacaccttgacgggcctttatgggatgtcacaattattattttgcttgggactggtctattttttaccattacaacaggatttgtgcagttccgtttattcccagcaagtcttcgtgaaatgtggtttggtcgtgcggtggagggtagttcgttaacacctttccaagcatttacgacaggtcttgcgagccgcgttggtgtgggtaacattggtggggttgcaacggcaatcgccttgggaggcgaaggcgcagtgttttggatgtgggtaacggcatttattggtatgtcgagtgctttcgctgaatctacccttgctcaattatttaaaattcaagataaagatggatcattccgcggtggccctgcttattatattgttcaaggtttaaaatcacgttgtatggcagtggcttttgcacttgcattaatttttacatttggttttgcctttaattctgtgcaggcaaactctattgttgaagcaacgagtaatgcgtggaattggaaaggggaatatgtcggtatttcattagtaatttttaccgcacttattattttcggtggcgttaagcgtattgcgattatttcgagcaaccttgtaccaatgatggcacttttctatttgattatagcagtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcggggatgggatctgcgcctaattcggctgcagcagctcacgttaagcatccagttagccaaggtttagtgcaaatgctcggtgtgtttgttgatacaatgatcgtttgtacttgtactgccgttattattttgctttcgaataattatggtagcgaaacgctcaaaagtatctcacttacgcaaaatgctttgcaataccacataggtgaatttggggtgcttttctggcgtttttcttatgggtaccgagtccgaattggtatacca

SEQ ID NO: 557 - DNA, 8845 bp, H. influenzae
ttctttcttttatcgtttttcctaatttttcacggtaaacaggttaaaattttactcacaataaatatccgtatgcgacttcttattttaatccttctttctgtattagtattgtttcaatataatttttggtttggcagtaacggttttttagattatcgtcaaaatgctgagaaaattaaggaaaatcaagcagaaaatgaaaagctatctcaacgtaatcagcgtattaatgcagaaattcaaggattaacaaaaggttttgaagcgatcgaagaacgcgcacgaatgcaacatggcttagtgaaagaaaatgaagtgttctatcatattgtaaaagagagtaaataatgactcgttcaattattgcggtcttgcccgcggctggtgttggttcacggatgcaagcggataaaccgaaacaatatttaacgctgcttggcaaaacactgcttgaacatacactcgatgtgatgctttcttatcctgctgtatctaaaattatcttggcggtaagcaaagatgatccttatatttctacactatcgctcgatcctaaaattcagttagtggaaggtggcacaacgcgagctgaatctgtcttaaatggtttaaatgcaattgcggaaaaaaatgcctgggtgcttgttcatgatgctgcccgcccttgtttacaacatgctgatattgataaattgttagctattgaagataaacaaggtgcgattttggcaatcccagtaacagatacgattaaacgagcggacaatcagcaatgtattgtaaaaacagaagatcgtagccagctttggcaagcaatgacaccgcagtttttcccagtagatatattaagagatgcgctttccacaggaattcaacaaggtgcgaatataacagatgaagcatcagcgatagaacttgctggatttagaccgcacttagtggctggacgtagcgataatttaaaagtgactcgtccagaagatttagcattagcagaattttatttaacaaggaataaattatgatcagaattggacacggctttgatgttcacgcttttggcgaagatcgaccattaattattggtggtgtagaagtgccttatcatacgggctttattgcgcactcagatggagatgtggcattacacgcattaactgatgcaatcttaggggctgcagctttaggcgatattggaaaacttttccccgataccgatatgcaatataaaaatgcggatagtcgaggtttactgcgtgaagcgtttcgccaagtacaagaaaagggatataaaataggtaatgttgatattaccatcatcgctcaagcacctaaaatgcgcccacatattgatgcaatgcgtgccaaaatagctgaagatatcctatgtgatattgagcaagttaatgtaaaagcaacgactaccgaaaaattaggctttacaggaagacaagaggggattgcttgtgaagccgttgctcttttaattcgacaataatttactattcttatattcttaaaagtgcggtgcaatttgaaaagaatttcatcgcatttttattagtgaaataataagcgattgctcgttattattaagtgaccattggtgaaaggagacgcccatttatgggtgagggagcaatggagggcttcagtccgcctttttgcttaccaaccttgttgaatatatggttcattattaattgatggaatttatacgctttaacgagaatattccattaactaaaccatttaataaaacaaatgtaaaacagtgagcttattgccaacttagattttcttattatacatttaaccaaaacgtcacaggcccatcatttgttaagctcacttgcatatccgctgcaaattgccctgttgaaacaggtaatttctctgcgcacttttggataaagtattcatataattcattagccaatgctggggacgcaccttttgaaaaactcgggcgtaaacctttttgcgtatccgctgctaatgtaaattgcgaaacgataagtaattccccctgcgcttgttgaacatttaaattcatcttgtcattttcatcactgaaaattcgataattaagcactttttcagcgagtttatccgctttttctcggttatcttctttttctacaccaagcaaaactaacaaacctttgccaattttccctattgtttcgccctttacattcacttttgcttgagacacacgctgaattagggcgatcatttcaatccctcaataaaactcggtaaccattcttcagcataactttcttgatcatccacgtttaacacgtcaatttttaaagtctcacaaatttttaccgcactttttgcttgaagtgtttgctccactttgtccgctgcatagcaaaaagtatcataatcagaactacctaatccaacgaccgcaaagcgaacatctgaaaaatccttttggctattcgctaattcatcaaataggggttttaaattgtctggcaattcgcctgcaccgtgcgttgaagtgacaatcagccaaattttctcgttttcaatgtcagataaatttggtccgtgaaaaagtgcggtggaaaaaccttgagtttctaaaacatcgtttaaatgctcggcaacatattccgccccacctaaagtgctgcctgaaagaatacaaatgtgcattttattatcctatatttattttcttctcaaagagaaaagaaaattattgaaatgattaataataaaaaggcttagaaaatctaagccttttattacgattaaacgttatcaaacttaccaagtaatgaacgaatatgctcttgccagttacgatgttcgtttttcagctgttcattttcagtttgtaagttttcgatatttctttgagattctgcgtttttctcttttaattcttcaacttctaattgaagtaattggatagtttctaccgcttgtttaattttttcttcaagctggtctaaaatttctaaagacataatgatttccttttaaatatgggtaagtttaggggtattttacccagtaaatttacctttttaaagcattgaataaaaatttattatgcaaacgattactcagtgatagaatgatgctatttttgccataatcttgaaaaataagcagaaggagaataataatgaatcgagcattagccattgaattttcacgagtaacagaagcagccgctctagcagcttacacgtggcttggtcgaggagataaaaatgcggcagacgatgcagcggtaaaagcgatgcgttatatgctgaatttgattcatatggacgctgaaatcgttataggagagggcgaaattgatgaagccccaatgctttatattggcgaaaaagtcggttctggcttaggggaattagtttctatcgcagtagatcctattgatggtacacgtatgaccgcaatggggcaatctaatgctatttctgtcttggctgcaggtggcaaaaatacctttttaaaagcacctgatatgtatatggaaaaattagtggtgggttcaaatgtaaaaggcatcattgatttaaatttaccactggaacaaaatcttcgccgcatcgcatctaagctaggaaaatccctttctgaccttaccgtaatggtattagcaaaaccacgtcacgatgccgtaattaaacaaatacataacttgggcgcgaaagtattggcaattcctgatggcgatgtggcaggttccgtattgtgttgtttacctgatgctgaagtcgatcttctttatggaattggtggtgcgccagaaggcgtggcagctgctgcagccattcgagcattaggtggcgatatgcaagctcgtttaatcccacgcaatgaagtaaaaggcgacaccgaagaaaataaaaaaattgcagctaatgagattcaacgctgtgcagcactgggcataaaagtgaatgaagtgttaaaacttgaagatctcgtgcgtgatgacaatcttgtatttactgcaacaggcattaccaatggcgatttgcttaaaggtatctcccgcaaaggcaatttagccagtactgaaaccattttaattcgaggaaaatcccgcacaattcgtaaaattcaatctattcattatttggatgacctttataaaattttgaatatttagctcaaacaaacaacatttcaattaatttaatctgctctccaaaaagctgaacaaatgacttactaaacagggagcagattttaaaatgtcatttttaaataattaaatcattttttctcaaaaaaatatcaaaaaagatattctaaaaacaaatatattcatatatgatataaaaaatattttattaaaataaaagtatcaaatatgaataaccttagtgcgcaattagaaaatcaaattgatgaattaaaaaagcttcagaaatctgtcattacctatgagcaatcgcaaagacaacagctttacgcaggaaaaattaccgatctcaaagcctttggaaaaatgctcaatgataagcgtaaatcacttggtattgagcttagtatgctagaactgcaaactggcgtgtctatttctaccttgaatcgcttatttcaagatccaagccaagttcgatttacaaccgtgtttcttgttgctaaaacattaggggtttcactatgcgcgatttagtccgctcgggcaaagtatttctctacggcgaatttattggcttacttagagaagatcatcgaggttttcattttgcttacaatcccgattatcaaggaataccgctctctctcagctttcctattgagcaaagtccttttcattctgacaccttattcccttattttgcatccctcgtcccagaaggctggctaaaacacaaatatgcacttcatcaacgaattgatgaaagcgatatgtttcgctttttacttaataacggggaaaatatgttaggcgcagtgcaaattcaggaagaaaaacaatgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagcaaggtacggaaaaataggtgcagataatgagcaatatgtgagttatgaacaaattgctaagtttattttgcagcacactgaaaaatcatttagctcagcaacgagaaatttttcgtcgaatatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaactataaaatccaaagggaattttcaccgcactttttctctccaacaaaaaaatcgcacctttaacagtgcgattttttcttatattaatttaggacattctgccgttttctataccaattacctgatcgcaaatagccatggtagattggcgatggctgacgagaataatcaatttctcagctttagcatcgagtaatgatttcaaaatcattgcttcgtttaagctatccaaattactggttggctcatcaagcaagataatcggtgcattatgcaagaatgctcgggcaataccgatacgttgtttttcaccgtcagagagattgccgcccaattcggtcatttttgtttgataaccttgtggcaaactcaaaataaaatcatgaattgaggctttcttcgccgcttccataatttcttctaaggttgcatcacggcgcgcaaggcgaatattttcttcaatgggtttcgttgaaatataggtttgctgagtaatgtacgccatattgtcacgcaactgcaagtgttgtattggtaaggtttcggcggtaattttaatgctacctgattttggatcataaaaacgcatcagcaatttcaataaggtacttttaccgctgccgcttctgccgtgaatacctaaaatttcgccttttttcacagataagctgacatccgataaaatttgttcttcgccgtaagcgaagtttaggttctctacatcaatgcgagaaacatcttttaaatctaccgcactttctacatcttttaactctggctcttccgctaataaacttaatactcgttcgccagaagccaaagtttgtaataagttgcttgaaaggttacttaaggcgataactggcccatagctcgacattaataaaataacgccgattaaaaaggcagcgaaatcaattttatctaagctaaacaaaattaagccagtaaacagcataatgatgttgaaaacagatactgccacttcagtataaacacgaactttcgcttcttggtctttaatgcgttcaaaggcggtatcaattttttggctacgttgttggatttctgctaaacgttgttgtgcatagccaaaaagctgaatttctttcataccacgcacgctgtcaaggaagaaatcattcatttcgccgactaattcacgatagcgtctgccatcttcacgagccaatttggtggtgataatcggtaaaatcacacctaccgttaaataagcggctaatgcgacaactacaaaccaacctgaaagatgggcaaagaccaacaatagaatcgcagaggtaaagaacgcaatcataattggtgcaatggtgtgtgcataaaatacttcgagcaattcaatatcattggttactaatgacactaattgccctgcttgtttatcttgcaacttcacaaaagccaaacgacgcaaagaagaaaacactttgtcacgcaataatgcgagtaatttaaaagcaatataatgcccagacatttgctctaaataacgcaatacaccacgagccaccgctaatacgataagtgcggtcaaaatgccagaaaaacttaaatgggtgtcaaagtttaagagatttactaaccccattgcaccaaacaccataataaagatggcagcaaggaaaccgagcgtccccatagtaatggtaaacgccataatgtgtgcaagtggagtcactaatttcaacaaatgccccattacaacaaaaccatttttacgcatttgccacctctctaatttgttctaaatctttttgttgttggaacatttcagcatacgcaccttgttttgccattaagctttcgtgtgtgccttgctcaatcaatttgccttggtcaagcacattaatacagtccgcattcacagcatttgccaaacggtgagaaatcatcacaatggttttttgttgtttaaattgttgaataaactgcaaaataatttcttcgctttccacatcaatattactggtcgcttcatcaaaaatataaagctcggcattgtgtaacaaagcacgcgctaaagctaaacgttgaatttgaccgcccgataaattcgcacctcggcttaatagctgcatatctaagccgccattttcgcgtacaaattgggcgagattcacttgttctaaacaagcataaatttgttcatctgtggcatcaattttcgccatcgtcatattttcacgcagcgagcctttaaacacataactgctgtggcttactaatgatactttttgatagaaagaagtgcggtcaatattgagggcgttttgtccattaaacaaaatctcaccttgttgcgcttgattaaaacccatcaacaacgaaactaaggtcgatttaccgcaaccacttttacccacaaataccgtaagctgatttggtaaaatactcaaatctaaacctgtaattgctgatttttcttcactataagaaaaatgcagatctttaatttccacttgaacgttattttttgcttcaaaatccaccgcactttgttgggtttccactggcgtatctaacaatgtgaaaatcttatctgaagccgctttgccattcatcgccacatggaagaatgaaccaagcaaacgaagcggaataaagaactcggaggaaagtagaataaataaaatcacgcctaacacgctgagttgtgcattttggaattgcaatagtgcggttaaaatcccgatagctgcgccaccataagcgagtaaatccatcagtgaaaccgagttaagctgcatagtaagcactttcatggtaattttgcggaaatgctcagcctctttatccatcgctttcgctttataaccatcaa

SEQ ID NO: 558 - DNA, 9091 bp, H. influenzae
  misc_feature (991)..(991): n is a, c, g, or t
  misc_feature (1111)..(1111): n is a, c, g, or t
  misc_feature (9038)..(9038): n is a, c, g, or t
  misc_feature (9067)..(9067): n is a, c, g, or t
ccagctgttagccacaaattatgttttttaaaaaaagtgtttctattggaccactagtcagagagccatatgctgttttgcccagcggaaaaaaatgaaaaaattggggttgtaaaattatttacaacaatcggtcctattaaaccgtagggctttcggtcttgtgtaaaggaaaagcaaaaacatattccgatcttgcccttccgattatctatgaggagcctttagatttttagctcgtgccagattaaagaaagctttttctgaatcagatttcccgtggcgcgtagatcttctaaattgggctacaacgagcgaagattttagggaaattatccgtacagtttatgttgttattcaggaaaaagaaaaaacggtcgaaaaaccgaccgctctttagacaaaatataaattaagccgccaccattaccatcgctgggcgaatgactcgaccacttaaggtgtagcctttttgcaatacgacgctaatttgattggtttcaaagccttcagctggttgcattgaaatggcttgatgtaaatcaggattaaaggcttcaccgacaactcccacagcttccacgccaaaacgcccaacggttgaaactaattcttttaaggttagttctacaccgtcaaataaggcttttacgctttcatcttctttatttgctggagtggcaagcgcacgctctaggttatcgatagtattcaaaatgtcttttgaaaatttttccaaagcgaatttatgtgctttttctacgtcttgttcagtacgacgacgaagattttcaatttcagcacgagagcgaagtaaaatatcctgttctttgtttgccgcttcttctatttgagtttttagctgctcttcaagctcttgcacgcgagcaattgcttcttctaaaggatcaaattcttgagaaggatctgcttgttgtgcttcttccacaacgacttcttcttgattttctacttctggggatttcaactnttttgttctttgttctgacattttttttctccgtaaaacaaaattgattaatcgtaattgggcatagtgtagcaaaaaacgatataatgacgaaaatgttaaattcaagtgcggtcattntatgaatcatttatatcgttcctttaaaaccattgctcttgtaggtaagcctcgcaatgatattaacttacaaatgcacaaaaacttatttcattggttaatggaacgtggttatcaagtgttggtggaaaaagaagtcgccataacacttgagttaccttttgaacatcttgctacgttagaagaaataggccaccgagcccaattagccattgtgattggtggagacggcaatatgctagggcgcgctcgggtattagcaaaatatgatattccattgattggtattaatcgtggtaatttgggatttttaacggatattgacccgaaaaatgcctattcccagcttgaagcttgtttagaacgtggcgaattttttgtggaagaacgttttttattggaagcaaaaatcgaacgagcaagtgaaatcgtatcaaccagcaatgcggtaaatgaagcggttattcatcccgccaaaattgcacatatgattgactttcacgtatatatcaatgataagtttgcattttctcaacgttctgatggattaattgtttctactccaacaggttctacggcttattctctttccgctggtggacctattttgacaccaaaccttaatgccattgcattagtgccaatgtttccacataaattaacttctcgccctcttgttgttgatggggatagtaaaatatcgattcgttttgctgaacataatacctctcaattagaagtgggctgtgatagtcaaattaccttaccttttaccccagatgatgtggtgcatattcaaaaaagcgagcataaactccgattgcttcatctgaaaaattataattattacaatgtgttaagtagcaaattaggttggttaaaatcattttgattatggtaaaaattttcgattgaaatagatttgacaaaatactgtaaaaaatcctttactgtaaattaaatcagttatatcatattaaatatacagttaaaggattttgctatgcttactcaacttactatcaataattttgcgattgttcgtcagcttgatattgaattggcgaaaggaatgtctgttataacaggggaaactggtgctggaaaatctatcgccattgatgctttaggtttatgtttcggacaaagagtagaaacctcaatggtgcgtgaagggcaagagcgtgcggaaatttgtgcaactttccaactagaatcgcaaaatcctgcttatcactggttgagtgagcaagaattacaggatccagataatccaactgaatgtattttacgtcgtataattaatgcagacggacgttctaaggcttttattaatagtacaccagtatccgcttctcaattaaaagaaattgctcaatatctcgttcatattaatgggcaacacgcttctcaattattgttaaaaaatgactatcagcttcagttagttgataattttgccgctcatcctgaattacttgtgaaaatgcgtgaagattatcagacatggaaaaatcttcaaaatcaagttaaaacctttcaacaaaaagtggcggaaaatgaagcacgtaaacaacttttacagtatcaagtggatgagttagatgaatttaaccttcgaccaaatgaatatttggaattagaagatgaacaacgtcgtttatctagcagcgaacagctaacccaactttctcaatcggccctgcaaattttaagtgaaaatgacaccgtaaatatcgatagtttgctttatcgtgcgacacaatatattgatgaattagctgaacttgatccgcaatatgctgaagtgcaaaatatgttgaatgatgcgttgattcaagtgcaagaagcaaccagtgaagtgcaaaatttatcaagtaatatcgagcaggatcctcaacttttacaggaaatcgaacagcgaattagtcaggctttacaacttgctcgtaaacatcaagttaaacctgaagatcttgtagaacagcacaaaaaattaaaagcggaattaaccgcacttttggatttttctgaaagtgaagagatgttgattgagcaagaaaaacgagcatttgaacaaatgcaagcaacggctacagcattaacagcaagtcgtcagcaatctgcaacccgcttagcgcaaaatgtcacacagtcgataaaacaacttgcaatggaaaacgctgaattttatgtagagttgaatacggatttagataaagtgagtgcaaatggtgcggataatgtgattttcactttgcgtagtaatttaggacaacaaccgcagccattagctaaaattgcctctggtggtgagctttctcgtatttctttagcgattcaagttttaacttctgatcaatcggctattccaacgttaattttcgatgaagtggacgtgggcattagcggaaaaacagcaagtgttgtcggaaaacttttacgtcaattaagtgaacgctgccaagtattatgcgtaacgcacttgccacaggttgcttgtcatggccatcatcagttcaatgtagaaaaatttactgttgataataaaactgaaacaaaatgaccgcactttcacaagctgaacgtgtaccagccttggcaagactcttgggcggaagtgaaatcacagaattagctctagccaatgcacaggaaatgttagatttggttcattaaaaataggattgaatatttagtttttgcgaggtttcaagaagatttgtgatgaaggctatttttgaaacgtccacaagccatattttaggatacaaataacctatcccaaaatgcttgaataaatgaccgctctttgacaaattcagtttcatccacaacgggggatttgcctatcaaatttaaatggtgaatagcattgcgtaaatcaacataacattgttttaatgtgtcgcagtctgtttggctaataattttagcctctgctatatcatcgaaaatacgaacattgtctgaccattttgttagttgtggttttttcggggcattggcaagcattaaatattgagcaataaattctatatctgtaatgccaccgcgatctgttttaaggttaaattcactgtgttttgagtgagataaatgggcaaacatttttttccgcatctcaacaacatcttgttttaattgttcaatatctcgtgatgcagaaagcacttgttggcggatatgctcaaatttagctttaagagatgattcgccaaatactggacgagcgcgcacaagtgcttgtttttcccatgtccaagcgtcattcaattgataatgggaaaatgcagaaagagagcagccaattaagccagcatcgccagaagggcgcaggcgcatatctgcctcataaagtacgccagcggaagtatttatgctgaaaatactcacaatcttttgtgccaagcgtaggtaaaattgattgctatcaatcactttcttgccacctgttgtttgattttctacggcatcgtacaaaaatacgaggtctaaatcggatttataaccgagttcaataccaccaagttttccataaccaataactaaaaatcctttttcattattttgtaaatgttcaggcacgccaaatctagaagacacttgtttccaagctagattcacaaccacttcaataatggattcagcaagataggttaaatgatcgcttactttcattactggtaatgcgcctaaaatatctgccgctgccacttttaatagggttgcttgtttaaattgacgtaaagcatcgataatctgttcttcatcatcagggggtaaacgaagcaaatattggtgtaactctgcaggatattgggtaaatggcaatggatgacgtagtgcttccgtattaagcaattcatctaataaaataggatagcgagccaattgttctgaaataagttgagactgtgcacaaagttcaataacttgctgaagtgcgcgaggattttccaataataattctaaataagtcgtgcgactcgaaattttttcaataatgttcagtattcgggggagcaaagtgcggtaattttcttgttcaaaaatgagtgcaagtactgttggcatcaaatgactcaaaacatcacgcccacgcgacccaatcactctgtgatttaggccgtctttgaattgagcaagcttttctaaaacttcatcaatattattttctgatacaccactctctaataatgtttgttcaatatcctcaaaatctgcttctaaaaaatcttgccattggctatcagtttgtgaaggctcatcttgttcatcaccgattaattgagtaaatactgcccgcactttttcttgtttttgttgtaaagtgcggtaaaaatcgtcccaattttctattggataatgtttttcaatggtttgattattttcatttaaacaggtgaaagttttacatgccttgactaaacgaatttgatctatttcatcggttggtagtgtttgcgtttgttgatcgttaatggcttgtagaatgttttctacgcggcgtaaaaaaatataactttcacgtaaatcgtggaattgttgttcggtaattaatcctagtttggtaatttcaggcaagatctttaagagtgaatgttgttgcagattgatttctcgcccgcctcgaatgagttgaaaaacttgtacgataaattcgacttcacgaataccaccagcacctagtttaatattatctttcaaaccacgacggcgtacttctcgctcaattttgcctttcatttcacgtaaagattgaatcacactaaagtcaatatagcgacgatacacaaaggggcgtaacattttttgcaatttagatacgttgggatcctttgtttgtacgcccaatactcgccctttaatcattgcatagcgttcccaatctcgaccttgatcttgataatattgttccattgctgcaaagctgagaacaagcgcgccgctgtcaccaaatgggcgcaagcgcatatcggttcgatacacaaaaccatcagaggtaaattcatctaaggcagaaataaggcgttgccctaaacgtgtaaaaaattttccattatccacagaacgtcgagcattcgtattttcaatagatgtttccccttgtgatggataagtgaaaattaaatcaatatccgaggaaaaatttagttcaaagccgcctagtttccccattcctaggatataaagctgctgcggattgccttgttcatccattggtgtgcctatctccgcacaggcttgatgataaagccaatcgcgggcagcgataattaaactctctgcaagttgtgaaagctgaacaaaaatttcctcaacagtcgcaagattcaaactttgacaaaaacttaattttgccatttcaatgttacggaattgacgtaatgtttgatagagtgcagtttcgtcatgtacattggctaactctctattcaaacgttcaatataggcagtgcaatctgcaaaacagggggatttttcccaccattgtttcactaagtgcgggtatttttgcaagactttttccacaaagtcagacattgctatggcatagcctaattgataaacaggcagttctggatgatttgaattttgttgaatagcttcgtgaattttttctggggaaagctctggaaaagattggcacaggattgtgccaagagattgtaatttttgttcaatgagggcagaaagtgcggtcattttttctaacctttttgataggaatctaagtgacgtaatacggtttctttcgcttgttgaggttgcaaactatctagccattgtattggtgttttccagccgcgcagccaagtgagctggcgttttgcaagttggcgcgttgcacaaataccacggaaaatcatttcctcgtgatcgtaatcgccttgcaaatattcccacatctgacggtagcctacacagcgaattgacggcagattaatatttaaatcgccacgtgcataaagtttttccacttctgcttgaaagcctagttcaatcattttatgaaagcgttgttcgatgcgttcatgcaaaacatggcgatcttgcggcgcaattgcaaattgcacaaaatcataaggcaaggcttcgcctttttcttcagtcagctctgtgagtgattttcccgtgatataaaaaacctctaaagcacgattgattcgttgagaatcactgggattaattcgggcggcagaaatgggatcgattttggcgagttctgtatgcaatgctgcccaaccttgttgagctgctttttgttcaagctcggcacgaatattttcatcagcagaaggcaagggagaaagcccttcaattaaggctttgtaatacaacatcgtaccacccactagtaacgggattttgccttgtgcggtaatatccgccatttcgcgtagcgcatcatcgcggaaattcattgcggaatagctttctgatggatctaaaatatcaatcaaacggtgaggcgcaagagcaagttcttcttttgatggtttcgctgtgccaatatccattcctttataaatgagcgctgaatctacactaatcacttcaactggaagcgagcttcgtagttgaatagctaaatccgttttgcctgaggccgtagggcccattaaaaaaattgcggttggtttcatgaagaatctaaatttcgtctaataaaggctgccaattaacaggtttgagtaattgggtgaatgccgtgcgattcgtttgcgtgagtaaacgttctgtatcgcttaataaattgagtgcgtccgctaaagcgtcaaaggttttacattctaattgtgcgcaaagtgcggttaaaaatggtgatgaattttcatctctagtcagcattgccatcaggcatttttgtagattttgtgtgcgtaacacatttggcactttatttaaggttaagcgtaattgtgcttgattttcgataaattcaaagccaatttttttgaagttatctgaatattgttgccatgcttgaaattgtgcctctgttaaacgaaatacgattggaatcaacaatggttgttgttcaatctgtatttgttgtaaagccaattgccattgcaagcgttgtaatttttccaatgaaagcaaaaagaaatcttggttctgttgtaataagagcgcgcgattttcaataagtgaaagggtacgcagatgtgatgagcactcaattatttcagttgagatgattttagctgtatctgaaatattttgttgtgctgtatccgatatatccttttgcgctgtaggcggtaacgtgcgtaacaattcagcatataaacgttgctcagttttactcggtgcatcagaacggtaatctcgataaccagtacttacatgatttggcaacactggtgtgttagaaaagtgcggttgattttgctgtggtttttcataatattttggcgcaaagctattttgccccgcagctgcacgattaggacgaatgctataattcggttggggctcacgcactgtattttcttcgtgattttctaccgcactttggtctgtgtgccaattaagctgttcttgattgtttagtgcataacttatgccttcgtaaataaaatcatgaatgaggcgttgttgatgaaagcgtacttcatgtttggttggatgaacattgacatctacatcgtgcgggtttaaatcaataaacaacacaaacgcaggataagcatcggttggtaaatattgagcataggcttgtcgaatcgcatggctgatcactttatctcgaaccattcggccattaatatagcaataacttaaatcattttgagttcggctaaaatttggtgtcgccacccaacctgataaatgtaaatcatcgtgtttccaatcaattcgtaaggcatttttgacaaaatcatccccacaaatcgcggcgacacgttttagttgngattgattgttcggggggtgctatagagngacctgcaggcatgcaagtctggc

SEQ ID NO: 559 - DNA, 8832 bp, H. influenzae
  misc_feature (8633)..(8633): n is a, c, g, or t
tttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaatggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataattaattctttatttttccttatatttgaaacttaaaatccaggattgatcgttatctcaaaccctgttacttgcggaaattcttcttgaattagtgttaataattcaatttgtttaaatagaatcccctgccgaacaatagcattagacacttcaataaaaattaaatgatctgttatgttgccaatacgaaatttgccgtgaaattcctgtggaaaaatgcggttaaatttttgattaagttcattgatggcaagaccttttttgattattttggcaaagggcgattgctcaagcacatccataatattgactgctttttgataacgatcagccttgttttccataaagtcagcccccagtaaatgacatcagtttagatttccgctacaatacacgcaattttcataataaacaatgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgattttttaccgcacttttttcatacctctacattagatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaacttacgtttctgcagctgcagcagcggntaaagaaagtcgtggtaacgaagctcaagttgctgaagaattagcagctgacgcagataatttaagttttgcataaggcgaagcctttataatcaagcgataaattgcatagggcctaaaattagcccctatattttatctaaagaggcggcaaaaaaaccgcattttgacagaggatttaaaaatggctgaaatccag

SEQ ID NO: 560 - DNA, 8894 bp, H. influenzae
  misc_feature (2222)..(2222): n is a, c, g, or t
atccccttgcatcagaatttcgttatcgcaaatttgttacccgtccaaatagcttattgattaccctttctcaatctggcgaaacagccgatactttagctgcacttcgtttagcgaaagaaaagggctacatggcagcattaacaatttgtaatgttgctggctcttcgctcgtacgcgaatcatatcttgcatttatgactcgtgctggtgttgaagttggggtggcatcgacaaaagcatttacgacacagctcgctgcattattaatgctggtaacggcacttggtaaagttaaaggtcatatttctgtagaaaaagaacgtgaaattattaaagcaatgcaatctttacctgctgaaattgaaaaagcgttagcctttgatagagaaattgaagctttagcagaggattttgctgaaaaacatcatgcgcttttcttaggccgtggtgcgttttatccaattgcggtagaggcttctttgaaattgaaagagatttcttatattcacgctgaggcctatgcggcaggagaattgaaacacgggccattagcgttaattgatgctgatatgccagtgattgtcgttgcaccaaataatgaattattagaaaaagtaaaatcgaacattgaggaagtgcgagctcgtggtggtcaattatacgtatttgccgataaagaagcaggatttacgccaagtgaaggaatgaaaatcatcacgatgccaaaagtcaatgatattgttgcaccgattttttataccattccaatgcaattactttcttattatgtggctttaattaaaggcactgatgtagatcaacctcgtaacttagcaaaatcagttaccgttgaataaagtgcggttgattttaatgtaataaaaaaaacggtgaaatttcaccgtatttttttagttaaataatcttctttgtttccgtgttttaatcacttgtgcgattaacaataatgtgagaataaccacatatagtgaaaaaataaccactagccattgcaccatcgttaaaccaaataatgaccattggctttcattacaagagccagttgggttaaatataaatggaaaccattgatgaaatggtaaagtctcgggaaaatttggaataaactcacattgtttccaaggagctggattcatttgcaaatcaagatgacgaaatgaaatcaataagcccttaatactgctgaataaacctaaagccaaggcgattaatcgaagtatgaaagcaagaggttgaagtaatgcaataatgcccgctacaaataagccaatcattgctaaacgttcataaacacagagcacacaaggttgtaagcccattccatattggaagtaaagtgcggtggattctaaggctaaacttgaaaaagccaataaaaaccacacaaaacgtttttcggaaaattgttttaatagcgcgagcattttttctccttaaattggcaaaattaaacctaaacttgctaaccaaattgtggcagctggtaaaataaattcaatagccagtaaaccaatgattgaaagtacaatcgtgtaaggtaaagccatataaaccattctgccataagaaaggcgaattaatggcgaaattgatgaagtcaataagaataagaaagcagcttgcccatttggtgttgcaactgatggtaagtttgtacctgtattaatggcaacagaaagcaattcaaattgatgcggtgcaattactccatttgtcagtgcagctttagcttcattaatataaaccgttgcaacaaatacattatcagaaatagaagaaagcaagccattaaacaaatagaataaagcaagttgtgtattttcttccgcagaaagaacgaagtgaataattggtgaaaaaagtttttgatcaataattactgcaacaacagaaaagaatacaacgagcaatgcagtaaagggtaaagattcctgaaaggctttaccgatagtatgttcatccgtcacaccagtgaaagacgtagcaaaaatgatgatacttaaaccaattaaaccgactgcggcaagatggaatgctaatccaagaattaaccaaattgcgattaacgcttgcatacctaatttaattttatcttgtttagacattttttctgaattagtgcgatctaagtctgataagactttccacacttcgtctggtaatttctcgccataaccaaataatttgaatttttcganccaagaaacaagtgagtaatccgcagataaacacaggaatagtcacgggtgccatactggaggaaaaattccataaagttccattttgcttgttctgcaataattaagttttgtggttctccaacaacggtcattacaccaccgagtgcagttcctacacccgcatgcatcattaaactacgtaagaatgcacggaatttttctaagatttcgtgctgttgttcaataatttttctatcgtctgaaatatcaaccgcatcaattaaattattgcctgatgcaactttgtgatacacaccataaaatcccattgcgacactaatgataacagcaacaaccgttaaagcatcgagaaaagccgataaaaaagcagcactaaaacaaaaggcaatagaaagtgcaattttagaacgaattttgacaagtaatttagtaaatacataaagcagtaattgtttcataaagaaaatacctgccaccataaatatcagtagcaagatcacttcaaagtttgccataatttctgctttgacgtgtttggcatttgtcattccaataataatagcttcaattgctaatagaccacctggttgaagagggtagcattttaatgccattgccaatgtgaaaataaattctgcaaccagtaaccaacccgcaataaaaggactaataaaaaagaaaacaattggatttataataagaaaaaccacaatggcaagtttgtaccattctggacttgccccaagaaagtttttcataaaagcctgaatgtttgtcatagtgaactccattatttttatcacgcgaacattgtaatatatccccctttaaaggataataaaaaccaagtaatttttttataaaattgcattttttttgatttttatctgatttttaattgtaatgcaaaacaataacgacattttaaaagcccaaagtccagcagctttagcagaggaatatattgtaaagagtatttggcaagatgtttttccttcgggcagtaatttgccatcagaacgtgatttagccgataagattggtgtaactcgcaccaccctacgtgaagttttacaacgtttggctcgtgatggttggctaacaattcagcacggcaaacccaccaaagtaaataatatttgggatgctgcagggccgaatattattgaaaccctaattgctttggatatgcagtccgcgcccttaattattgataatatgctctctttacgtagtaaaatgtcggaatcttacatttatgaagcagtaaaaaattcccctcaaaaatcaaccgcactttttgctgaattagagcaattacaaaacacagcacaagattacacagaatttgattaccaattatttcgtcaatttactgttgttgccaacaaacccttttatcgtttaattttcaatagtttaaaaggtgtttatcagcgaatagggttgttattttttaaagaaaaaaaacaccgtgaattaacaaagcaattttatttagaaatgcaacaaatttgtcttgagggaaatgcagatgcagtagtggattgcatccgtaaacataatttacgttcttcaacctattggaaagccattttagaacgattgccacaaaatttatcagattaatactggaagcgaatttaagaaaaaaacataaaacttttcttataattacaaaatcattttcaccaatttatctgctttaattcgtgcaaattttttcaaaagtttttgcactggttctgggtattgattcaattcttctaattcagagtaatgttttaatacttttgtatgttggcgaatttggttttgctctttttccacttgggctaaaagctgttgttgtggatcgtaaattaataagccattttctgcatccaaacgccatgctcgagggttaagattattgcccgtcaataaaatataacggtcatctacccacacaccttttaagtggtaggtattatcgccatcacgccataaacgcaccacaagctgaccattttcaatttgagtctcaaatttttcacagaaacggcgaagattactttcataaagataaggtaatgcccccgccattttgaatggttgttctggtggaatgtaaaaatcgtttgcgactttatcgccaacaataatttctacttgtttaccgctttccaataatgttgctattttatgttgcaatgtgcgtgggaaattaaaatatggcgtacaaatcaccaatttttcttgtacttgtaagaataaatcttcaattacttgatttaattcgttgcccgatgcgcctaagccaaacagtggcgatacgcttaaaacattcggtaatttcaccgcactttttaatgaatattctccattttgagcaaggtctttacgataagctcgaatattaccgcggatctctttagtacgagggcggttggtcacatcaagtggataaactgcactgaaatctaacaagtaatcattgatgaaatttaccattgaatcagctaattcggcatgagtgattttttgatagcggtcgtaacgatatttttcaaattgatgaagatagacattattaatacttgcaccgctataaagcaccgtatcatcaaatacaaagcctttgacatgcaatacaccaaaaacttctcgcgtattaattggcacgccaaagaacatattcggatcatcaggtaactgataagtttggcgttgctcgcaataccagtctgcattagtggcagatttttccgcccctaataaattgcgttgtgcacgatgccaatctatgagaatttttacatccaagtgtggattttcttgcttcacgcgataaatttcatcgagaatttcctgtcccgcttcgtctttttgccaataaagtgcggtgacataaatacgtttttttgcgtttctgattaattcaataatttgagttttaaattcagccgagctacccaaaaattcaatttgctcagcttgcaaagcaaggaatggcaaattatttaaattttgttcagctcgtttggttttattgattaacataatccatctcgtgattaaagactagtgcgttagtttacaatatttcacgtgcttattaatagaaaaaaggctttttttcgttataatgctcacaaattttagcattttttggctaaaaaacagccatttttactcagggaaaccctatgaacgacaaacgcaaaccgtcttttcaatccgcaggcaaaacctttcaagaacgctcagtaggtgaaaaatacagagaaaaaccaagccaaaatcgaccgcactttaatgataaatttaatggaaatagaaacgaaaaatctcgttttcctcgtgataaacaagaagtgaaagaaactagaattaagcaactttctttatctcgcgcaccatcaaataaaaatacagaacaacctaaggttcaagtgacaataaaaagtacgggtacggtttataaaacgaaagaaaagaaaactggtgcgctttctcctcgtgcgcctgaaaaaattaagaaaaaccgtgcggaagaaatgaaggtttacggtgaaaatgcctgtttagctttatttgcagagcgtcctgaaagtattgttcgattgtgggcaaccgtgcaaatgtcacacaaaattggcgaggtattgagttatttagccgaaaacaagaaggcttatcacgttgtagatagtgaagaattagcccgagtgagcggaacagaacatcacggtggcatttgcttattggtgaagaaaccgcgtgctttcacgttgcaagggtattttagatagtgtatgattaaaggggaaacgatttcccctttaaaatttcaaataaaagtctttagtcaattcaataaacgcttcagtgtattgattatccgcatcataaattaccaattgatcttgcattaaaacttcgggttgtttggcaaaggtaagcaacattctctggggcgtttttcctattttagtgatgacattcgtctgttttatgcaaaaaagtgcggtggattttgtgagcgttttgcctgcatcataaggcaaaacaaaacttattttcccattttccgacaagcgtgttgcagcccattctaaccaatttaagtggctttgcttggtataacgagccaattctcgttcttcatttttacaagcgataccttgttcaaaataaggtggatttgccacaattaaatcaaaggtttgttcagtggtttgtaaaaaatgttgtatatccgcttgagtaagttgaatgcgatttttccacactgaattattgatgttttcttgtgcttgttttgctgcaatgggatccaactcaaccgcttgaatttgacagttttcttcagttcgttgtgctaacattaaagtcaataatcctgtgccactgcccatatctaaaatatttttacaatgctttacatcagcccaagcacctaacaaaatgccatcagtgccgactttcatggcacaagaatcttgattgatatggaattgtttaaaggtaaatccgctcataaatttttcgtaaattgaccgcactttcaggtataatcctcgacgattttaacaaagaaccgcacaataatgaatttatcccaatttgaacaattcgatctttctccagaacttttaaaggcacttgagaaaaaaggttattcccgcccaacagctattcagatggaagccattcctgccgcaatggaagagcgtgatgtattaggctctgcaccaacgggaacagggaaaaccgctgcttttttattacctgcgctacaacatttattggattatccacgccgtaaaccagggccaccgtgtattttgatattaacaccaacccgagaactggcaatgcaagtggctgaacaagcggaagaattagcgcagttcacccatttaaatattgcgacaattacaggtggtgtggcgtatcaaaatatggtgatgtattcattaccaatcaagatttggtggtggctacgccaggtcgtttattgcaatacattaaggaagaaaattttgattgccgttccgttgaaatgctgatttttgatgaagccgatagaatgttacaaatgggatttgggcaagatgcggaaaaaattgcagctgaaacccgttggcggaaacaaactttgttgttttctgcaaccttagaaggagagttattggtcgattttgcggagcgtttgttgaatgatcctgtgaaagtagatgcggaaccaagtcgccgtgaaagaaaaaaaatcaaccaatggtattatcacgcagacagcaatgaacataaaatcaaattgctcgcgcgttttattgaaactgaaaaagtaacccgtggaattgtatttgttcgccgtcgtgaagatgcgcgtgaagtttctgaaacattgcgtaaacgaggcattcgttccgcatatttagaaggcgaaatggcacaaactcaacgtaacaatgccattgataaattgaaatcaggtattgtgacggtattggttgcaacagatgtggctgcgcgtggtattgatattgatgatgtaagccacgtgatgaattttgatttgccctatagtgcggatacttatttgcatcgaattggacgtaccgcgcgagctggcaaaaaaggcacggcagtctcttttgtcgaagcgcatgattacaagttgctaggtaaaatcaaacgttatactgaggaaattttaaaggcgcgcattttagcaggtttagaacctcgcactaagccaccaaaagatggcgaagtgaaatctgtcagcaaaaaacaaaaggcacgcattaaaaaaaaacgtgaagaaaagaaaaaaacagaggcaaagaaaaaagtaaaattgcgtcataaggatacgaaaaatatcggcaaacgacgcaagccaagtaacagtaatgtttaattaggtatgatttaaattctgttttatatcacactagcaatgtgggtttcttgtattggtattaactaaattacgcattaataaagcgtaatttaagttaatatcttgtggtacatttaagaatacaaaatgcccatcacctagtgctgcatcaaccgtttcatttttacgatttagcattttttcaattttgaaattaatattgccttgtggtgtcatcatttctacattgtcgccaagtaagaatttgttttttactgctacttcagccataccttgttcgttacgtttgcccgtaaattcaccgacaaattgctgacgatcagaaatagaatagccatattcgtagttttggtattcatcgtgcgtatggcgacgtaagaaaccttcggtataaccacgatgcgcaagggattctaacgtatccattaagctttcatcaaatggtttgcctgcggctgcatcatcaatggctttgcggtaaacttgagccgttcttgcacaataataaaatgatttagtacggccttcgatttttaaagaatgcacaccaagtgcggtcagtttttccacatgttgtacggcacgtagatcttttgaattcataaagtaggtgccgtgttcatcttcaaacgctgtcatttgttcgtcaggcttttgtgattcggtataaaggaagactttatctgttactgtgccatcgcctaaggttggtgctacatttttcattcgatttgttgagcaggatcgatttcggc

SEQ ID NO: 561 - DNA, 8390 bp, H. influenzae
  misc_feature (8361)..(8361): n is a, c, g, or t
gcggcccacgtagaaaggtcgaatttacgcgcccaggtaaaacgcgagttttttttcaagtttttctttgggagcgggaagcataatattttatctttatgctgcctgctgtacccctggaatacgagtgagtagtttatccccaagagcttgtttagttgattcaagcggttcagcacgcctgaattaaacaagctttagaacgataaatcacgtccacttcttttaagccatttgcttcaagcgttgcccctgatgatactaaatcgcaaatcgcataagcaatacccgcactaggtgcgacttctactgaaccatttaataaacaacttttaaacgacaccccattctcattcatataacgtttgagcaaatgcgggtaagaagttgcaatacgcctattagcaagatctttcacattctcataatgacaatcgcgatcaaccgcaagtgatagacgacaatcaccaaaatcaagttggcgaagttttttgtatgtaactgtttcatttgctgcacggcgaccaagctcttcctcttctaacacattttcgccaataatcccaagatccactacgccatcaaaaatcaatccaggaatatcatcatcacgtacgcgaagaatttcaatcggcaaattttccgcataagcgattaaacgttgttcattccaattaattttcacgccacattgtttaagtaatatggcacaatcctggcttaaacgcccttttttttgcaaagcaatacgaaggcggtttggttgcattgttgtgtttgtcataatgtttttcctattttaaagttgagataaaagaaaacccctcgaaaattgccttccgagggggtatttattgcttttacactgatttttattacactcggaagatattttattatcttccaaacatacaatcacgcctgaaagataatcaggtgtggtgatgatggtaagtgcagataaaattcatattgtatatgctcgctcaaatgttattagattttatattgccttaaaaatacactttaaaattaaaaaaagcaatttttttgaaaaaaattgtgtttttagtacatttttactatcgttaaaatttatcaaaaatgtttacttaagaggtataattttctagatttttattgtgttaattttcttttccctttctgtgttcatctcgttacaatacttagcgaatcaactaagacaaagctaagacaaaataggagagcttatgatttacagtatgaccgcttttgcacgccttgaagtgaaaaaagattggggcgatgcggtatgggaaattcgttccgtcaatcaacgttatttagaaaactttttccgtttacccgagcaatttcgcggattagaaaacacgttgcgtgagaaacttcgtcaaagtcttactcgcgggaaaattgaatgttctttgcgtattgaaacaaaaaaacaaacaaatgctgaattgaatttaaataaagaacttgcgaatcaagtcattcaatctttgcaatggattaaaactcaagctggagaaggtgaaattaatttgacagacgtgttgcgttatccgggggtggtggaagcgcaagagcaagatttagatgcgattagtcaagatttattgacagcctttgatgatttactgaccgattttattgcaatgcgtggtcgtgaaggggaaaaactgaacgatattattcaacaacgcttagatgccattgcagtagaagcggataaagtgcgatcacaaatgccagcagttttacaatggcagcgtgaacggttattgcaacgttttgaagatgctcaacttaatcttgatccacagcgtgtggaacaagaaatgattttactcgctcaacgtgttgatgtggcggaagaactcgatcgtttacaaatgcacgtgaaagaaaccacgaatattttgaaaaaaggcggtgcagttggtcgtaaattagattttatgatgcaagaattgaatcgtgaatccaatacccttgcgtctaaatccattaatgcggatatcacggcttctgcggtggaattaaaagtgcttatcgaacaaatgcgtgagcaaattcagaatttagaataggaaagcagaatgtctcaatttatttctcttactcaatatcaactgattgaagtacagggtgcggatgtagaaaaatatttgcaagggcaattaacttctgatgttgtgcgattagcgagtggcgcaacgacgcttacagctcactgcgacccaaaaggtaaaatgaatgcaatttaccgtttgtttaaagtaagtagtgaacaagtctttttgctcgttaagaaagatattttgccaagcgctctggatgctttgaaaaaatatgcggtattttccaaagttagttttgatttacgtgattggcaaatcatcggcgtaataggtgaaaaatgtggaaaaattacaccgcacttttcattggaaattgatggacagcgttcaattttattaaatgaaactgaattacccgtgaattttaatggcgatgaaaaaatttgggaagtagccgatattcaagcaggattgccaaatttaagtccgcaaacacaaaatgaatttatcccacaagcactaaatttacaggccgttgagcaagcaatttcttttaccaaaggctgttatattgggcaagaaaccgtggcacgtgcgaaatatcgtggggcaaacaaacgtgcaatgtttatttttaaagcgcaaactcagcaggaagtggaaattggcagtgaaatcgaaatgcagcttgaagccaattggcgtaagactggcacgattacaagtgcggtcaatttagacggtattttatggttgcaagttgtgatgaataatgacatggattcagagcaacaatttagattgccgagtaatgaaatactgttagagcgagtgcagttaccttattcgattactgaataagaaagcaaaaaagatcaggcattaccctgatcttttttctatttagtaaagtactctagcacgaattgtgccatcaatttccttcaattttgtcagtaatggtgatgcatcattcgtttctacatcaacgacaacgtaaccaattttcgggtcagtttgtaaatattgtgcggcaatattgaggttggcttcgacgaaaatttggttcagtttgttcaatataccagggcgattttcatgaatatgcaataagcgttttgttccctcgtgctctggtaaagagacttctgggaagtttaccgaagaaagggttgagccattatctgaatatttaacaaatttgcctgccacttcaaaaccgatattttcttgtgcttccgctgttgagccgccaatatgtggcgttaaaatcacattatcaaattcgcgtaatggcgagacaaattcttcattaattgaagcaggttcaacggggaatacatcaattgcggcaccctgaagtttcccgtcttttaaggcttgagcgagagcatcaatatctaccacagtgccacgcgcagcattgatcaaaattgccccttgttttaattgtgcgatacgcgttgcgttcattaagtttttggtggagggcagttctggcacatgtaatgaaaccacatcgcaagaactgagtaattcttcaaggctacgaacctgttttgcattaccgagcggaagtttattttcaatatcatagaaatacacatccatgcctaatgattcggcaataatacttaattgtgaaccaatgtggccgtaaccaataatgcctaattttttaccccgcacttcataagagccagtcgcggatttattccaaacaccacgatgtacttcggcattagcctgtggcacattacgcataagtaataaaatctcgcctaatacaagttctgcgacggaacgagtgtttgagaatggcgcattaaatacaggaataccacgtgcttttgctgcatttaaatccacttggttggtgccaatacagaaacagcctactgcgattaatttgggtgcggcttcaatcatttctgcggttaaatgggtgcgagaacgtaatccgataaaatgtgcatctttaatggcttcttttaattcatcaccatccagtgcttttttatagtaatcaatattgctatagcctgccgcgtggagcgtatcaagtgcgctttgatgcacaccttcaaacaatacaaatttaatttttgatttgtcgagtgaaactttgtttgtcatatttgcttccttatgatttttattatgaattagtcaataattttggcaccttcaggcgtgccgacgattacaacatctgcgccacgcaatgcgaatatcccattagtgacgacacctgcaacattgtttaattctttttccatttcaactggatttaaaatactgaagttgtgtacatctaaaatcacattgccattatctgtaaccacgccttcacgatactcaggtgcgccaccaagtgcgactaattttctgcccacttgtgaacgagccattggaataacttcaactggcaatgggaaagtcgaacctaacacatctacttgtttactagaatctacaatacaaataaattttttcgctaatgccgcaacgattttttcacgagtaagtgccgcaccgccgcctttaatcatcattttttgtggattgatttcatctgcaccatccacataaatatctaagctagagacatcatttgcattaaatacttcgatcccttgtttacgtaataattcttctgatgcttttgaagccgcaactacgccttgaattttatttttgattgtacccaaagcttcaataaagcagttcactgtggagccactgcccacgccaacaattgtgtcagctgttacatattctaatgcagcttgtgcggcgagttttttcatttctaattgattcatttcttttccttatttcaataagtaaacgattgcgttactttattacgagcctatctaataaacaagtataattttttagcgggcgtttttctcaagcaatgttctttcacgactagactatttcacgattaggctattcttcagttaaaaataattccaatagttcattgagaaataacttgccgtgctcagtgatttgccaagaatcagcgttttccacaatatagttttgttgaatggcaaaatcaatttgatttttcaccgcactttgcgacaagcctgtgtaatcttcaaattcttgtttgggaaccgcttctaacaaacgaaagcgattcataaaaaactcaaaagggcggtcaatttctggcacgtttttttcttcgtaaagatattcgccacgcaaataacctttcgggtgcttggttttagaaaagcgagtaatctcgccagtcggaaacgtcaatttcccgtgtgcgccacagccaatggctaaataatccccaaatcgccaataattcaaattatgtttacattgaaaacccgcttttgcgtaagcagacgtttcatattgctggtagcctgccatcgttaaaagttggtgaccttgctcaaaaatgtcccaaagtgcgtcatcatctggtaatttaggtgggcgataagcaaacatcgtatttggttcaatagtcagctgataccaagaaatatggggaggagatagctcaattgcttgacgaagatcatctaaggcttcttccaacgtttggttaggcaaaccgtgcattaaatctaaattgaaactttttagcccagaaactttcgctaaattgaccgcactttttgcctctgctgcattatgaatccgcccaagacgttgtaatttatcatcattgaaactttgaattcccatagaaattcgcataatgcctgcggatacataacctttaaaacgttcagcttctaccgtgccaggattagcttctaatgtgatttcaatattatcttcaaaatcaatctgtttttttatttcttttaagagatacgcaatgctttctgccgagaacaaacttggtgtaccgccaccaataaaaattgaatggagttttcgttgttgaatagaatctttaaagcgttgcaaatcagcctgcaaatcttgcagaagatgataaatatagtcttgttctggtatatcgcctttttgtgcgtgcgaattaaaatcacaataagggcatttttgaacgcaccaaggaatgtgtatataaagggaaagtgggggaagttttagcattgtgttattaacaagttttcaatttggaaaagtataaattaaccttgtgtaaagatgaaattatcatctctaaaatcaataaaagggcttgttttcacaagccctaaaacattcaattaattgaccgctctttctgatttactcgtcactttacggcgtggtgctttaggtttagccttcactttaacaaactcaatgccctctggtggattttccaatgcaaaaccaagcacttcatcaatggtttctaccgcatgaattgcaagattttgttttacgttttctggaattttttcaagatctttaacgttctcttttggaattaatacggttttaattccgccacgatgtgccgcaagaagtttttcttttaatccaccgattggtaatactttaccacgtaaactgatttctcctgtcattgccacatcagcacgcacaggattacctgttaaacaagaaattaatgcagtacacattgcaatacctgcacttgggccatcttttggtgttgcaccatctggcacgtgaatgtgaatgtcacgtttttcgtggaattcagcattgatacccagtttatccgcacgagcacgcacaacggtcattgccgcttgaatggattctttcatcacatcgcctaatgaaccagtgaaagaaagttttcctttgcccacaacagaggcagtttcaatagtgagtaaatcgccgcccacttctgtccaagctaaaccagttacttcgccaatacggttttgcgtgtcagctttaccaaattcaaaacgttttacgccaagataatcgtgcagattatctgaatttaccgtgatagatttaagttttggatttactaataaatttttcacggctttacggcagatttttgaaatttcacgttctaatccacgtacgcccgcttcacgtgtgtaatagcggataatatctaaaattgcactttcttttacggtaagttcgcctttcttcaaaccattacgttcaatttgttttgctaataaatggcgcattgcgatattaagtttttcatcttctgtataaccagaaagacgaataacttccatacgatccaataatgggcctggaatattcatagagtttgatgttgccacaaacatcacatcagaaagatcataatccacttctaaatagtgatcgttaaacgtggtgttttgctcgggatctaatacttcaagcaacgctgatgcaggatcacctcgcatatcggatgccattttgtcgatttcatcaagcaagaataatggattttttacgcccacttttgccatcttttgaattaatttacctggcaatgcaccaatataggttttacggtgaccacggatttctgcttcatcacgcacgccgcctaatgccatacgtacatatttacgaccagtagcattggcaatagactgaccaagagaagttttacctacacctggagggccaactaaacaaagaatcgggcctttcactttgtttaaacgcgcttgtactgctaaatattcaagaatgcgttcttttacgcgatctaaaccatagtgatcggtatctaaaacttgctgtgctttaacaatgtcttttttcactttagaacgttgatgccaaggcacttggatcatccattcaatataactgcgtattaccgttgcttcagaagacatggcagacatcattttaagtttttgtaattcattttctactttgtcacgcacatcagctggcatgcctgccgcttccaccttttgatgcagttgttcaacttcatcaatggtatcttcattttcgccaccatccatttctttacgaatggctttaatttgctcgttcaaataatagttacgctggcttttctccatttgtttttttacacgaccgcgaatccgtttttccacttggagaatatcagcctctgattccatcataccaagcaaatattctaaacgttcttgcacattagcgagttctaacgcattttgtttatggcgaatgcttacagggagatgggcagccattgtgtcagctaagcgatcaacatcatcaatacgttgaagggcattgagaatatctgtaggcacttttttgttgagggtaagataattttcaaactcagaaagtaccgcacttttttgccaccactaattctgtncagggtaccgagtccgaatacgtatacca

SEQ ID NO: 562 - DNA, 13466 bp, H. influenzae
  misc_feature (2643)..(2643): n is a, c, g, or t
  misc_feature (13138)..(13138): n is a, c, g, or t
  misc_feature (13192)..(13192): n is a, c, g, or t
agccaataatgcagacagcctaaaagccaatccgcaaacgctttcattccaaattcacggcaatcaattgttgcaggaaacgcaatttacagccgatgaaaatgatgaaaccgccccgacaaatcggcacacaaaataattttactcaaaccataaaaatgagtgaaatggagcggcacatttttaataaagccttgcatatcaaaggaaaaaatagtcaatctttatttcatttcgatcgcttgcaaagcaaactcaacattcaaaatcgcaatgaattgcaaaataacttgttaaaagattggcaaattgaatttttgggattagggcaagataaacagattagcccagatgacaacttgcaggctgcctaaaaatcttggaaatggttgaaaaacgtctcaatgaaagtgatatgccatttatcggtacaaaagaatttacgcctaaaaaattgtgggaaatttttggcacaccaaaacaaaaatgggtcaaaaaagatgatgtaaaaactgctattgccatgcaaaatgattggtatgtgatggataattttgctggaacgagtttggaagaagcgttaattcaatttatttcagagcgtttgggcgatttgaaatctaaatatgacgttcatttaatccgcaatgaagaagtgtttaaattgaataactttgccgatggtgaaggatttatgccggactttgttttattgctgaaagataaacaaaaatcttcttccaatggtgtgaacgactttttgcattaccaaattttcattgaacccaaaggcgaacatttagtggaaactgataggtggaaagaagcttttttaaaatcaatcacagtggaatatgggaaggataagatcctgcaaaaagatacaccgcattatcgtttgatcggtttgccgttttttactgatcatcagaaaaatggacaatttacggagttattccctttaggagagacatagcttgaaaaatagagtggtgtattattaaaacacagccttaacaaaacaagggagcattaaaaaatgctccctttctcttaatcaacttaactttatggaatgacgagtaattaacctttctgtacgctatatgcttctaatgcacgtaaagaataagtataagctgcacctgcatttaatgcgatagctgttgctaatgcagcagcaacctcagcttcacttgcaccagcttttactgcttcttctgcgtgtacgctaatgcagctttcacaacgagttgttacagcaactgctaatgcgataagttcgcgagttttagcgtcaagcacattgccctcttccgcggctgagcctaatgcttggtaagcttgtaacattttagggtgttgtttacccaatgcgccaaatgattttttaacgtgagatgtgtgttctttccaatctgcaaacataatgttctcctaaatatattgaattaataaccaactggtgtggcaaattataggcggattagattatgatacttgcttatttatctcaatttttatcgctaacatctcattatggactatttagataaacttacccatttagcacaagtgcgtggagaaattaatattcgctgtgaatttcaaggcgaatggcaaatatctcatcaagaaaaggatgcaggaaaaggcatattccatcttattgaacaaggcgagtgccagcttacactaaatgaaaaacaatttcatttaaaagagggagatattttttttcttcctcaaaatcaaccgcactttatgcattattcagtaaataaaagggcagatattcctacaaaaaaaagtcatcaaggattatttgagttacatcagattggacgaggtacaccagatttaaaaatgttctgcggtaatttttattatcaacaagatgcacttcttacggcatcaatgcctgaatatttacatataaatttatgcgacacgcccattcatcctttagtgcagctttttttgcaagaagcacaaaaaaatgatgcgggtacgaaatcggtcgttgatgcactttcaaatgtacttttaatttatattttacgtcacgccattcaacaaaatttaattgaacaaggcatcttattcgccttacaagataagcgattaaatactgcactgatagcaatattacaacaacctcaaaatgattggcatattgaacaattagctgaacttgcaacaatgtctcgtgcaaactttattcgtgtttttcaacaacaacttggtatgtcgccaggacgttttctcacgaaagtgcggttacaatctgcggcgtttttattaaaacaatcacaacaatctgtgcttgccattgctttagaagtggggtatcaatcagaagcgcatttttgtaaagtttttaaaaattactaccaactttctccaagccaatacagaaaatctgtcagcctataaattgatttgtttttgtgctataataatatgcacttctaaaaggcaacccgcgttgccttttctttttaaggaaaagatatgtttaacaaaattttttcgtggtttgaaaatcgtttgaatccctatccagaaagcaatccaacaacacctaaaaaggtttgttccgttttatttggtctagtattacaggaatgaaaggctggattnttttgctcgcaattttaaccgtaggtacaggtgtaatggaagctgtattattccaatttatgggaacgcttgtagattggttaggcacatttacacctgaaagattatggcaagaaaaaagtcatttattaattggaatggctgctctattacttattagtattgtgtggggatttttagcttcggccgtgcatttacaaaccttacaaggcgtatttccaatgcgattacgttggaatttccatcgtttaatgcttggacaaagtttaagtttttatcaagacgaatttgcaggtagagtatccgcaaaagtaatgcaaaccgcccttgcagtacgtgacacagtacttacacttgcagatatgttcgtttatgtattgggatattttattacctctggcgtagtgctagtggcattagattcttggttcttattaccatttattacttggattatactcttcggtttgatcctacgaacccctattcctaaactatcaaaaaccgcacaacgacaagctgatgctcgttctttaatgacaggacgcattacagatgcttattctaatattgctacagtaaaattattttctcacggctcacgcgaagctacttatgccaagcgttctatgcaagattttatggtaacagtacacgcccaaatgcgcttagcaacatcactagatacactcacttacgctacaaatattctacttacgttaagtactgcaatacttggtattattttatggaaaaatggtcaagttggcgtgggtgcaatagcaacggcaacggccatggcattacgcgtaaatgggctttctcgctggattatgtgggaatctgcccgtttgtttgagaatatcggaaccgtaaacgacggaatgaatactttaactaaaccccacaccattgtggacaaaccacaagcgtcaccgttacaagtgaaacaaggggaaattaagtttaacgatattacctttgcttacgatccgacaaaaccattactcaatcatttcaatctcactatcaaaccaggggaaaaggttgggttaatcggtcgttctggtgcaggaaaatctacgattgtgaacttattacttcgcttttatgaagcacaacaaggcgaaattaccattgatggacaaaatgtactcaatgtgcaacaagaaagcttacgtcgccaaatcggtttagtcactcaagacacttcgttgctacatcgctctgtacgtgacaatattatttatggtcgcccgaatgctactgatgaagaaatggttttagctgctgaacgagcggaagccgctgatttcatcccatttctcagtgattctcaaggtagaaaaggctatgatgcccatgtgggagaacgcggggtaaaactttctggtggtcagcgtcagagaattgccattgctcgtgtaatgttaaaagacgcaccaattctattgttagatgaagccacaagtgcattggattcagaagtggaagtggcaatacaagaaagtctagataagatgatggaaaataaaactgtgattgccattgcccatcgtttatccaccatcgcagcgatggatcgcctgattgtgcttgataaaggacaaattgtcgaacaaggtacgcacgccgaattactagagctcaatggtctgtacgctaaactttggaatcatcaaagtggcggatttttaagcggaagtgctgaataatattgcgtttatcatatttaattaattgtactgtaatcaagctaattaaaaaattagtctaatttaatagctaaagaaaagtgcggtgaattttcaccgcacttttttgctagatatttagcgtttaattcacgacttcagcagtatatttcagcttgtgaattgcatcgaataattgttggtttgtgacttttggatcttccacaaccgtcactaaaccatctttaatagatgcttttgttgaaataacgccatcaatattacgcagttctttattgactaagtaagcacaaagctggcaattcatttcctttacttttagcacaatttgtttggtttcattcgcatgagcgaaagaaattgcaaacagcgaaagcaaaagtgcggtacataatttcttcatttttattcctaattagctaattctaaaatccaaggtaaaattgttggataggttaagaaaaaaatcatcacgataaatacaatccaatataaaacgataagttttttacgggaaatatatttgctacaaatgatttttttggaaaacatcaacagccaaaatccataggcaaaggcacataatgaaatgataagcataggaatacgcaaataatcatattcgcctaagccaatcaaccaagtggacgacacaccaaatactaaataaattaatggtgcgatgcagcacaaggttgatgccaccgcagcacttagtgcggcggctatggcaacccaaaaggatttattagagttttttagatacgtagtcatatttaaattcttttgggtcaaaggaatttaacggatcgccacctacttctgcatatggatagccgaagttattgattggagccagttctggttgtggatataaatcgaagtcacgggcatgattaaatcccacccagtttgcttcccagttaccaaacaaatattttgctacggcttgtgtatctttatcttcaacagattttttctctgctaaacgcattttggcaacgtctgcggaatcaactggtacccatccaaatcctgcaaggtagaattcagcgcggcagtgctgaccgccacttacgtttacgatgccttgttcatttgcactaccgaaggcaccttttgaatatttgcccattttctctgccgtacctaagcgaataccaaaaatttcacgagcagggatgcctgcagcacgagcaagtgccacaaatacagagttaatatcggtacatttaccttttaacacgccagtggtaagaattttttctacatcgccgtcaccacaacctaatacagaattatcacgttccatattttttacgatccagtggtgaataagttctgctttcttcaatggattagtttctttacctaggattttgtcagcaaattctttcacaatgccatcagttttaatatgtggagtagcttttaagtattcttgtacatccacggaatactgaatatcttttggcggagtataattctctaaagcacctttcaccatcggttcacggtcttttgtttcaatgaccatcgtgacttttaaatcacgtttttgtgcatctttatcccaagtggcaaataaggttttcgctccgtatttattgttttctgttacataggcattcatgtaattaccttcaaagtgaatcgatttcacttgttggtattccccattaaatggtaatggaacccataaattggtttgtccttgcgagccttttggcacaactaaatcataggtttgcgtgaattcgtaaagatgggcgtctgtattgtagtttggaataatggtgtttgcatgagctaacgagccacacgcagaaaacaccgcaaccgcgataagtttcttcatgaaaagatcctctagttaataatagttaaacttaacatattagataaactaatacgccactatgctaacggatttttaaatctatagtcaatttgttattccaaaatttataaaaacatcaacctactaaaataccctataaataatgtacctattaataattagttgatttggctcaagtaaaacttctatacaaagattataattaactcgttttagttattactcgatcttactgtgggggacgatattatgagtaactttaatcaaataagtcgccgagattttgtcaaggcgtcatctgcgggagctgcactggcagtttcaaatcttactttacctttcaatgtaatggctaaagagacacaacacctcaatgaaaatagtcaggaacgtattgtttggagtgcttgtacagtaaactgtggtagccgttgtccattacgaatgcacgtaaaagataaccgaatcacttatgtggaaaccgataatacggggacagaaacatataatcttgatcatcaggttcgtgcttgtctacgtggacgttctatgcgtcgtcgagtgtataacccagaccgtttaaaatatccaatgaaacgtataggtaaacgcggagaaggtaaattcaaacgaatcagttgggatgaggctttaactgaaattgcagacgcattgaaacgcaatatcaaaaaatatggcaatgaatcaatttatttaaactatggtacgggaacactcggtggcacaatggctaaatcttggcctcctgcatccactatgatcgctcgttttatgaattgtattggtggatatttaaaccattatggtgattacagcaccgcacaaattgcagtcggtttagattatacctatggtggtggttgggcattgggaaatggaatggctgacattgaaaacaccaaattaatagtgttattcggtaataatcctgcagaaactcgtatgagtggaggtggtttaacttattgtattgaacaagccaaagctcgttccaatgccaaaatgattattatcgatcctcgttataatgatactggtgcagggcgtgaagatgagtggatcccaattcgtccaggcactgatgcagccctcgtttctgcccttgcttatgtaatgattcaagaaaatctcgtggatcaacctttcttagataaatattgtgttggttatgatgaaaaaacattacctgcggatgcccctaaaaatggtcattataaagcctatattttaggttatggtaatgatggtatcgctaaaaccccagaatgggcggctaaaatcacgggtattccggcggagagaattattaaactcgcacgtgaaattggcagcacaaaacctgcctttatttcccaaggttgggggcctcaacgtcgtagtaatggagaattaatctctcgtgccattgcgatgttgccaatcttaacaggtaatgttggaattcacggcggtaacactggtgcacgtgaaagtgcgtatagcattccatttgtgcggatgccaacgctaaaaaatcctgtgaaagcaagcattccaatgtttttatggacagatgcaattattcgtggcacagaaatgaccgcacttacagatggtattcgtggtgttgataaattatcgtcccccaattaaagtaatttggaattacgcaagtaactgtttgattaatcaacacgcacaaatcaatcgtactcacgatattttacaagatgatacccaatgtgaaatgatcattactattgataatcatatgacatctactgccaaatacagtgatattttattaccagattgtacaacttcagaacaaatggatttcgctttagatgcctttgtatccaatatggcctatgtcatttttgcagatcaagtgatcaaaccatcttttgaatgtagacctatttacgatatgttgagtgatttagctgagaaaatgggcgtaaaagaaaaatttactgaaggaagaacacaagaggaatggttacgccatatttatgagcaatctcgagaaaaattacctgaattacctacttttgaagaatttagacaacaaggtatttttaaaaaggttgatcctaatggctttaaagttgcatacaaagatttccgtgataatccagaagcccatccacttaaaacgccatctggcaaaattgaaatttattcttctcgtctagctgaaatagcaaacacttggaaattagcagaagatgaaataattcatcctttaccaattcacgcccaaagttttgagcattacggcgatccattaatggaaaaatatccgctacaactaagtggttttcactacaaagcaagaacccattcaacttatggcaatgtggatgtattaaaagcagctaatccacaagaagtttggatgaatcctattgatgcagaacctcgtaatattaaaaatggcgatatgattcgtatctttaatgatcgaggcgaagtacgtattaatgtaaaaattaccccccgtattattccaggggttgtggcattaagcgagggggcttggtatgcaccagataaagatcgtatcgatcattcaggttgcattaatgtacttacgacacaacgcccatcaccgcttgcgaaaggtaatccgcaacattctaatttagttcaagtggaacgtttgtagggggataattatggaacaatatggtttttattttgattctgaacgctgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcttattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgccatatggcatgtccttatgatgcaccgcaatatgatgcacaaaaaggtcatatgacaaaatgtgatggatgttattctcgcgtaaaatcaggtcaaaaaccgatttgtgctgatgcctgcccactacgagcattggatttcgctcctattgatgaacttcgagcaaaatacggcactcaagcctccatcgcaccactaccaccggctgatatcactcaaccaaatttagttgtaaaacccaataaacacgctcgtttaagtggcgatacaagtgggttcttaggaaacccaagagaggtgtaagatgaatacaggattatatgaactgccactagtattttttacagttttggcacaaagtgcggtcggtgcttggcttgttttcacatttgtactattaaatgagaaaaatacaaaaagtcgcacttatattcataaagtaatgtttgtgattttggctttgctaggtattggatttattgcttccattatgcatcttggcttacctatacgtgcatttaattcacttaatagagtcggctcatcaatgatgagtaatgaaattgccactggtgcaatatttttcgcattagcaggtttctactggctgattgcaattttaggtaaaatgccagcttcacttggaaatgtatggcgaattgtgaccgcccttatcggcatactatttatgtatgtaatgaatcaggtttaccatattacaagcataccaacttggaataatgcattaacctcttggtcattctatcttaccgttgtattaggtggattaacattaagctatgcgttattaatccctaataaacaacgtgaatatcagcttcagcatctgccaagtttatttgccattggagtattattggtcgcaatagtagccatatatcaaggcttcaatttacacaatattcacagtgctattcaaaatgccgctgacctcgtaccaaattatgccataatgaccgtaactcgcttatgtttactttccattgtagctttcctcttattccgagtgaaaaacataggactattaggtatttccgttctattaacgttagtagctgaaggcatcggtcgcgtattattttatggattacatatgacttacggcatggcgattggtggttaaattatgttgaggcgtatagcatacgcctcaatttttagaaacgttaattagtaatatttaaccaaccctcatatccccattcactaatgacaaattgttttcggagatactatgcaaaatactcttcaacaaatttctatttatgggcgtttactcggtgcagtattttactatgagcctaatgatgcacgacttactgatattttgacattctttcgccaaccaaattggatgcaagaatgggaaatttcatttgatgtaaaaacacataaaaaaattaccgcacttattgaaaaagggctgcaacaaaatatcaatgaacaatatcagtatttatttattggtccaaatgaattacctacgccaccttggggatccgtatatcttgatcctgaatgtgttatttttggtaattctctcttagcattacgcgatttcttacaacaacatcaaatcgcatttcaaacacaacaagatgaaccagaagatcatattggcttaatgttaatgcttgctgcatatttagcagaaaatcgaccgcacttattaatcgaatttctacgtgaacacttcttaacttgggcgtatcatttccttgaacaactaagcaaaatagaaaattctgatttttatcaagctcttgcattacttaccctaaaaactttacaacaatggcaagtagatttacatattaatataccgacagtaagattttatcgataatgaaaaacgaagcctattatcaggcttatttaagccaccatcacatttctcgtagaggactattgcgtcatatatttccagctacaaaatcaacaatagaaaaaacgcaatctcgtcctcccttttcagcacgagaagatttattttccgccgtctgcaatggttgtggggaatgtgcttcagcttgccctaatggtttaattcaactaaaacagcaacaagccacccttgaaattgactacgcaccttgtgatttgtgtggtaaatgcgcagaagtttgtccgacaaatgcactacatcctaattttccagcggatacattacttcgtccacaattttcctcagcctgtttaatcctacaaaatcaaacctgtccagactgccaaaccgcttgcacacaacaagcaatctccagcactttagagattgataatgaacgttgcaatgggtgcggagaatgtaaaattacctgttttgtcgcagccattacacttaaataaaaatcttgaggctgtactagataacgactaaaaatcccatttaggttagaataaaccaatgagaaaaagtcgcggtattctggcttctcaaacgaaatggcaaggtttataccgtcgttgtccctaatgcgcaatcagcgacattattgtcaattatccgaggaaaagttaagcctgatagcattgtgtacacggatacctttcgtagttatgatgtgcttgatgtcaatgaatttagccattttcggcatcaatcacaggtcgcattgatgaagaccaagctcaagattatgccaaacgtaaaggttgggatgagagagagatgttgaagtggttgggggggggcgatgaagtagggataaaacatattatgatataacgttatcttatatttgaagttatttattaaactatacaattagagcctaggaataaaaacttaaactatttattaacttaatttattatgggagaaaattttatgtccttaaataattcgctaacaacttttaatagtcagttacccgatttatcagttaatactattcccgcaattaatcaactagtttctgctcttcgcattccaagagacgttttagcaagtgatgaagaaattagatatgcttggaatgatttacctagagaattaagaaatataccagtccagaatgtgaatcctgagcttattgctcgtatgtgcattgcaattagctcaggattatttgatggtgcaatcaactatatatggaatgcttctattttgagattgcgtgataaagttagaacctttggtcttccaattgttgctcaagtattggaaagggattttgaagaaggccatttaatagcattacaggatagtcagttactagatttatgtttgcaattaaacattcttaacgaagaaggctttctttttctaggccaatgtagaaatatccgtaataatttttctgctgctcacccttcacttggcaatttgaatgatagagaattcattacattcttaaatcgttgtataaaatatgctttaggtgattcttcttcacctaaaggagtcaatattagtgattttattcaatcgattaaaggtggaagatttaatcaagaacaaagggaatattggattgataggctatctaaaactcacgaagcacagaaacaattattgattattatggcacacggtatttattgtgacccaaactcacaggaaacaactagattaaatgctttagatatttgtgctttctttcaaaatagtttttctgcttcactaaaatcttcattaattgataaacactctgaatatatcgcaaaaggagatgaacaaagattaagagcatctagtcaattttttgagaaattaagtttattagggttgctatcagctccacaacaacatgcgattttttcagcagcaattaacaggttgcaaatcgctcatgatgggctaaacaatttttataatgagcctccctatgctgaaagattagcagaattgtctaaaatacagcagtccctgaaacagccaagggattttgagaacgatagtntctgttatttggaaacaatatgggagttcatggggagcattccattttatgaanaaatattagaaacttttctccaaagaattaacctatgattaccatgcaaaattatagttctaaaatggaagaaaaccacgatgatatggagataagattattgaagctttaaaataatgattcgggagattccaaggggagtcccccagatatgccaattataatatatgggggggtgttactacaaccttcagactgccccccaaggcgactcttcccggggggcctaattataaacccctcaaaccaccgctttattttaggcccggtggga

SEQ ID NO: 563 - DNA, 14710 bp, H. influenzae
  misc_feature (8250)..(8250): n is a, c, g, or t
  misc_feature (8293)..(8293): n is a, c, g, or t
  misc_feature (8350)..(8350): n is a, c, g, or t
taactgcacgtctggtcgtcggctgtaaagtcataaggcggtaatgggctccacgaacaagattatgattggattaattgtatgacgcgtcttaaaattggcggataaaaagggtcaagtgttgattatgatttgaaagcctggcatttatcgatatgcaccaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaacccaatccccctctttagtaaagaggggttaggggagatttggcagaagtaacatcaacctcagtggtgaattttatatcgttaaaatctcctccagaccctcttcacaaaagatgagagaaaattaaccgcacttttgcagtaaaaaataggaaaaataatatgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatttaatacttgccttcctccgtttacgggggaaaggtgcccgaagggcggaaggggggcaatctcccacccttagttatttagaaatatccccaataaacagggggacaaagtatttaaagtgcggctgaaaaacacgtcgaattttaaccgcacttcccttaacgaatagagaaaaacattatggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaattaaggctcaataagaggaaaaagaaaaatggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgttaaaaataaaaaatgtgctgatttttcaccgcacttaatcactgaatttcattcaaaaataaagccctgtaatacacagggctttgtcgtttataacgctaattcaaacaggctgattaaaaactaaaacttagtttcacttctgcagttttttgtttttccgcttgttttgcttttgttaatccgccaattagacttaatttcacattatgatatttcaatttaagtcctgcgttatattgctgttggttttccacattgtaagcaaaatcatatctatctacattaattttgccgctgccttgatttgcatcatatcgagcagacaaaattggcgtaatggaaaactcgcctaagtgataagtataacttaaatcaacttgagcaaaggctgttttgacagatattggatttactttaatgcgatctttagctaatgcaaaattagcgtttgataagtaactataacgaacccctacagttggtttaacagcaaaattgccaagattaaatgctttgcctgcggttaaaccaaattgtgcagtatggcgagcaaatttcgcattatgattagtttgtaagttgctttggaaattaccatagcctaaatccaccgctaaataccaatgattatccatataatatttagaatagagatttgcttgtgctaaggtatttttactgcttgccttatcaaagttgttactattgcgaacataagtaaacacaccacctaactgaacattgcttgagattgtttgatcccaaccaagttgagtttgcgcacttttagaactaaaatgacgatattgacttgaggaataattttctttcattgaagtattagatacccaaacgttatattgcccctcgttattcatttctaactggctaatatgttgagaaacggctttccctacatttaatgcaacaaattgtgcttttgccatggcatcagaaattaccgcattggtgtttgtacttgtgagatcgcgcaatactagttgtgtagccacatcatttcccgattgcggattctccgcattttcagtatgtagttccactggctcgtaactattctgagctgatctacgagttcttctgcttcgtggttgtggagtagatcctgaattatccactgttgtttcttgagtagaagctactgttgtttcttcagcagaagtcactttagactggctaacaacagcttctgttgtcgctgtttctgattgaactgcctctgaattaaccgtagattgagttgtagcaggtgttgtattctctggatttttcactacagggttttcagtgcttactgttgtggtttctgtcacaggttgttcagcttctgtagttttattctcaacaggtttaataggtgttgtagcattttcaggtgtaacaacttctgttgaagcaacagcagtgtgggcttcaggctgatgaatattttcatctgtcgtttctgttgattgaggattttctgctttattttcagctgtttttggattagctacaggttgagcagtttctttctgttcactgtttgatgcagttgtctctttcgcagcaacagttgtaggttttgcttgcggttgagcttcttttacattattaacagtcgaaacattttcacgagcaggctctgcttgctgtgtggtagtttctggctgtgcttgcgattgaacagttttaggctgttcttgctgtttagccatttctggttcttcttgttttggagacgcttgaaaagccacttgaggggcttcttgagttttctctgtttctactttagcagtatcttctgttcctgctagatttatattattagaagacgagctaatacttcttctaggtctgctctttggttcactgattgtaggatcatcttctactactgtttcttcagtagaatttatttcagactgacgagcagtttcagcctcttgagtttcctcggtttcgcttccattttgggcgagttcatttgtttgagtgttagcttccacagttggtttagcttcttttgcaacttcatcattttgagctgttgtctcggttgctttttgctcgtttttcgctactgtttcactttcttgcggactattttcagccactttttcaattgtctctgatggaacactttctgaatttggatcatcagcctgtgttgtatcagcttgtggttcagatcccgatgggtgagtagtatttgtatcttccattgtaggttgaacggtttctgcaggacgagtttctggttgctcgtttgccattgctgatccagtagcaggtgcaggtggtgctggcagtggaattggtgcttcaacacgagcggtttcttcatggttatttgatacgctaggtacatcagcttgcatattattagctgttgcaatacttggcgtatcgacagtttgatttcttctttctacttctgggttatgcaagtaataacgtccactattttctttcaaagtatagctccaagcacctcgatcaactttgccattagccagtgaaacatttaagccacttctttcagttgcatttgacgcatcaaaaagcgtaagttcattatgatttggctcgcctgttttatttgccacttgtaatgtaaaggtacctttggctgatttggttacaacaactttgtcgccctgatttttggtaaaatcaacccaataatagaaagaaccattacctgataaattgctaatattgagcgtgtggtattttgtttcttttgttgcatctgagacattatttaaatgaatatgcccatttgctagatctaattgatgaacatcactatttcctgttaaataccaatggctgttttcttttaaattaacttggctattttccgtgctgttaattgtgccaaataagttagctttgcctaaggtaaagtttgcactttcggttaaatttacattaccgcgcaaattagttggattaaaactattgagtgcttttgtagataaagtgtcattatggcaagtcacatagcccgtatagtcagaacgtacacaaacggtatcgcctgctttatagccgatatgcacttttgctttattagaggctgtgatatttgaagtaatactttcaacattgcgacctgaataaagggttgcgttattggttacattaatatttgttgctttaaaagtgcggttaatccagtcgtcttctaccaccacttcattattttcagcaaagtgtttatctttttctgttgaagaaatatttgcaatatctcttgcgtgtggtgttggtctgccagaaaggaataatgtacctttttcaacttttaattcaccgttaaggtttgttccgccagtcaataaaaagcgattttgatcacttttgccactaaaggtaacatttaatttaccgttttgatctgccttagttgcttcctcgccaaaataaccattaaagccattcatacgtctgttattgatgtacaccatggctttcttttgtgcatcattttgattgtcgcccatgaattcccaattagcatctgatttttcagagctatagcaaggcatttctgcagtagggcttccaccttgctttaacgcatagtatttataacaggtattactaaagtaaagatcttttcctcttggaatagatggcacatagtaataattatcatcatcggcggttattgctggtgtatatatagtgacctgacttggatttgtaattaatcctgctccagtaatcgttatatttgaggcattagtcatattatgattaactagtcttgcaccatcatcaatattacggatatgttcaaaagtgagattattgccattggcatctaatcgaccgcctctaaaaccaaagtaaattgaatttggatctacttggttatcatcattaagtacaacagttgagcgaccacttacaattcctacagaagcaaaagcgtgttgtcctgtagttgtttgttgttttaaaacaactgtgccatcgcccacttttagcgaacctttattatctcctcttccttcaacaattagctttcctttaccaattttagctaaacgatcaaattgagggttatgcactttccactttactgtttttccttcagcaacagatataccagcccctttccaagtcgtattttctgaagtgcctttaacttcataatcaccttcaaagaacaatccgcctgcaccttgatcgatattattatttaagggtaggtttccacttccttcanacgtaacatttttcccatgattgagatttttattatccactanatcaacacttaatgattcagatgttccagatatcaagcttgtattacctttgcttgnccagttatattgcgtattacctttcagtaaaccagcactgtcttttttgagaatattttcagcaaattgtggtttataaatattccattcttgccaagattttttcttataccctccccaaaaatcataagcaccaaggaaaagccatttctctttagatttatcataaacaaataacggtgagccactatctcccaagacagcataattagtaagcggtttacgagataatatctcttttggatcgttatgatcttcggttgaatcaccaaacccaatgagtccatcgtctgtatgattcactttataaggcgtgcctgcaataccataggtataagcgttaccaactaatttaagattatctccacctacatcccatctgtgtattatttcctttttctcgtttttctcttctaaaattaattcataatggcttccttttttatagataaattgagagccacttcctaatctcacaaaagcaggatatttattctgatcattatatgttccagcatcactacttgtagttgaagcctctatcggtgcaacttcggtaacaaatttatcaaggcgtggcatataataatcttcacggcgtttttggttttgctgttctttaactaaggcttgtccatataattcggaaggaacatcttttttattagatgtatactgtttatctttttcgttattttgtgtttttccgtttaattcagaagaaaaattatttttttcaacagtgtaatatctgttttcctcccaagatacatctcgatgctgaatagaatttccaaatttagggttccaattcccatttaaattcccaaaatgtagttcacccacaccgttaccaacgtgttttacccccacaacatattgtggatttaccaacgtggcaattctcttatctacatccacagcactaaaatcaatcatcggaatatctttaggtagcgcactgcccaaattattatttttgttatctctcacttccacatttgttgcaccaacagaaaacttccctttattctctgcaaaatcacgaaatatttgataatccacatcgtttctcactaacgcggcttctgtataaggggttaatgcgtaggcgacagtaagcgcaataaaattgagtttgaattttttatttagcatagaagctgtccttattaattaagtttaaaaagtagatttgatatacagctacaagttgattcaaatcttggctgtgttgcgttgatagtttgcaagttgtcttcatttttataatgagtgggttttatagcataaatcgctcaaaacttgaattacatttattaggtaatgataatgatttttgatattttttaaaaaattggcgtattttttaccgcacttttggttaatttaaggcgttaatgatgccattatggacagaaaacatttttttgttttccacttgcatttcttttagttgtctttgagtgatggcggtaacaaatacttgcgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatacacacattaaaagtttaagctgtccacgagaaagcacatcttcaacaggcaatccttgtgctttgaaacgaaaatccgctttttgagggccagaaaaggtgtaatttaaggcacgatctcgttcaaaattttgttgaagaatttcataataatcagcatttttttcccacccttgatgaaagctgacattaatttctaattcaggcagaaaaagttggcaagtttgttcaatttcagggcggagagcttctgcatattcggcacgccattgacttacttggtgggcaagtttggcaagttcaacgtcccaaatttttatggcagagtaaggctgattttgtgcgagtgcggcatttcgttgtttaagtaatcggttgagattgctccaagcggaatagaaacttgtttggtggtggaataatccccaatctaaaaacgcacgacgataacttggcccaccgttgagtaaggttaagccctctggcgtgattaattgcattggtaaaagatgggctagatcggaaattttattgccatcttcgccgttaatttttactaaggtgttgccttgacgaagtttttgtaagccgacagaccattgatgttggctttcttggatttgtccaaatagggtaaagtgcggttcgtcgtaagaaatgatgcggtttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcgcattcgcacttgattacatttaagtgcattcagcacatcaagaatataggtgacattaaagcccacttctaattcttcgccattgtaattgacatcgacaatttcttctgcttcttcgtgttctgtgtttgaggcagtaattttaagctggttttcctttaagcttaaacgcacgctgcgcgctcgttcattagataaaatggacgcacgaacaaaagcctgtttcagcatttcccaattgccttcgacagtttttgtggcattacgaggcaatactcggcgatagtcaggaaagcgaccatcaattaattttgatgtaaataccgtgttttttaaatggacacgtaaattgttggtgccaatttgtaaacgcgctggttcatcgtttgtttctaataaacgaaccagctctaacacacctttacgcggtaaaatcacagaatgattttgtaattcttgttcaagggaaatggtacacaccgcaagtctatgaccatctgttgccaccgttcgcaataaattgccttctgtttcaaacttcataccatttaagaaatagcgcgcatcttggtttgccatagaaaattgagtggcttcaattaaacggcgtaaggtattttgcggtagttgaaaatccacttcagactgccaatccgtgaggtttggatattcttcggcaggttgggttgtcagcgtaaaacggctacgcccagactgcactaaagcacggtcttgttcaaaagtcaccgtgatttctgaatcatcagataaagtgcggcaaatatctaagaatttttttgctggaatggtaaaagtgccattttcagaagacgatgaaagctgagtttgactcgataattcgacttctaaatctgtaccagtgatagtcagacgattgtcttcaatttgcaacaatacgttgtttaatacaggaatatttggacgattactcaatacgccacatacttgttgcaacggttttaataaattttctcttgaaatgctaaattgcattgcgttctccttttatgcaggatttattgtatttcttggctccacccatttctggggggagctgccgaaggctgaggggggattaaccagcccccttccgccctatgggcaccttcccccgcaagcaggggaaggcaaggtatttgtctagcgaaaagttctttgctgttttatatctttttcaattttagattatgcggacaaagtgcggattaaattcgcccaatcttcttgaatgctattgtcttgctcgcggaattttggcacttcacggcaagcgtttaatacggttgtgtgatcacggtcaaaggcacgaccgatttcaggcaaactgcggtttgttaattcttttgctaacgccatggcaatttggcgagggcgagtgactgaacgcgcacgactttttgattttaaatctgaaaccttaattcgataatattcagccaccactttttgaatattttcaatagtaaccaagcgttcttgtaaagccaaaatatcttttaaggtatcacgcacgaaatcaatatcaatgtcaccgcctttgaagtcttgcattgctttcactcgatttaatgcaccctcaagttcacgcacgttggtacgcaagcgttgagcaatgaagaaagcaacttcttctggcaagttcatattatgttcttccgcctttttcaataaaatcgctacgcgagtttcaagatcgggcggttcaatggctgttgttaagccccagccaaaacgtgattttaaacgttcttcaattttttcaatttctttagggtaacgatccgaagttaagataatttggcgacccgtttcaaataagttattgaatatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgcgcattcggtttatcggctaaaatgccgttgccaatggcgtgtaacaagtgagttttccctaaaccagtgccgccatataaaaagaaaggattagccgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatatatttggcgtattttctactactttaggtgcaggcttgaccccttcttttaaagaaatacgcagttcaggattttgtgtaagtgtttgacaaatttgctggatttgtgcgagataatgggtttccacccaacctttcacaaacatattagaagcatataaaacaatgtggttatccgccaccacatcagcctgtaaaggacgaagccaagtgctaagatcgctggctgaaacttgatcttgaagttgtaacaggcaactttgccaaagatttgagagattcacaaaaggatccttgttgtttttattataaaagtgcggtcaaaattgtcggagattttacaataaatgtgtgaaaagatcttctaaaaaatctagtgttgagttttcatttcataagattatagaactgaaaagaaatgcgccagtgcgatatagatagcgtgcttaacctgtctggcgcattttaatttagaatttcatttctaatgttaaggtatagtttcgtcctgatgctgcgtagcgagtataattaccaacattttgatgttgattgaccgctccttgtgctgtttgacgcaccgcttcccaagtgacatagcgatagtttaataaattatatactcctaatcggaacaaaatacttctattcaccatgtaataacccgatacatctaagatatgccatgcccgagtaagttttcttgttgattttacaccccttgaagtgttacctaatgaacgttgtcctagcaattcattttgagattttgcttttgattgagtaaacattgtattaattccccgaagtattacttgaatgatcatagcctaaaccaatgatataacggctgggctgaatggcatcaaataaatagctgcttacggaggctaaaccagcattgattctttgatctttaacttttactcggttataagcaaatgttgcataccatccgtagggaatacgtttccataaaccattaaaatctaattgcgcagttatatttacgccaactaattttgcattttgtgcattatgatatccataattgcccttgccctttccatttttaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccatccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataatatttttcccttaataaccgcacttacagtcatgggtacgagccgaatcgaac

SEQ ID NO: 564 - DNA, 12186 bp, H. influenzae
  misc_feature (12116)..(12116): n is a, c, g, or t
aggatccccttttatggttgatcatgataccttattcgggacaaagaaagaaaattcattcaacaacgaatgaaagatattcgtaaacgtattgatgattttattcaattaggtaataaaaaataaaagggcgaaagcccttttttgttgcacattgtagaaaatagttttatatttcttcaaaaagttgtaaacttcgcaaacttttattctttggtgacttatgacaaatctatcattaaatcctatttttgaaagttttgcgccaatttttaagcaattaaaaaccgtggcaatgtctgcgttatttattgcgccattggcgataaatcatcctgttcgtcacactacacacacagtcaatattttcagtgttcaaacagatgaaaataaatcgatcaatcaacaagacatagaaaagattattgatatggtgaaagctgtttctgctatcactgattttgttattgcgtcaattacggcagaatcattaagctatattgatttaagtgacgttctgagactagaaagcaaaattaataaatatgatgatctagctaacaatattatggtcaataataaaactccagaattatcaacaacgctacaatcattcagcaataaaatgcacacgctttgcaatatgatgaaatcagaaaaatacaagcaacaatcagatgaagtagtgttatcacgcctttatcgcaaatctgaagatgcagggtacacctacaaatcatcacattcttttgatgattttaaaaaagcagtgatgatgtaggataacaaatgaagattgagttatcgaaacaatttcaagaagggcgtttaaacacgcccttttttaaagacattcaagccatgtcagatgaagaattgcagctcatctttgattttatgcaatccattaaacaagggaaactattaagaggtaaaaataaaccatcttggcttgatgataatctcaatgacattccaaatacagaggtttatcaacaaaacgaaatatggcattatcactgcggcccttacaataaaggatctagatattgtcctatgagtgggctaaaaataaatttgaatggagaaacatcaggacctgtaattcattatcaaaaaatatcagatgaacatatcgtgattatcgctttttctccacaacacgaaccgttcccacgcgaatgggacactccaaacccaatcattgacagagcataatcaaagggcgaaagcccttttttgttacctactattccacacactcccacactcgccacaccgcacaatattgccaacaataaggcattttctttaactgtgaatgcctatgtctgctgaattacaacgaaaactagacaacattatccgctttggggtaatcgctgaagtgaatcacgccactgcacgagctcgcgtaaagagcggtgacattctgacggattttttacccttcgttacatttcgagcgggtacaaccaaaacttggtcgccgccgacggtgggcgaacaatgtgtgatgttatccgttagcggtgaatttactactgcctgcatattagttgggctttacacacaaaatagcccaagccaatcgcccgacgaacacgtcattgaatttgctgacggtgccaaaatcacttacaaccaatcaagtggtgcattggttgtgacaggtatcaaaaccgccagtattactgccgctaatcaaattgatattgactgccccgctatcaatatcaaaggtaatgtgaatattgacggctctttatcaaccacaggcacaagcaccacaaaaggcaatatcagcacgcaaggcagcgtgaccgcaagcggtgatattaaaggtggctcaattagtttacaaaaccacgtccaccttgaacaaggcgatggccaacgaacctctaacgcaaaggcatagtatgaatcgatacactggcgaaacattaaaaaacgaaagcgaccacattaaacaatccatcgccgatattttgctaacgccagttggttcacgaattcagcggcgtgaatatggcagtttaatcccaatgctaatagaccgcccaattagccacacattgttattacaactggcggcttgtgccgtcactgcgattaatcgttgggaacctcgagtacagatcacacaatttaaacctgaattggttgaaggtggcattgtggcaagttatgtcgcacgcagtcgtaaagataaccaagaaatgcacaacgaaaaactatttttaggacataaacaatgagcgaattagtcgatttatcaaaactagatgcaccaaaagtgctagaagatttagattttgaaagtttgctcgcagacagaaaagcggaatttatcgcacttttcccacaagatgaaagggcattttggcaagcacgattaagtttagaaagtgagcccatcacgaaattattacaagaagtggtttacttacagttgatggaaagaaaccgcatcaacaatgcggcaaaagccacaatgttagcctatgccagcggttcagatttagatgtgattgccgccaattacaatgtgaaaagacaagtcattcaagaggcgaataataatgttacgcctaaaatccccgaaattttagaagatgacacctcattaagattgcgcacgcaattagcctttgaggggctttctgtggcgggtcctcgctctgcttatatcttccacgcactctctgcacaccctgatgttgcagatgtgtctgtggtatcaccacagccagccaatgtcaccgtcacgattttaagccgtaatggacaaggtgaaacaaacgaaaaccttttaaatgtagttagagccaaacttaatgatgatgacattcgccctattggcgaccgcgttattgtccaaagtgcggtgatccaatcctacgaaatccgcgccaaattacatctttatcgtggccctgaatacgagccaatcaaagctgcagctctaaaaaaattgaccacttacaccgaagaaaaacaccgtttagggcgagatattagcctatcgggtatttatgccgcattacacttggaaggtgtacaacgagtagagcttatctcacctaccgccgaccttgtgctaccaagctcaaaatcagcctactgcacggcaattaatttggagatagtgacaagtgatgattactaatcatttactgccgataggcgcaactccattagaaaaacgtgcggcagaaattctaaaaagtgcggtagaaaatcccattgttattgcagatttaatcaaccctgaacgttgtcccaccgaattactgccttatttagcttgggcgttttcagtggataaatgggatgaaaactggacagaagaagttaaacgcattgcgattaaacagtcttattttgtacacaaacacaaaggcacgattggcgcagtaaagcgtgtggttgagccaataggctatcttattgaactgaaagaatggtttcaaacaaatccgcaaggcacaccaggaacatttagcctaaccgtagaagtgtctgaaagtggcttgaatgaacaaacctataacgaactagtgcgactgattaatgatgttaaacccgtctcaagacatctcaatcagctcgctatcgccctctccccaacagggtcactttgtgcctttgttggtcagcaatggggcgaaatcatcacggtatatccacaataggaatatttatggcatcacaatattttgcaatcttaaccgactacggaacacgtgctatcgctcacgcattaagccaagggcaaccgttacagctcacccaatttgcagtgggtgatggcaatgggaaagcggtcacaccaacggcgaacgcaacagctctcgtacatcaaacgcacattgcacctgtcagtgccgtctctctcgaccctcgcaataataaacaagtcatcgttgaattaaccatccctgaaaatatcggcggtttttacataagagaaatgggcgtatttgacgcacaaaacaaactcattgcctacgcaaactgtcctgaaagttttaaaccgacagaaagtagcggaagtggtaaagtccaagtattgcggatgatcttaaaagtagaatcttctagtgcggtgacattatctattgataacagtgtgatttttgtcacccgacaacaaatgacaccaaaaaccattactgccacaacgcaaaatggatttaatgaaagcggacacagccaccaaatagccaaggcaagcaccacacaacaaggtatagtccaactcaccaacgacacagggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagatggaaaggttggtttaaatggtaacgaaagcattaatggcgagaaatcctttgaaaatcgtattgtggcaaaaagaaatatccgtatttcagacagccagcattatgcttcacgcggagactatttaaatatcggggcaaacaatggcgattgctggttcgaatataaatcaagcaaccgagagattggcacgcttcgtatgcacgctaacggcgatttaacctacaaacgccaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacttagcaagcggtcaaaatctacccgaaaatggggaatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcgatgaaggagtgattaatgaaagtctattttttaaaagaaaatttgaatagttatcaaattttccctattcctcaaaacttaaatgattttgtggaaatggaagtagaaaacgaatcagagcttgagactaaacaacttattgattttaaaagtcaatacattctagttgatagacaaccaacagaattacacaaatggaacggaaacagctgggttgttgataaaaaaaagaaaactgaaattaagcgtgaactcattaaaaatctagttgatagcattgatgatacagcagctaacattagtgcaagatggacaaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagcttgcgtacattgcaacaacaattagcagtgcaaagaatgcgtaagtatgagttaaagcatgaggcgttgagtgatgaagaactgcaacgtattcatgacgatattataggtaaaatgcaaacattagcggaggcacaacaatgataggcgctaaaatctatctcgcattatacaaaggtaaaaaaacgggtaaaaacccgagcgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggcggtgtacgttgtaagcaaattgatgtttatgatagagaaaaatgggatttaattgagctagagggagttactgaagcacaaatcaaagcttattttgaccgcactttgggctgtaaatatgactggtggggtgcgttagggattgtgctaggcatcaaacaaaaacgctcaaaatatttttgcagtgaatggtgttttaatgcgatttgcggtagcgagagcggttggagatttagcccaaatcaactagcggctatatttaataaagagaaaagttaaaaggagcgtttaccctgcaaaacttcaaagggtataaagatttaaattgcttagcgagttggttattgttcagtgggcaacaagtggcaacgtttgatgacttattccaacataatttctggcattgtattcgtcagtctgattatccaaaggctgatggctatttggacggcgtagagattgtgaaagaatcattccacacgcttttgcctaagtttagcgatgatccgaaagcgttatttgtgttagatccgccttacctttgtaccaagcaggaaagctacaaacaagccaaatattttgacctgattgacttcttgcgattggtcaatatcacgcgaccgccgtatgttttctttagctcaacgaagtcggagtttattcgctttatgaattatatgctggaagataaggtggataattggcaggcgtttgaaaacgccaaacggattacggtcaatgccaagctgaactaccaagtggcgtacgaggacaatttagtctataaattttagctatgaaaaaggcttcgggtgatcacgaagcctttgttttagtcttctaattcggaaagcaagcaataaaacggtggggcgaaaggggcgagcgtggacgtaaatctcaccacgcaatctttgcgtccgtcttccacaaaacgcacatctaaaaatgccgtgttatagacaaaagtttgcccgcattcgttaggcagtgaatattgcgaaccgtctacaataaaaccgtcgtgttctttcactgcaataagggctaattccatcatcatttcctgctcggttctcatttgaaaatttgtcattttgtggtttcctgtgcttgtttaagttggtcacaggattactctcttcggcaggcatagcaagtcatcattgcggcaaaacgactgactgcggtcgaattagactgggggggtatggacggctaaataagtgcagatatgtaatgccatttcactaaatgaaaaaacaagaaaaggaaattatcttgcttttttaggaacggttatgttgtgcgggtttatctaaagtgtaaaatttaaacgccctttaatgatgatttaaagggcgttttgtctagatatatggcattaaatataatggtattatgaatggtattatataattatgtttcttttgaaaatttcgttttaaatcaaaatattatttaattaattctaatccagctagtcgcaccatctctatttttctctattccccaattttcagatagaaatagataaaatataagtaaaaacaatagcttatataatttcacacactaaaacataccttcttttttatatcaaaatcgcctaaaaggtagtatttttataccgattgggatcgatttcgatctgttctatactccattgcacatatttttgcacacgtgtattgcacacatttttatggaataaacaatggcgacaattatcaagaatggcaagcgttggcacgcacaagtgcgcaagtttggcgtgagcaaatcagctactttttttgactcaagcagacgcaaaaaatgggcagaaatgctcgaaaaacagctcgaatcaggaaagtataatgaaatccctgatattacattggatgaactgattgataagtatctaaaagaagtcactgtaaccaagcacgggaaacgtgaagagcgcataagactactgcgtctttctcgaactccgcttgccgcaatatctttacaagaaataggaaaagcacactttcgtgagtggtaaaatcaacgattaaaagaagtctctccagcaacagttttgcgtgaacgtagttcgctttctgctctaatggccaaaacgattgaatgggattttataacagcccccccctaaaatatcttgagaaaccaaaagcaccagcgccaagaactcgtcgatataatgaacatgaaattgagcgtctgatttttgtgtcaggttatgatgtcgaacatattgaaccgccaaaaaccttacaaaattgcacgggggcggcatttctttttgctatagagacagcaatgagagcaggggaaatagcaagtttaacttggaataatatcaattttgaaaagcgcaccgcctttttgccaattactaaaaatggacattcaagcacggtgcctctttcggtaaaagcaatagcgattttacaacatcttacttcggtaaaaacagaaagtgatctgcgagtattccaaatggaagcacgccaactggatcacaacttccgcaagctcaaaaagatggaagggcttgaaaatgccaatttacattttcacgacacccgccgtgaacgattggcagaaaaagtggatgtaatggtattagccaaaatatcgggccatagagatctcagtattctgcaaaatacttattacgcacctgatatggcagaaggctataaaacaaaggcgggttatgatctgaccccaaccaaaggcttgagccaacggaattttttcttctttaatgaaaacttcatcgttttcacaacaaatccaccgatagtcattaagctgtaaccgtccatggagcattaaaaggtcaatttgtgacggttttaatggcgaaccgataggcaacatcaatagattagcttgatgttcaatttttgaacggttacagttattgacacaagtccaagcggctcgatgcgccttgtttgttcggtggtctccgaattaagtgcggtggaacccaacgcacttttcgctgatttaatcacccagttttttaatttggtgatgattttcttttctgtgaatctgttttttacccccacaattttcttacgaatctcaccgtatttattcggttcgcattcttcatactcaatacaaataggctgatcacaacgttttgtcattgcgccaccttgcgcaaactatcactcaacaaatcattttgccgtatttgcaaattaatgttgatccgaatattgcgccacatcgtatcccttattttgagtttgacacaaaagaatatgaagacttatcggtatttgcagatgccatccctaaacttacgggcattggcgtgcagatttcggaaagttgggtgtgggataaattagggattcctgaaccgcaggaaggttaggcgaaagagatttgaaacgccgtgggattgataagcctgacgacagttctgaatttttggtggaagtagaacgcccagcagataagcaaggtaatcgtgaaaagacggtagggtttaaattgcctgatggcacgatacgtgtgacggataaaggctttgattacaatgtagggcgattaaactacaagcctaatttggatctttatcctgaaaaactggcgcatgcgtttgcgaaggttgagatgaaaggtggggagtttaagcacgattttgagttgttggcaaagcatatggcggagatgaaacaaacgctcagcctagatggaaaaaaactcactgttgatcaaatgttacaggtgcgagatagtcttaccaaaaattttaaatttgcggcaggtgtcttgagtgcggaaagtaaggatttattgaaaagcaaaactggcacagtgtggctttctgatgatactttaattaaacagtttaatagccgtgatgggcaagattttggactggaaagctatgcacttttccctgatttatttaatcagcctgatattgttctacaagataatgatcgtttttattttatcaaaaactttgagaaacagcgtattttaggtgtaataaagcacttatctaaatttaatgaaatttttgtgctttcggcaagggagattaatatcaaggaagtagaaaaaatgaaaggtaaattggcagttatcaagtaaggctcccgatcacttacacacgctctcggacacctgagcaggacgagccacctcaagtaggctgcggcagggagattatcaccgcttttttaataactgccttgcatgaatatacccccttaaattttaaaaatcaacaattacttcctcaaatttttatgcgagcaaaagggcgatcgattcgtttgattgggttacatgtcaatttacccgaagaaaataaacaagaacaaatgagcctctggtgatataatctcgcggttttttaggagtcgataccatggaacataaattagaagatattattgcaatttttaatcaatgttttgaagaggaatacaacactcgcttagtcaaaggcggtgatgagcccatttatttacccgcaaatgatgaagtgccttataacgcgatttattttgcgcgaggcttttacagcagtgcattgcacgaaattgcccattggttagtggcaggcaaagaacgccgtaaactagaagattttggttattggtatgagccagatggacgttcagaagaacgtcagcgtgattttgaaaaagttgaagttaaaccgcaagcattagagtggattttggcaacggcggcaggtttccgttattttgccagtgcggataatttgaatggcaatccgggcgatacacagccttttaaacaagccgtgtatgaacaagtgaaaatctatgcggaaaaaggtttaccaaaacgagcggaaatgttacgcaaggcgttagtggcattttatggcacagaagatgaaattgatctggcgaagtttgatgtcgtgcgtatttaatagcagaaagtgagcaaaattgctcacttttttcagtcttaagcccccaattccctcctaattaaatagttcaatttttaatcatttcacacccagatactgggggggtgttcccncccccaagcacgcatctcatatttattgctccccaatatgtttgtctttttcttttcccccactacccgc

SEQ ID NO: 565 - DNA, 12596 bp, H. influenzae
cgcaggcaaacattagcattgtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggtggagtaggccggagaattaatagagcaggtaaagcgtcaaaaggagtatctagcaaagaagaatgttgaaattcgagtttgtgctattgcgaattccaaccgtatgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcgcgcaaattattaattcttgctcgtgaagcgggaattgaacttgaactttcagatgttgaagttgaaggtgtattgccgaaaggcttctctgaaggaaaatctgcagatgagtttatggcaatgttgccacagcttgacaaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacattaataaggatttccaatgttaagaatttacgctcctgcatctagcgcgaatattagcgtaggtttcgatactttaggtgctgcgatctctcctattgatggttctttgttaggcgatgtggttcaaatagaatctatttcaagtggttttgagttagaaagtgcgggctattttgttcgtaaattaccgaaagaaccacaaaaaaatattgtttaccaagcttatgtgctatttagcgagcaattaaaattacgcggagcaaatgttaaacctttacgtttaacgctcgaaaaaaatatgcctattggctctggtttaggctctagtgcttgttctattgttgctgcattagtggcattaaatcagtttcataatgaacctttttcgaaaatggaattgcttgaaatgatgggagaattggaaggtcgtatttctggttcaatccattatgataacgtcgcaccttgctatcttggcggtgtgcaatttatggtgcaatcgctcggcaatatttgtcaaaaattgccattttttgataattggtattgggtgttagcctatccagggattgaagtttctactgctgaagctcgtgcaattttaccgaaaagctatactcgacaaaacgtgattgcccatggtcgtcatttaggtggctttgtgcatgcttgccatacccatcaggaaaatcttgccgcgattatgatgaaagatgtcattgccgagccttatcgtgaatctctgttacctaattttgctgaagtaaaacaagctactcgagacttaggcgcacttgccacaggtatttcaggctcagggccaactattttctctattgcccctgatttacaaactgcaattaaactttcaagttatttagaaagccattatttacaaaataatgaaggttttgtgcatgtatgtaaagttgataacgaaggcacaagagaaattaaataagttaatttaaatagatgaaatcagattaaaaacggattaaatatgaatttatacaatatcaaacacccagaagaacaagtcactttttctcaggctgttcgtcaaggtcttgggtgggatcaaggtctattctttccagaagttattcctaaacttaataacattaatgaattacttgaattgcctcttgttgagcgtagtcaaaaaattctaggtgcattaattgatggcgagttaccacaagcaacgttagatgcaatggtaaaaaatgcgtttactttcactgcaccgttagaaaaagtggaagataatatttatgcacttgaattatttcacggtccaacgctagcatttaaagattttggtgggcgttttatggcacaggcacttgctgcggtacgtggcgatggcaaaattactattttaacggcaacctcaggcgatactggagccgctgtagcacatgcgttttatggattagaaaatattaatgtagttatcctttatccaaaaggcaaaattagcccattacaagaaaagctattctgtactttaggtgggaatattcgtactgttgcgattaacgctgatttcgatgcgtgtcaggctttggttaagcaagcctttgatgatgttgaattgcgccaagctatcgggctgaactctgcaaattctattaatatcagccgtttattagctcaagtttgttattactttgaggctgtcgcacaattgccaaaagaaaaacgtgataatgtcgtggtttctgtgccaagtggtaattttggtaacttaacggcgggattaattgcaaaaaccttaggcttgccgataaaacgctttgtcgcctcaacaaacgcaaatgatactgtgccacgttatttgaaatcgggtaattgggatcctaaaacgacagttgcaaccctttctaatgcaatggatgtaagtcgcccaaacaattggccgagagtggaagaattgtttaaacgaaatggttgggatttaactgatttaggttcggggatgctaagtgatagcgaaacagaagataccttaaaagcgatgcagtcgaaaggttatttatgtgaacctcacggtgcgatagcttatcaggtgttgaaagagcaacttaaagcgagtgaaacaggaatcttcttgtgtacggcgcatcctgcgaaatttaaagaatccgtagaacgtattcttggtattcagcttccattacctgaaacactggataaacataatcagctaccattgctttcagatgaaatggataatgattttgcacaactacgggcttacttattgaagtcataaagtgcggtaaatttttattgtgttttggatagcatctgattttcaggtgctattttatttttagaaaatagggtatagagataaaaaaataaggatatattaactaattaattttacattaatagaaagaatagctatttatcaataagacagtgatttgaaaaagtagtattaaatttaggcaataaaaaaataccttttcggtgattactttatttttaagtggtgggtcgtgaaggattcgaaccttcgaccaacggattaaaagtccgctgctctaccgactgagctaacgacccaattagatgattttaaagtaaattttaaaatctttggattggtattttaaatggtgcccgaagccagacttgaactggcacgcctcgaaaggcgagggattttaaatcccttgtgtacatcatttaagtttgaaaactatttgtttagaccaattccgtgtacctagccaatacaccatgatctacccactaacgctctgtggataggttagatcttacacaaaaatactagtttgtaaagcctgaatgtattaattttaaaaatatttttataaggatgaataagctgagaatgagcggtttaaatttattttgcaaggaacacccttagatgctccttgcatacctatctaaagtaattctgtatattctcttattgaatcaatattatcttcaatataactcaatgtaactttgacatctttatgtcctagtaattgtttggctatatataggttttcaggttttttcattagatttgttgctgctgtatgcctaaatctgtgtggggagctaataattcctgtatattttgaaataactttgaagatatagctcacctggtcattggtcattttctctccctttcgtttaactgcatttgaaaataaattaatgttaaatagttgagattctacaggctgattcaatttacttagttcagttaataatttctttagataaggataaagtgtagttgatataggaagtatatgatactcgtgatttttatttatctcagatggaatatgaataacttgatttagcaaatctacatctttaattcttaatttatttaactgagagcgtcgaattgccgtatagcggaaagtcataattatagttttagtaaaccataatgggcgaagaatagaaggaagatgctttgattcagtaattccaaagctaagtttttttaaatctgaagaagtatatactttccttttcttctttccttctctaatgaacaaaccatcgaaagggttctttgtaaatgggaggagttgtttttcaattccaaatttgaaaatagtctttagctgacgaatatagctgttccaagtcacttcaatgatagattgtccaacaactctctttctccattggagtattaatgagtctgatatttcatcaggatattgaatactacaatttttctgtaattgtctaattgctttttcatagcttttaatagtatctatacgtaaatgacggtataaaaaaaattactaagtaacatatcaaatgtggttctattcactttcattttcctcaataagtgataaatgcaaattatcaattggaattctattaccgaaaaaatagtcggttttatcaatcaaatacccaatcaattgagaggttcttcttgggccaataaccttacagcgccaaaaattaatactatcattgtttgattgacggtatttcttgtgtaatttaaggtcttggaaactatattgcaaattttcgatatcttttttagtaaagttagtaatgcccttactattgaaaaatagctgaaagattccaggtgttacaaggaaaagtttgcctttgactatatgtaatttagcatttgaattattaatagttagggtattcccgataattccagattttagccattcaacaaaaatctctcctgagacagcctcagtttcctttgtatcatcatccgttgctatagatggggtagaggcgattttatttatttcactttcttgagatggttttttatcagtagagtcttgagattcttctacaggtgaaaataaattcattaccaaatcagtcatatccgtctcggtttctgagttttgggtattgatttgagtgttttgagaggatgtattttcagataaatccggtttattcagtgtacctgttattgcaggaagtggcatttcagattccataatcactgaattttcttctttagtatcttcacctgaatttaattgttcttcattttcaatatcgactcgacctaaaaatataccaggtctgtcattaagattttcccaagctacttccggtttaattctgagtaaagaaaatgctttaggtgggcaccagcctgaatcagctttaattcgacaatgccaaattgctgtaccatcatttgtactttcaataatccccagcgattgcatttcactaaataatttaggattgtctgctggagctgatatcccttgctccaataaataagctcgaatttggtctgcagtgggtttgctcattaaccatagcgcatcctctgtaagccaaccatcagatgggcctttaggtgtattaattttaaatttatgttgcagtaaatgacgtaaagccatgactagctgttttgcaaatgatgttataggtttctgagtcagttttgatacgtctccacctagtgcaagagttacactgttttggtctgctttttgtactatttcagataataaaccagctttatctttatgatcagccatggcatacattaaagctgaaaaagcttccgggtattctgctaaccatgcaaatgcttctttaggaattaaatagtttgcaagaaaactacccataaccgggtgaagatcataatctcgccctttaatatatttgaatttataaggttgagttggcactcctaaccaaggaaaccaacgagaaccatcttttaattgtatatctatatcaacaataactttaccaatgtcatgaaccaatgcagcataaataacagcagcagtccaagcatcacgttgcttagattgttcttccggagcagcattttgtggcaatacataactttgtcgtaatttagctgcaaatgaaagaacttctaggccatgatcaagcataccacctaaatgtgagtgatgatgtgattctgaggcaggtagtaattgaaccatttcagcgtagcgctcgataggttttttatagagctcattaaacatatcttgcgtcattgatacttgttgccaaagtaaatttaagtatttttggcgtaattcagaattgagtaattctgacgcagagaacggagttatccatccctcactatcaatctttgacattgaatggttatgggaatctagaactggaatagtaaaggaatcttgttttttcccttttaatcgataaaaaattgatgaaaacataaaaaaataacccataaatttttgcaaaatgctaccgatttatgagttaatctcaataaataaatgactttgattcaagaataaatattaatacaagcttaatatcgctagaaagagtagctaccaagcatggatagattgatactcttacttattcttaatttactacaaaactttttgaatcattaacgtattcactaaggtagcattctattataaataaagcggctaatttaatggtcaacctgttacaataatccagatatcgagtgtatggaatgcaatgttcagctccagtccctccacttttatacattattttttcaccatcacgccatattgacgcatgatgagaaccatttcgaatagaagattcaatatcattttctgcaaagaccgaaaatataggagttaatttaaatggatttgatttatttgctttatttatttctaggtattttgatagcttcattgacttaaattcatcaaactctctaccgtccatgatattattcaaacaagcaataatagtcatatttgaagttagcgcttcataggcatctccataatatagctttatctgctcaaacccattagatgacactattaaatcatcaacattatgtccgattctagaatacattactatttgaccgaagtgatctctatggcgaaaatattcagagaatgtatttaaatagcgatattgattttcttgttttaactcactctgccaatacctaataaaactagaaagcttgctttcaggaatatttttaatcgtattaattatcggttctacaatgttttctaacatagggtaaaaaagggaatcaaaaaattcatgaatgatatgaaattcactataaacactacctgatttataaactataatttctttatcgcgcataaaattagatgatgatgggttcatatccttgtttctatgtttagtgtattgcaaaacaaaatttgaagcttttttgttatcttggatattagttatcattcctttaatcaaagaccatttgtgtggtgcatttggtatatcaaattgattatcaaaactttgcattctacctggtatatacctcatatgtggaattattagaggccccgaaattaatgtaggaaaacaaaaaggattatgtaaatcatgtttattaaatgcacaatttgggtgaaaatttaagacttcgagttcaatattaggctctcccgaaaaaagagagcaattttctacggcttctacatcagctcttggaggcttagtccttatagcaaagactatattaatattgcaattagaacaatcaaaatagtgtttctgataagaatcaaacccaactccaacccttattctgtagcgatgtccgcataactcacattttaatcctgtacttataaccattagttctccttattttccatcaccttactaatttctataatcattcataatttacgtttattcacataaacgttatctttcaagttgtaaaattttatcttaatcttattcgttttagaattccgttaataatgtttaatcaatgatattgatgccatttttagccttttgaaaaaaaagccttttggcctttttaggtaagacctttccattaggaaaggttacctttgacccttaatcccgttagagattcctttaaccttttagctttttgggtggttcatcaaggacataataattgataaaagtactcaatgaataatctgcattaatgaagggagttaactggatgttaggtggggagaagaccgattattgatacataagtttgacaatgttttccaaaagaaggacaatacccagagaagatagtccctcacaccacacaattagagcggaaatgttatactatcttactgataattcatgttaattaatacgttttttagtatatgtttttgactgggtaaatatcccctcggtcgttaaatatagtagggatcctcagagtgctactcggccggcttataatgagtaagtagagaatttctaggcagcggctagaaagaacaatggggagctttactccccattgttctttctacttattagttattagccatcaattttatctagagtagcatatttgctttttccttttagggatttatctcatcttcaaatttttttagtaatttatttacgcgttcaatttcttttgccaatttatagacattcgtatccaaacatctgagaacaaatagcatctttatataaatagctcttagtttagacttgaaaataggctcgtgatgacaaattctatttcttaattcattcacctcatcattaattttgattagtttttgggttagcttgttataatcttctctagttagcttcctatttattgaaaacaaggaactattgaaattatataagcgagggtatagtggatgcccagacttacctacactaccagaataatagaaatgtttattcaatacttcggtccaaaaagcgaagtttaatctagatacgatcattggtgcactgatagttgaagctcccaattcattcaacttatctctaaagaaggagcttaagcgcttcttgaagtagtaatcattaattgaatcgctaaattcactattcactacagcaaagattttgtttcttaacgtaacttcatataagtttattacttcaaaaagtgctgatgaaatctgaatattccacaaatataattttagtgatttcaagctaatatcagcaggagatagattaggttcagaagaatgaatgtagttttgataaacagaaatccgctctctagaaaaagatgtgataaaattagtaatacttaaattcatggtttagatgttgattgactattgacaacggtatgattctatcatactattaaccacgctgataggttgcacagattaagcatttgtcttaatgtcttaatgtcttaattttcccatcctatatatttagtggacaaagaccaccattttcgtgggtctttgtcattttagattaagaaaagtagaaatcagtcgaaattttcagccctaaccatgattatcaaaggcattatagcgctttctccttattcactatccatttcatttaagctatcgtaatcaccatattcaccatctgactcatcacctgatagttgcgactctaatacttgccgatcttcgtctcctagaaatttccaatagttacagattaattcactttctccatatttttcccacactccagggtaaaaatattcggcttctacatgacagattcccccgatgtgcggttctctgatatttgcttcaaccattaagcttattaaaaagaatggtagtaattttaaaaagacatttaacatggctctgttttagtagttttttggagattctaagagaattactattttttggtagaagaatttatctctgattctaaatcaatttattgctgtatttttattttgagcgagtattctgtctaaaaactttgatagatgtttttagatagtctgaaaacgggtaaagtatgagtttttagactaggattaacaaatagtctaaaaagtataaagttttgaacaaaggagaaaaacgatggtagaaatattcagtttagtggcattgtggctttgcataatttctttgtggattagagtttatcttttagaaaagaagattattgagcttaaaagcaaaattgataaatcttaagttttgcacatacaaggagcaaaaaatggaaaaaatcacagttcgcctaaattattgtctagcagacaatgaaattcgattagcaaacatagataaattaaagctaatcatttatttatgtgaaatgaaattggaaaaaggtattgatttaccttttaaagaggtaacagtaataggtacagattacatatctgatgattacactctaacaaaatcgttggggcaggttgtaaatcgatcaagaaaaataggggtcgttttcactctatgggaaaaatgggaacaaaaagaatctgatttttctaagtgttgaattttgaacaaaggagtatttatgaaaggctatgaaattgaacttgaggacaaaggacaggatttcacaaagttaagaacggatgaacaaggtatagtgatagcagccgaaccatatcaaacagatgtatggaaaggggctttaattcctatttctcaacaaaaaataggtgatttatgtatgattcatcatttaccgcatattgaatatggttatctgaaatacaaagtgttagccattaaagagattaactattaagttttgataagtgaggatacaaatgttttatgtaataacgtttttaatcttatggtgcggttttggactctatttactagataccgaaaagaaccctaatagaatgaatctagatgatttaaaagataaattaagaaaactttgaattttgaacaaaggagtaaaaatgcagtttaaaagtgtttctttcaaggtttttgtgtctgccaacatgcttatgctggggttatttgctttttttcttgctcctgcaattttacttaaacagcttgaatttaatggagctgaaatagttgaacttttaagtatttatatgggaatgaccgctgttatctctgctgtttgttttcttacaaagaagatcggtatcgcaaagtattttttagtggaatttatattgctagcgataatttttgcatatttaggatataaatttaatgttttgaatttttaataaaggagttaattatggactatgattatcaaaaaggctttgaagaaggttatagaatgattatgggagcatccgcattgctacctttagcacctattcaaccattgacgccgcttggaagcactccatttagagagggtttaaaagctggtataaatttagctaaaagaaataaccaacagtcatttaataacatttttaaataattttaagagataagatggcattaataggatttgctcgagtatcaactcaacagcaggatctaagtgaacagattcaagtattaaaagaatacggctgtaagaaaattttttcagggaagcattccggtaaagctgagaaaaataaagcacaattggatgaactactggattatgtccgagagggtgatgttgttgcagtaactaagcttgaccgcctaggaaggagccttgctcagtgtttgaatacacttgaactatttaagaataaaaatattggttttgttgcaatacaacaaggaatagatacccgaacccaaaacaatcctatggggatggccttaattcaattgttaggtatttttgctgaattggaaagaagttttattgtcgagcgtactcaggaagggaagcgaacaaaacttgcttcaggtcataaaaatgcattaggcggccgcccacctaaagtgacagataaaatacgtaaaaagatttatgcggattttaaagctggtgattctatttcaacagtaatgaaacgatatgatttatctaaatcaacggtggcgagactaaaaggtatttataatagggaaaatttaatggctgaagagtagaaaaaaacagctatgtatttcttgatattataaacaaaaatggcagggctcaactttgccattttcgtttggtttgtaaattggaaaagtctctaacagagttttttacatc

SEQ ID NO: 566 - DNA, 13379 bp, H. influenzae
gccagctacgttgcctgcaggtcgactcttggaaatccccttgcttatgcagtggaaaaggcgtaacgaatttacgcgtgatttgccacgatgcaacggaaattttacgagacagtattgctgatggtgcgcttggcggtttgcagttatttttccccgatccttggcataaagcaaaacatcataaacgtcgtattgttcaaccgcactttgtgacacaagttatacaaaaattaggtaaaaatggttttatccatatggcgacagactgggaaaattatgcagagcaaatgctagaagtattaagcgcaaacaccgatttagtgaacacctcgaaaaatggcgattatattccaagaccagattttagacctttaactaaatttgaagccagaggttacaaacttggacatggtgtttgggatttatattttgtgaagaaataagcggattttaactaaacccaatacctaatttatgaatttaatataaaatacacgtttgaatataaccttaataggagaaataaaatgtctaaatcttacaatcaacgccaacgcaaaaaacttcatcttgcggaatttcaagaactgggttttcttgtaaatttccaatttgcagaaggcactgcgattgaaactgtagatgaaatcgttgatcgttttattaacgaagtgatccaaccaaatggtctagcttatgaaggtagcgggtatttacattgggaaggtttagtttgcctagaaaaaattggcaaatgcgatgaaagccaccgtgaaactgtgaaaaaatggttagaaacaaatggtttgcaacaaattgaagtaagcgaattatttgatatttggtgggaatatccagcaaaagctgaataatctaaattgaaagcagcataacaaaaattgctatgctgttttgttttaatcccttgcaaaattcattaaaccttaaattttttgatctataacaaataaagttcaaataattgacaaactacctattttgggttgttctcattcattcatcgtaaacacataatccttcatctacagaagcattcagaaatattttaaagacattatgaccgttgaaaatttacctcgcagacaatttttacgcggtaaattttcaacattgagctgtttagaaaataatcaaaaacagaattttgtgggtattagaccgccttggtctgtggaaaattctatttttgtagcacaatgtacgcgctgtggcgactgtctttctgtctgtgaaaccaatattttggtaaaggacgatgctggttttcctgaagtgcgctttgataatggcgaatgtactttttgtgggaaatgtgtagatgcctgtaaacagcctattttttatcctcgtgaccagttaccttggtcacataaaatcgacattggcgtagcttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccctgtgaatgcaataacaatgaacgatctaaaacaaaatgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaataattttaaaatcaaacgtttaacgtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaaaaaccatgtaaaaatcaaccgcactttatttctcccatcaataaaagaggaagatgaaagtgcggttaaaatctaaaaagaaaatgaagaaacccgcccttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgtgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaagggacaactgtaattcctgaaccagcagaacccgtgctcgcaccaattttagggggcggaaaataatggcaaatgcaccaaaatttgcagggaaagaggctcgagaaaaatggggctggtggtatgcaaaccgctttttgttttggcgtcgattaagccaacttagcattcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgtgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatcctattgttccaaatgatttcaaaccgatgaaaggttacggaaactaatttaagaggtctatatgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcgcatcgtttagaaatggctcaaaatgaatgggcgcgtatgaaagctaacgattctaaagaatgtcgtaattgccataatgtagatcgtatgaacttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtgattttctaaaaataggctgaaaaaataccgcacttttttcagcctattataaatttgggtagtttataaaaaaatctgcactttaattcgctgatttattcagcctttaaggtgcagattaattatattttctaaagtgcggttaatttttagattatttttagcctaagattttatctaactcttggctaacttcttctactttttgtgtaccgtctaaacggaaatattgagtattccccgctttcgcttctgcttggtaataatcaattaatgggctagtttgtttatgatatacggctaaacgatctaatacagtttctggtttatcgtctgcacgaataattaaatcttcgcctgttacatcatctttaccttccacttttggtggattataaacgatgtggtaagaacggccagacgcttggtgtacgcgacggccactcatacgttcaacaatcacttcgtctggcacatcaaattctaaaacaaagtcaattttaacacctgaatctttcagtgcatccgcttgtggaatagtacgagggaaaccatctaacaagaaaccatttgtgcagtcagcttgagcaatacgatcttttacaagggcaacggttaattcatctggcactaatttaccttcatccattaatgctttagcttgtttgccaagttcagtccccgctttgattgcagcacggaacatatcaccagttgaaatttgcgggataccaaatttgttcataataaattgtgcttgagtgcctttacctgcacccggtgcacctaaaagaataattttcataaaaaatctccattaatacaaaacgtgattaagatactgataaagcatagtgcggtcaaattttttataatttttaccgcacttttatactgagctggtcttattattttcttgcttcaaaggtgctacccaaaataaacaaagcatgccgggaatcgctaaaaataaacaaaaccaaaaatactgataataccccactgctcccacaacataaccagaaagtatacctaaaactttacttggcaaagctgaaaggcttgtaaaaagtgcaagctgtgttgcagtataaagaggattactctcacgtgccataaaagccacaaaagctgcggtaccaagtccaacgccgatatattctgcggcaatcacaacacctagtttccataactcggcagatgtaataacatcaaaatgaccgaaagcagacaaccaaataaacccaccaattgttaccatttgtacaagcccaaatagccacaatgcacggttaatacccagttttagcattatcataccaccagcaagcccagataaaatgcttgaccaaagtgcgttactttttacaacaatagcaatatcctctttgctaaatcccatgtcataaataaatttggtttgtaacgttgtggcaaaagaatccccgaacttatacaaaaacaaaaatagtaaaaaaccgatagcctgaatgacgcccttacgctggaaaaattcttgtaatggaatccaaaatgcttgatagaacggctgattagtttgctgcacgttgattttcggctcttttgctaaaaataatgtcatgaagatgcctgctaacatacaaagtgcggtccataaaaagacggtttcccaaggataaatcgccgccaaatatagcgataatccccctggaattaatcccgcaattcgataagcattaatatgaatagtgtttcctaaacctaattcatgatcactcaaaatttcacgacgatacgcatccaacacgatatcttgtgtagctgaaaaaaaggcgataagcaacgcaatatttgctactgtacccagttgtgtgagcggatcaaacaggctaatgatgtaaagtaaaatcaataatgccacttgtgaaagcaacatccagctacgacgacgccctaaaaaactcgggaaataacgatctaataatggtgcccacaaaaatttcaatccataaggcaacatcacacccgttactgcaccaataagctcaattgaaagatgtttatctgtcagccaaacaggcaacatttgcgacaatacaaataatggcaaaccagaattaaaacctgtgaaggcgcaaattaacatcttgcgcgtaaaaatttgagaagaaagggaatttgacataaagtgcggttaattttagttgtattttagaaatttcgcctttcaattaaaggatttttgtaaaaattaggggatttttaatcattcccctaatgtttagcattcttcttcctaaaaaagaaaaacaaatattagagaatattaatctctatacccttttggattatttttctgccagttccacgtgtcttgcatcattttttcaagaccacgttctgccacccaaccaagctcttttgcagctaaactaggatcagaatagcaagtagcaatatcgccagcgcggcgttctacaagtttatatgcaattgtaatattgttggctttttcaaaggcttttaccatatctaatacggaataaccatggcccgtaccaaggttataaatatgtaagccagcgtcattttcatgacgttgaagcgcttttaaatgccccacagctaaatccactacatgaatataatcacgcacacctgttccatcatgagtgtcgtaatcactaccaaatacagaaagttgtgctaatttaccgatagcaacttggctaatataaggtaataaattatttggaataccatttggatcttcaccaatcaagccactttcatgcgccccaactggattaaaataacgcaagatagtcatgctaaattttggttccgcttttgctgtatcgcataaaatctgctcaaccatatatttagatgtaccataaggattggttgtaccgccgacctcacaatcctctgtaattggaataatttttggatcgccgtaaaccgttgcagatgagctaaatacaaagttccaaacacccgcttttttcatttcttgaattaatacaagggtgccagcgacattgttcatgtaatattctgtcggcttttgaacactttcccctacggcttttaaccctgcaaagtgaataaccgagttaatctcattttctgcaaaaatttttgtaacaaagcacgatctaaaatatcgccttcataaaactttgcttctttgcctgtaatttgttttacacgctcaagggattttggcgatgaattgcaaagattatctaataccaccacctctttgccagcatttaataattctacaactgtgtgagaaccgatataaccggcgccacctgtcactaaaatggccataatgatttccttgttaattattgagactaaaaaattatatcactattttgtgtggtaagaatggtgattttcaataaaataaaaaacctgttgctaaaaagtattgttgtagcgagtgagataacctctcatatttagggctatgtccattagttgtgtgatataaggttatctaatcccattttcttgattttaaggcgtgttttatatcattaggtaaacgtaatatatcccagaacaaccgaaaaatcagattttggtaaattcttggtttggaatatataccaatttttttatatacaaacttcggcggaattaaaatatcttgtgtgtaatttttcttttcttctggaataaaagcaattgggttattcagtggtgataaaggaaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctttttgatgatgaaatgcgtaaggattccctttttcttgataaaaatcaatacctgttaaataaagatctttataacccattgcagtcgccactgcacacatataaacgcctgatgtaatcctcttattctcatataattcgtgatattgtaaatgagcattaaaagctcgtagttttttcaaatagcaatgaccaagatcaatttgtggcagtaatttttctaaatgctggattttctttaatgttgaatcccctaaattcagaaaagatgctaagataatatcagcatattcatatttatattcattatttttaattaattgcataaacgtatagtattgttcaaaaattacagaacaattaaaaaataccttttttattttcttgccaagaaaataatgatcttcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattgacatattgtaccgttcattgaataaaatagaagttatccctaaaaaataataaacattatatagatttatagaactttttactaaacgttgattataccttcctaaaattattatctaatatcagttgtactatctccgttgtatcttagcaagaaaaatttaaaaatgcttttcttgttccattcggatagaaacctaatcgcttgttttttctaccaaacaagcgtagacttaccaacaatttttagtcggggtgccgaaaggctgagatgatacccgtgaacctgaaacagttagcactgacgtaggaaactaatatgccaaaaaatccattttcttttcattccatttcttatcctttcttttttattacgcattccctttaatcattgaggcgagcaatggtgcgtattcaagatttgagtcttgcctttaatgggcaaacgttatttgagcatcttaatttaaccctgttgccgaacgaatgggtgagcttattgggcagttcaggcgtgggaaaatcgacacttttgcgactactggcgggcattgaaacgcaaggtgtggtgcaggggaaaatcctatttgaaccgaaaattcgtattgcgtggttgcctcaaaaagagaccctttatccgtggttgtcaattgtcgataacgtgcagttgcaagcggtcttatttgggcgaaaatctgcaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggcggatttgattttgcttgatgagcctttttccgctcttgatgccatcagtcgccatcaacttcaagatttagcctttgaactgctagaagataaatcagtgctgctcgtgacccacgatccgcaagaggcattacggctaagtcagcgtatttttgtgttgcgttcgcctgaatctcatcaaacagcattatcggcggtgattctgcccgaaggtaacgcccctcgtgagttgcatcaagccaatttatgggcgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtagggcagcagttattcacacacgctgaactgctttggcagcatacgcaagtcacgttgttagaaatttgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggccgcctgttatgatggactacgcatatccctcaagcggggtttgattggcgaatacctttacattttccccttgtgttcattgctttaagggccaattacctgccgttttgccgcttttgtctcggtttttgaaatgccggttggtcgccccttcgtttcccggccattcccggtttctc

SEQ ID NO: 567 - DNA, 14669 bp, H. influenzae
ggcagcttgctgcctgcagtcgatctaaagaaccccttgctctaaccttctcggaaaggatgtgccatgtggagagtgcgaaaaaaaggctatcttcatagggttattactcgatctgcgtttaaacttgctgctataaattctccaagacctgcaattataaatccttctgcaagattgtagtgagctgtagttggtgtagttaagttatcaacaacacctcgtcgttgagatgctgcaacacataaatgtaaaggaacattgtgggtgatggaaaacatttgccaatgtttttgtaaattaacttcatcattggctggatacactaatgcatttccgttactcactccatcttggaagaaaaaaatctgtgagatttcgtgtccttttttgattaaggcatttgcaaattgataagctaaaaatgccccttgctttccgtaaatagggcttttgacggcgataacatagcgcattattcttgctcttgtttgatttgacggatgtacaggtaaaccgtatgtcgggaaatatctaaacgttcagcgactaaattaatcgcatctttaatatcaaaaatacctttttcgtaaagagaaaggacgatttgtcggtttttagtattattggcaacagcgcgatccgcattgacttcttctattgttttttcaatagtctgcgcaaccaagtcttccactgaattcgcaaagttcactgaagatgtttcattcgtatgctccgttggcataaagcattgcaaaaattgagacatgggtacatctaaattgatattgatgcaaagcaaaccaataatacgttgagttttattacgaatagcgatagtaactgatttcatcagtacgctgccttttgctcgtgtaaaataaggttttgaaacactttcgctttgcatatttcgtagcgaacgtaaggcaagatcagtaattggcgaaccaacttgtcgattagtgttatgtccgttggcaatacaaatagcagaatgttcaatattttccagagaatgaagcactatttcgcagtgctcgccaatcagtgcgctgacaccatcaacgactgctttgtaggaatttatgatagcttgatcttcatcagtgaaaggatatttatcgtttaatgtcatagcgttaggttaaaagtgcggtaaaaattccgctcgttttttataataaaaagcacgcgttaaagaacgcgcgctattaaacttatccgttatttttcagatttcggattgacgtctaatacttccacatcaaaaattaatgttgaatttggtggaatagatgcgccagcaccttgttcgccatagcctaattcaggtgcaataactaattgaatttttccgccttttttcactaattgaagaccttcagtccagcctttaattacttgatcaagttggaattctacaggttgtccgcgctcgacagagctatcaaatacttttccatttggtaatttacccgtgtaatgtactttaaccgtatccgttgatttgattgtatcgcctttacctgcactttcaattttatacattaaaccagattgcgtcgtttttacatctttccctttagcaaattcagcacggaatttatcgccttcttcttttgcttgtttagcaatcgcttctgcttttgcttttgatgcagccactaattttgcttcaatagattctaaggttttttggattttttcatctttacgaacatccactttgccttctaaagcatcttttaagccatctaaaatacgcgcattatcatatttaataacttctttgtgggaatcaacaagatctttcatttgactgcccatgagcgtacctactgcataagatgccgctttttcatcgaatgtgttatcttctgcaaaaacttgaccagaaattaccgcacttaccattaatgctgcgatagataatttttgaatttttaacatataagttaatcctttataatgaatggaataatacgaggaatagattaaatggctttctatctattctcaacttttttttagaatttagagaaaatttatgcaaattcaacaaatgttagaaaatcgcatcgaagaacttgaaatgaaaattgcatttcaggaacagttattagatgaattaaatcacgctttagttcaacagcaatttgatattgataaaatgcaagtccaattgcgttatatggcaaataaattaaaagactttcaaccgtctaacattgcaagtcaatctgaagaaacgccaccgccccattattgatttttgcaataaattcgtacaaatgaaaagggcgcttaatgcgccctttaaattacattctcaaataataatcagctaaatacttgcctgcttatgcaaagtatttttccaaatcgtcgctaccgccaatgtgtttaccaccgataaacacttgtggaacagtagcacgacctgaaactgcacgtacgctcacgattgttgcatcgtgacctaatatgatttcttcaaagcttaagcctttatcgtgtaaaagttgttttgcttttgcacagaaaggacagccaggttaaaaaaagattgaaatagactcttgcacttggtgttgtggtgcaaggtatttcaacatagtgtcagcatcggatactttgaacggatcgcctggttcgtttggttcgataaacattttttcaactacgccgtgtatcacaagcatagaataacgccatgaacgtttaccgaagcctaatcttctttaccaactaacatacccatgccttcggtaaattcaccattaccatctggaatgaaagtgatgttttcagatttttcatcttctttccatgcgttcattacgaaagtatcatttacagatacaacaagaatatcgtctacaccgtattttttgaatactggcgctaattcgttgtaacgtggtaagtgtgatgatgagcaagttggagtgaatgcgcccggtaatgagaacacgatcactgttttgttatcaaataactctgaggtagttacatcaacccatttatcaccctgacgagtgcggaatgtcacttgagggactttttttccttccatactagacattgttttttctcctattggttgttaatttaaattttacgtgctgtattatagggaaaattatgatatagtcataatcaattaattctattcttttaattgaatttttctatagggaaaatctcatgaatatccgtgatctagaatatcttgttgccttatctgaatataaacatttccgccgtgctgccgattcttgtaatgtgagtcaaccaacattaagtgggcaaattcgtaagttagaagatgagcttggtattattttgttagaacgtactagccgtaaagtgttgtttactcaatctgggatgttattggttgatcaggctcgtacagttcttcgagaagtaaaattattgaaagaaatggcgagtaatcaaggtaaagaaatgaccgggccattacacatcggtttaattccaacggttggtccttatttgctcccttatattgtgccaatgttaaaagcggcattccctgatttagaagtgtttctttatgaagcgcaaacgcatcaattattagaacaattggaaacggggcgtttagattgtgctatcgttgccactgttccagaaactgaggcttttattgaagtacctattttcaacgagaaaatgttactcgccgtatcagagcatcatccttgggctcaagaaagtaaacttccaatgaaccaattaaatggtcaagaaatgttaatgcttgatgatggtcattgtttgcgtaatcaagcgctagattattgcttcactgctggtgcaaaagaaaattcccatttccaagcaactagtcttgaaactttgcgcaatatggtggcagcgaatgctggtatcacttttatgcctgaattagcggtactgaatgaaggtacgcgcaaaggtgtgaaatatattccttgttattcgccagagccatcacgcaccattgcgttggtttatcgtcctggttcgccattacgtaatcgttatgagcgtgtggcaagtgcggtcagcgatgaagttaaatctattctagatgggttgaaataatggctggtgttcgtgctgttcaaaaagaaaagactcgtcgcgctttagtggatgcagcatttaatcaacttagcgcagaaaaaagtttttctaatttaagtttacgagaagtggcgcgcgaggctggtattgcgcctacctctttctatcgccattttagtgatatggatgaacttggcttagaaatggtggatgaagcaggtttgatgttgcgccaattaatgcgtcaagcgcgtaaacgtattgatgcgggcggtagtgttatttctgtttctgtggatacattttttgaatttattactaatagcacgaacgtttttcgcttgttattacgcgaaagttcaggcacttctcaagcttttcgtactgcggcagcacgccgaaattaagcattttgttgatgagttagcagaatatatttcctacaaacatcaatattcgcaatatgttgcttatgttcaagcggaaggcatcgtaacaatcgtattcactgcaggggcgaatgctttagatatgagtaaagctgagcgtgagcaacttaaagctcgtgtgattttgcagttgagaatgcttgcaaaaggtgctgattttgcagcgaataaggaaagaggcaagtaagatagtttatatctagcctattagttttctctttgtgcttaggtatttgctatcttttattcttccaagttatttttcataccaaattttatttatataaagggtaataaatcctgatggcgtttctacccgcacttcgtcgtctaatgtttttccgattaaagctcgagcaactggggaatcaatggatatccaatttttcgcaggggcaaattcatcacaaccgacgatacggtattgcttaatttcaccttcttcattttctaattccacccacgcaccgaagaaaacttttccctcttgctttgggttgtaatcgacaatttgtagcacttccaatcttttagttaaaaaacgcacgcggcgatcaatttcacgtaaacgacgtttaccataaatatattcggcattttcgctacgatcgcctagcgcagctgcatctgaaacggcttgagtgacttttgggcgttcttctttccacaaaaacttgagttcttggtcaagcacaagccagccttgacgggtaatataatttgattttgccataataaaaataaaagaaagttttttgaattatatttgagccagcccactaaaaccagtattctatctttgtttttttataataaagaagtacgacaatgttaaatcaacaaattagccaaattattgcggcagaattaaccgttcaaccccaacaaattcttgctgccattcaattattagatgatggcaacaccattccatttatcgcccgttatcgtaaagaagccacagggggcttagatgacacccagcttcgccattttgaaacccgtttaatttatttacgtgaattagaagaacgtcgtcaaaccatcttgaaatctattgaagagcaaggaaaattgaccgatgaattgcgtgacaaaattcatgcgacacaaagcaaaaccgaattagaagatttatatttgccgtacaaacctaaacgtcgcaccaaagggcaaattgccattgaagctggtcttgagccattggctaatttactttggaatgagccaaaaaatgatccagaatcaaccgcactttcctttgtggatgctgataaaggcgtgacagacaccaaagtagcccttgatggtgcacgctatattttaatggaacgttttgctgaagatgcaggtttattagcgaaagttcgtgattatttagcgaaaaatgccgttatcgtatccaaagtgatcgaaggcaaagaaacggaaggggcaaaattccaagattatttcgatcatcaagaattattgaaaaatgtgccttctcaccgtgcattagccatgttccgtgggcgtaatgaaggcattttacaacttagcttaaatgcggatcctgatgcagaagagggaagtcgccaaagttattgtgaagagattattcgtgattatttagatgtacgtttcactagccagcctgcggataaatggcgtgagcaagtgattgcgtggacatggaaaatcaaagtttcgttgcatttagaaacagaattaatggcgagtttacgtgaaaaagcggaagaagaggccattgatgttttcgctcgaaatctgaccgcacttttaatggctgcccccgctggcgcaaaaagcactatgggcttggacccaggcttgcgtacaggggttaaagttgcggtggtggataacacaggtaaattattagataccaccaccatttatccacacacggggcgtgaagctgaagcgcaagtggcgattttcagcttaatccgcaaacataacgtagaattaattgccattggtaatggtacggcttctcgtgaaaccgaacgctttgcgaaagaagtgattaaagaaattaaagaaaataaacctcaaaccgttgtagtgagcgaagcaggtgcatccgtttattctgcttctgaatttgccgcaaatgaattccctaatttagatgtatctttacgtggtgcggtatcaattgcgcgtcgtttacaagatccattggcagaattagtgaaaatcgaacccaaagccattggtgtagggcaatatcagcacgatgtaaaccaaagccaacttgcacgtaaacttgatgcggtggtggaagattgtgtaaacgcggtaggtgtggatttgaatacagcatccgcgccattgcttgctcgtgtggctgggatgactaaaaccttagcgcaaaacattgtggaatatcgtgatgaaaatggtcgttttgaaagccgtagagaattgaaaaaagtgcctcgtttagggccaaaagcctttgaacaatgtgcaggttttatgcgtattgcaggcgggaaaaatccacttgatgcttcaggtgttcacccagaggcttatcctgtggtcgaaaaaattttgcaagctaccgcgcaatctattcaagatttaatgggtaatgcgggtgtggtacgtcagcttgatgcaaaacaattcattgatgagcaatttggtttaccgaccgtccaagatattttcaaagagttggaaaaaccagggcgtgatccacgtggcgagttcaaaaccgctgtatttgctgagggcgtggaagaaataacggatttaaaatctggaatgattttagaaggaacagtgactaatgtaactaattttggcgcatttgtggatattggtgttcatcaagatggtttagtgcatatttcatcattaagcgataaattcgtggaagatcccctccaagtggtaaaaacaggcaacattgtaaaagtcaaagtgttagaagtggatgtgctgcgtaaacgcattgcattgacgatgcgattagatgaaagtgcggtcaaaaatgacggtaaatctgaccgcactttatccgcaagacctcgtggaaatacgcagcgagaggcgcgtagttcaagaggtaataatgcgatgggcaatgcctttgctgatgcgctaaaaaattggaaaaaataacaagttatagggcgaaattattcgccctttttttatcgctttcctttcccgaaaagcatcgccaaaacgggcgattttttgctataatctcgcccaatttttatttacaaaagaatgagataaattatgtcagaaacgaccaatgataactatggtgcatcgagcattaaagtattaaaaggccttgatgcggtgcgtaaacgtcctggtatgtatatcggcgataccgatgacggtactggtttgcaccatatggtatttgaagtggtggataatgccattgatgaagccctcgctggccattgttccgatattatcgtgacaattcacgatgataattctgtatcggtgcaagatgatgggcgcgggattcctgtggatattcatcctgaagaaggcgtttctgcagcagaagtgattatgactgtgcttcacgcaggcggtaaatttgacgataactcttataaagtatcgggcggtttacacggcgtgggcgtatcagtggtgaatgcgctttctgataagttacaattaaccattcgtcgtcaaggtcacgttcacgagcagttttatcatttaggggagcctcaatcgccattaacagtgattggcgaaacagaggcaacggggacaacggttcgtttctggccaagctcagatatttttgctatcacaacctttgattacaaaatcttagcaaaacgcttacgcgagctttctttcttgaattctggcgtatctattcgtttaatcgataaacgtgatggatctgaagatcatttccattacgaaggcggtattcaagcattcgtagaatatttgaacaaaaataaaaacccaattcatccaaagccattttattttaccgctgagaaagatggtattggcgtagaagttgcattgcaatggaatgatggtgtaaatgaaaacgtgtactgctttaccaataacattcctcaacgtgatggcggtactcacctagctggtttccgtggggctttaacccgtagcttaaatagctatatggaaaacgaaggcatgctgaaaaaagaaaaagtggcgacttcaggcgatgatgcgcgtgaaggtttggtggcgattatttccgttaaagtgcctgatccaaaattctcatcgcaaacgaaagacaaactcgtgtcttcagaagttaaaagtgcggtggaatcagcgatgaatgaaaaaatgcaggaatatttattagaaaatcctgcagatgcaaaaatcattgtaaatcaaattattatggctgctcgtgcgcgcgaagccgcacgtaaagcgcgtgaaatgacgcgccgtaaaggggcattagatattgcaggtttaccgggtaaacttgcagactgccaagaaaaagatcctgcgctttctgaactttacttggtggagggggactccgctggtggttctgcaaaagttggtcgtgatcgtaaaactcaagcaattttgccattgaaaggtaaaatcttaaacgtagaaaaagcacgtttcgacaaaatgttgtcttcccaagaagtgggcacattaattactgctttaggctgcggcattggtcgtgatgaatataacccagataaattacgctatcatcatattattatcatgactgatgctgatgtggatggttctcacattcgtacgttgcttttaacgtttttctatcgtcaaatgcctgagctgattgagcgtggttatgtttacattgctcagccgccactttacaaagtgaaaaaaggaaaacaagaacgctacattaaagatgcggatgaaatggagcaatatgaattaacccttgctttagatggcgcagaattacatatcagcgcaaatgcaccagcaatgaatgcccttgtatttgaaaaattggtggcagaatataacagcgtacaaaaacttatcggtcgtttaaaccgtcattacccagtgcctgtattgcaaggattaatttatcagtcgccaatttctattgaaatgatgaaagaggaaagtgcggttgaaaattggggtaaatcttttgttgaacaactgactgcaaaagaaacagaagcgcatcaatattcagtgcgtacacaatttaatgcggaacgccaagtgtatgaagcggtgattactgttcgcaaacacggtattgataccgattatttcttgaattttgattttgttcacggcaatgaatacgcaaaaattgtttctcttaataaacaactcaatggtttattagaagaaggcgcttatgtcacacgtggtgaaaaagtacaaccagtgcgtagttttgaacaagccgttgaatggctagtgaaagatctcgtaaggtcttgaagtacaacgttataaaggacttggggaaatgaatgcagatcaactttgggaaaccacaatggatccaaattcacgtcgtatgttgaaagtttctattaaggatgctgttgcagcagatcaactcttcacgaccttaatgggagatgaagttgagccacgtcgtgagttcattgagctgaatgcgttaagagcaaatttagacgtgtaaattttcgtctatttatattcaattcatgactgaaagggcaccaaagtgccctttctttgtttatcttgttatttcatataaggattactattgggtttttgaacttaagtgagtaaactaaatgcactcattttctcaacggagaacctttatgaaaccttatcttatcgccccatcaattctttctgccgatcttgcacgtcttggcgatgacgtacaaaacgtacttaatgcaggcgcggatgttattcattttgatgttatggataatcattatgtacctaatctcacttttgggcctgcagtatgtcaagctttacgtgattatggcattaccgcaccgatagatgtgcatttaatggtaaaaccgatcgatcgcattattcccgattttgctaaagcgggtgcgaactacatcacttttcacccagaatctagcgaacatattgaccgctctttgcagcttattcgcgattgtggttgtaaatctggattagtttttaatcctgcgacgccgttgagctatttagattatgttttggataaagtggatgtggttttattaatgtcagtgaatcctggatttggcggacaatcttttattccagcaacattgaagaaattacaacaggctcgtaagatcattgatgaaagtggttatgacattcgtcttgaagtagatggtggcgtgaaggttgataacatcgcagaaattgccgcggcgggtgcagatatgttcgtggcaggttctgcaatttttggtaagccagattataaacaagttattgaccaaatacgtacacagttagcaagtgttagcgcataactgttattttaataaaatacgatcgtaatagaacagagaaaaacaatgaacacacaatttaaacttattggctttgatttagacggcaccttggtaaatagcttgcctgatttagcgttatccgtaaattctgccttggctgaatttaatttaccgaaagcgccagaagaattagttttaacttggatcggtaatggcgcgcctgtattaattgctcgagcgttagattgggcgaaaaaacaaacaggaaaagtgctaactgaaacagaggttaagcaagtaacagaacgttttaatttttattatggcgagaatttatgtaatgtcagccgcttgtatccaaatgtaaaagaaactttagaaaccttgaaagaaaaaggctatgtcctagcagttgttaccaataaacccacaagacatgttcaacctgtgttggcagcatttggcattgatcatttatttagtgaaatgttgggcggtcaatccttacctgccattaagccacatccagctccactttattatttatgcggaaaatttggttttgaaccacgccaagtgcttttcgtgggcgattctaaaaatgatattatcgcggctcacgctgcgggctgtgcagttgttggtttaacttacggctacaattacaatatccctatcactgaatccaatccagattgggtgtttgatgattttgcccagctattaacgattctttaagtttcttatctaacaaaaaagtgcggtgaaaattgatctgcaccccaaaagttggactaaccaaaccaacaattgaggggcagattttttatgggtaaacactacacaatcgaatttaaattacaggctctccaacctattttgaatggaaaaatgagtattagagaagcggctcgtttttacaatattccttccaacgccttagtcgggacatggttgaaacggtttgaaaaaagtggcataaatggactgattccccgtaaaccatcaggacgaccgccaatgaaacccaaatatgccagaatgccaccgccacccaaaactgaagaagaccgtttacgtttgagaattttacagcttgaagcggaggtagcctacctaaaggagttgagaaggctcagacttcaggaagaagccgagcaacagaaattatccaaaggttaagaacacgctatccgttaaaatggcttttaggctttgcacggttagcgcgtagtacgttttttgctaaacttcagattaaacgagataaggatgagccgctgaaaaaggccattaaacgcatcaaagccaatcatcctgattatggctaccgacgtgttcatgcctatttgccaggtgtgaatcatatcgtcgaatcttggctgaacatggcatcattcaaagtatgtcgagaaaagggaattgcttggacaatgcagcgatggaaagtttctttgggcgattaaaaacggaatgtttttatggttgggaatttaacagtagagaggagatagttgatgccgtcagggattatttgggttactataatcaccgacggattcaactaaaattaaaaggactgagtccgatacaatatcgaaaacaatcctttaaataacagtctaactttttgggggcagatcaaatctgttacttactattggtatttcagttaataaattatttggtgttgtccgtagttcctctggtaatgttgattgtttactcttatggaaacaagctaaattaaagtccattccaccaagagatttctcctgcttaaagtagttatttttttgataacgttcagaaataaaccaataacacttataaccaatcttatctaaataggatatcaactcattagagtgatgaatatgagcttctacaaaaattataggcttatgtctctctatgagattctttgcaccatttaaaacatttagctcaaatccttcagcatcaatttttaatagatctatatcttccaatcgattaacttctgggtgtttatctaaagaaataacatgtatcaattccttagattctacacctataaaattaccctcggtactaaaccctttatctaatgaaaaacttccataattccaagcagtatcataatttgatgagggaatctcaatcaactgttcattttcaccaacccccaaattataggcatgaacatttgttaattgattaagcgacaaattcgcacaaagtgtctgaaaaattactctttgaggttcaaaacaaaataatttccccccccccccacttattgtctttgcaataggaactgcgtgcattccaatattcgaaccaacttcaatgacattacttgaagaatttaggttttccaaaaaaaattggacttctacatctgaccattcgccataaagtgcagcatattggctaataaaatccccttcaataagattaaaggttccccactttaattgataaatagatgttttcataaataatattccttagatttaaattaccgatactataacaaaaacagaactctttgtacgataaaataaataaaggaattaatttttaatcatccgtacaaattactctatacaaattctccgtacgacttacgaatctcttatatgttatctttcaactgcactttttcatcgcattttgctgtatttcacggtaaaccatctcaagttttcagaaataataggtaatttatgcgtcttttcattggaattttagtgggtgtttaaaccattctctttggcagattttcgatggaaaatgcggcactttactttggtattgcgagtagtggaaccccttagtcaatggttgaaagcctttcggaaaaacggtataaatgggtgccatcccaaacctaaaggtcgcccaagtatgaaacccaaatacgctaaaatgtctccaccacccaaaacagaagaacgtttacgcctacgcatccttgagtgagaagcagaggttgcttttctaaaaaagttggacgaaataatcaagagggacgaagctaaacggcagaaacagtccaaagtttgagagtgcattatccttatagattaagtcgtcgcccaaatggcatgttagtgcaagaaatgttgttacaagcggtgaaaaaattacagagaaatgcgaatttgatattacattcagaccaaggaatccattatcaaatgcttagctatcaacgcttattagcgaaaaataggatttctcaaagtatgtcgagaaaagggaattgcttggacaatgccgcgatggaaagtttctttgggcgattaaaaacagaatgtttttatggtagggaatttaacagcagagaagagatagttgatgccgtcagggattatttggattactataaccaccgacggattcaactaaaattaaaagggctgagtccgatacaatatcgaaaacaatcctttaaataacagtctaactttttggggtcagatcaatttttaccgcacttttgttatctacttaattgattttaaagaatgtttgaaaattcttctaacatttcttttggccatacgcttgattgcacttcaccgatatgtttttggggatctccaagagtcgacctgcaggctagcaaagtgtgagc

SEQ ID NO: 568 - DNA, 13196 bp, H. influenzae
  misc_feature (13168)..(13168): n is a, c, g, or t
atccccctacattgcgggcgaacttggcgcatcttttagtcaagtacgtgggtaatcactttcttttggggtagcaaatggcgatttctacttccataacgggttggttagcaaaaacgttttggcgatgtgcggttaatttttaagtctcaacttttttatttgttgtctcttcttggctctgtgggattgcagatagtcttgaggcgttaattatttttcgcgtcattcaaggtgctgtcgcaggtccagtgatccctctttcgcaaagtttattattaaataattatccaccagaaaaacgcggaatggcattggcattttggtcaatgactattgtggttgcgcctatttttggcccaattttaggcggatggattagcgataatatccattggggatggatcttttttatcaatgttccgatcggtttgttagttgtgctaatcagctggaagattttgggaagcagagaaagtgaaattgttcatcaacctattgataaagtcggtttagttttacttgtcttaggagtgggatgtttgcaattaatgcttgatcagggtcgtgagcaagattggtttaattctaatgaaatcattatattagccgttgttgctgtcgtttgtctgattgccttggttatttgggaattgacagatgacaatcctgtagtggatatttcacttttccattctcgtaattttagcgtagggtgtttatgtactagtttagcctttttgatttatctaggttctgtggtattaattccgctcttgctacaacaagtcttccattacaccgcgacgtgggcagggcttgcggcttccccagttggattattcccaattttgctttcaccgattattgggcgtttcggttataagatcgatatgcgaattttagtgacgataagctttattgtatatgcaataacattttattggcgagcggtaactttcgagccatcaatgacatttgttgatgtagctttaccacaattagtgcaaggtttagcggtgtcctgtttctttatgccacttactacaataacgctgtctggcttgcctgcgcataaaatggcttcagcctctagcttatttaactttttgagaactttagcgggttctgtaggaacatctttgaccacatttatgtggtataaccgtgaagctgttcaccacactcaattaacagaacacattaatccttataacccgatttcccaaagtttttaccatcaaatgaatcaatttggtttaagtgatacgcaaacttcagcttacctcgctcaacaaataacatcgcaaggatttattattggcgcaaatgaaatattttggttatcagctatgggattcttaggattgcttattgtgatttggtttgcaaaaccaccttttagtactcagcattaaaataaatatatattacataccaatcacaacacaatcggtaacagttttagctctactttgcgcctgtactgcaagctctcgagtatcaaaacttgctacacgaacacggttccattcgccgttagtttgtatttgagcatttaatcctgtcatctgtaaacgaccttgcaaattttcagcttgcgctcgatttttaaaagcaccgcattgtaaaccaaatttcttgctatcccgtacattattaaccgtttttatttgttctactttttttgcgctttcaattttctgtgagtcttgctttttaattgattccaattttacgatttctgactctgtatttttcatatcttccgtttttttggattgagttctcgttgcatcttctattctctgttgctcagccagttttctagcttcatcagccgctttttgatctctttctatttgaattaaaacttgacgttgttcttctgttaaacgcatattttgttctacactcgctggattattatctacaggtacagtacgcgtttctaaggctttaatataactccacacttcctctggacgattaggtaacacacttttaggttgagctttttcctgttgtgttatagcttgctgcacgcttaccttactgttctgatttttcaacaaataaagtccaacaacaaaaactagaacaataaataaagcaagaaaaatcaagacatttgtattctttttcttattttttttcttattatttgagctacgacgcgcagcaaaatctcgatgtgccacaataaattcctagatttgaagtgataattttaataattcaacaaaattcgctaagtttactgaaaaatagtctttaaataaagactaacataagtggattatttatataattaacagaataaaaaaataccgcacttatacaggttatgctcaaaaaagttggataaaacaactatttataagtacaaattacgtaagataacctaagtgcggtttgttttttctatgttttaattagtgggttgttttattttcatcaaaaaccggtaatggtttgtgttcagttgcgatatagctatataccacaggcaagacgaacaaggtgaaaatagtaccaatggataatcccgctacaatcactatcccaatactaaagcgagataccgctcccgcacctgttgcatagagtaatggaattaagccagctaccattgccgccgttgtcattagaattggacgcaaacgcacttttgccgcgtgagtgattgcctcaattcgagttttaccatagtttagctgttcttcttttgccacttcacacattaagataccgtgtttagtgattaatcccacgagagtaatcaacccaacttgagagtagatatttaatgttgttcctgcgatgctaaagaaggataaaatatttaagctcaccaatgcaccacttacggctaatggtacggaaatcataattaccattgggtcacgtatagattcaaactgaatggcaagcaccaagaaaataattacaacagcaagaatgaaagtcgtcgtaagtgcattaccctcttgtactaattgacgagcttcggatttgaaatcataagtgtatccttgtggcaaattatcatttgcctgttgttgaagccaagcaatggcatcaccacttgatatacccggcattggtacagcactgatttcagccgaatttaattggctgaaacgcggtaatgatgttggctgagtttctaatttcatactaataacactacttaatggcactgattgaccattagatgcagttaaataataattttggaaactttctggcgataagcgatcatctcgttttacctgcgaaatgactttataagcgcgtccatccacatccacacgcgtaactgtcgcaccagataagaaactccctaaagtattactgatttgttgcatcgtgatgccgtaagtaccagctttctctttatctactgaaattgtcatttgcgccgtgtcataggtcaaatctaaatttgtataaataaatttgccagaggctttcatcgcactgaggaatttctctgcggtgtttgccaaagatttataatcttgcgcagttttcaatacaatagagactggagcgccttgttcccctgtatcaatttcaggaatgttaaatgctgatactgacacttctggaattgattttgctttttcattaatttcattcattattgcggattgtttacgtgaacgttctttccaatctttcaatgtgatgatatttaacgagctattagaagttggcgcaccagcaatgctcataccaaaagagacttcgggtgtttccattacatttttcatatatggttgcattgcattttgaatgtaatccacatttacgctagatggcgcattaccaattgcaataaatgcgcctttatcttcatttggcgttaattcactagaaagtgaattaaacaaaaatgggagcgttgagaaaatcacgaccgcaaaagccagcattgatttacgattgagcataacgagatcaagcatgtattcgtaaacacgatttactttacataaggtatgttctacgcgttcttccatccatgttggtttagcattggatttgagtaacttactactcatcattggcgataacgttaatgccacaacaccagaaataaatactgcaccagcaagggttaaagcaaactctttaaacaatgtgccagtaatcccccccattaaagccattggtgagtaaactgcgatcaatgcgatagtcatagaaattacaggcacggcaatttcacgcgtaccaataatcgccgctcggaatggcgtttctcccgctttaatatgacgatcaatattctccagcaccacaatagcatcatctacaactaaacctatggcaagaattaaagcaagcaaggtcattaaattaatagaaaagttgaaactttgtagcagcattaatacgccaataagagaaattggaatagccaatattggaattaaaatagcacggaacgaaccgataaacattaaaattaccactaaaacgatcaaagtagcttcaccaatagtttttatgacctcgtgaatagagctattaatggcaatagtgcggtcataaagaatatcgctttccatactgtctggcagttgtgtttttatactttcatataaagggcgaattttttctgcgacagtcaaagggtttgctgtcgaggttggattgatggctaacacaacggactctgcaccatttgccgtagcacgcgaattatcattttctttatttaattcaacggttgcaatatcacgcaaacgcactaaatcatcgccatttgatgaaataattaagttgctgagttgttccactgatttcgttgtagtctctactttattacgataactcacataatagccattatcgttccccgcagccgtttgtacattatttgcagaaagggcagacatcactgttggcacagaaagattttgagctgccattttttgtggatctagccaaatacgtaatgcatactcagccgcaccaaatacttgtacttctgccacgccttcaatcgtaaagaattgaggtttgactacacgattgatgtaatcagttacctgactagaatctagttttttagatcggaaactgatatacataataccgctcccacctgaagaagaggatacactaggatcttcaataccatttggtaatgctgactttactgcattcactttggctaacacatctgctaacgcgcctgcaggatcggtatttaatttcatttttattgtaatagtcgaactactaggcgcactagtcgaagacatataatcaatattatcggcttgcgcgatagattcttccaattttgacgtaacaaatgcttggattaaattcgcatctgcccctggatatgcggtactcactgtaatgactgtagtagtcattttagggtattcacgcactgccaatttcgagattgcttgcaaccctaaaataatcattaacaaactaattgaaactgctaaaacaggacggcgaataaatatatcggtaaatttcattcggatttcctcatacattaaagtggtgttttatgtgcaggctctactgcacccacaatgtcttttttaatccattccacaagacttccattaccaataccttgctgaccgcctgtaataattttatctcccgctttaacttcatttccctgtaattgagcataaacaccttgacgatctttagtaaatacggtgatctgtttcgcacgatagagacgatccaatttttcattacctgacatttttcctttttcttcttcagataatggttcaagtaaataggcaatttcgccatacatattgtagctaatagctacttgtggaacgacaacttgatttgtttcagttggtagcgcaatgcgtaaacgagagaacatacctgaaagcaatttatgcccatcttcaggattaaatgtagcttgaacatcaactaaacctgttgatgaattaatggcaggttcaatagccgtaattcgagctgaaaatgtttcgcccaagcgagcatctgttgtcgctgtaacgcgctgaccgatatgtaatttatctaaatcattttgtgaaagagcaaaatccactttcattgagctagtatcttctacacgcacaatttctgttccaacattcacatattgtccaacattgattttcacaatacctgctttgccatcaaatggcgcaacaattttacggcgctcaattactgcttttaaagattcgatattggctagttgagcgtcataagccgcttttgcgttatccatttcttgacgtgatacagcattgctgtttaataaacccacataacgctggtaagtttgacgaagtgctgataattgtgcctgagcagcttgtagattagctcgttcaacagaactatcaagttccacaagcacctcaccttttttcacattttgtccattttgcacaagtacttgagaaatcgtacctgcattttgtgtactgagcaatgcgccttgatttggacgcacaagacctgttgtgttaataactggcgtccattcacgcggttgaacttcaagtgcggttactgggcttgaagattctggcatttctgcaatggctcggcttatcattacgccttttattatattaaaaccgatgacaccgacaaaaattaagacaaataccactaaaattattttcatcaagaaaatatgtgagcgttttggtctttgatgttgagtttgactcatgtttaaagctccgttataaaaataacaacaattatttctgaatcgcacgccaagagcgttcaatcacagattctaaaatttcaggcttaagatcgaaatcgataaattttgcatcagaggctaaatttatcgccgttttcaaacttaataaaaagagaatatcttcagataattccgctaataagccagcttttttggcttggtcacaaaataaatcccaacgacaatttttaacgtttttacaaatatccttgaaattaggcaaagattcatattgctttaaattggatagaatggtgggattttcttgtaagaaataccaaatatttttccacatttgtcgatactgttcgaaaaaaggcttagattcatcaaaatctttttcaagtgttgccataaacattgaaaacactctatgtgcaaattgttcaagcaactcatctttgtttttgaaataaaggtaaatcgttcctgctgctacatttgcctcttttgcgattttatgcatagaaagccgatctaaaccttcttttgccattaaacgatcggtagcaagaaaaatttgttcggctaaatcagttttagcttgtcgcataagatccttgagtaaaataaggagcaataattgctcaaaaatgaatggacgttcattttatttattttttattttttggcaagttaaaaaacaaaaagcgtaacaatacttatctgtaggtaatccgtaaacccataagatgaatgataaacaaaggaggatataaaaaataggaatataaaatgcagtcaaaattaaccgcacttttcatcatcaaatcaaggtgtagaatgaggctaccttattttgtgtgataagaacgatgtcttgtatgcccttgcggtggtactgcacgttttaaccgatacggtttcggcagttcaagcaaggcttctgtttcatattggctcactgggatagaatggccaatatattcttcaattcctggtaaattcatcgcatattcttcgcaagcaaaactaatcgaaacgccactttcccctgctcgtccagtacggccaattcggtgaacgtaatcttccctatcatcaggtaaatcataattgaaaacatgcgtcacatcagaaatatgcaagccacgagcagccacatctgttgctactaaaatatctaaatcaccgtcggtaaattgttttaataacgataaacgttttttctgggctacatcgccagtcagtaaaccaacacgatgtccatcagccgccaaataaccccaaatttcttcacaacgatgttttgtattcgcaaacacaatacagcgctcaggccattcatcttccattaaggttaagagaagtgccattttatcctgattagatggataaaaaagttcttctttaatacgatgacctgttttttgttccggttctatttcaatatattcaggatcattcatatcctcaaatgctaattcacgcactttataagaaagcgtcgctgaaaataacatcgttaaacgcgcttgcggagcggggcatttacgcaataaataacgaatatcacggataaacccaagatcaaacattcgatccgcttcatctagcacgacaacttggatttcatctaaaccaattacgccttgttttacataatcaatgactcgccccgtcgtaccaatcaaaatatctacgccacgctcaatcacttgtagttgtttatcataaccatcgccaccataggcaagtgcggtctttaatccactcgcttttgcaagaaattctgcgtcattactaatctgtaccgctaattctcgagtaggtgctaaaatcaaagttcttgggtgaggatattcaagattaggatcttggtgagttaaaagatggtgaaaagtagccgttaaaaaagccattgtcttgcctgtacccgtttgagcttgtcctgcaacatctcgtccatttaaactgataggcaaggataaagcctgaattggggtacaaaaatcaaagcctttttttgccaaagcacctcgcacaatcggatgtagaggaagagcggagaatcgttgttggcttaaataatcttgttgcataaaaatcacattttagaataataaaatcacgtttagcatagcatttttaggaaaaatcctcaaaaaaagcaccgcacttataaaaattaaccgatagggtttcctatcggttaatctctatttaatgctccatccgtcactcacatttggatccattgcaaaatcagcagtatcacttggaatcgctttttcttcagccgcccattcgccaagatcaattaactggcaacgtttgctacaaaaaggtcgaaaagtactttcatttatccaaggcaccgatttttggcaaatcggacaaggtacttcaatcatttcgtcaggcatttttattttccgcttgttgtaaataaaactggtgcaattctagcaccttttgctgcaagtgcggtaagttttgggccagttcagaatcattgttaatcacatcatctgcccattttaaacgctcttgttgagaaacttgagaattcataattcgttgaatttgctcaaaattattgttatctcgttgtgatgaacgagcaagttgagtttgtggactcacatccaccaccaaaatacgatcacaaagtgcggtcaatttattttctattaataaagggacgacaaataatgtgtaaggcgcagtttgttcagctaatttttgtttcattcgttcacgaatagcgggatgtagaaggttatttaaccacaatttatcttcatcatggttaaacactcgctctcgtaaagccgcgcgattaagctcgccttgttccgttaaaatttgagccccaaaatgttcaacaatttttgacaataagggggaatctttcgcgacgacttctctagcaaccacatccgcatccactagaggtacgccaagatcggtaaataaattagcaatcgttgttttaccactaccaatgccaccagttaagccaacaatataagtcatataatttcccataaaaaataagcggcgatattaatcgccgctaaacatataatcaacgaaagaaaataaatcatttcggataaactggaagacgtttacaaattgctaatactttttctttagtttcagcaatcacttgttcttcattttctttgcctaaagcatctaaaacatcacacatccagccagctaattcacgcacatcattttcattgaaaccacggcgagtcacagatggtgtacctacacggatgccagaagtgacgaatggtttttgcggatcgtttggtacagcatttttattcactgtaatatttgctttgcctaatgccgcatcagctgctttacctgttaatccttgtttaataaaacttactaagaacaagtggttttcagtgccatttgacacaacgtcataaccacgttgtttaaatacctcaaccattgctttcgcatttttgattacatttgcttggtattctttatattgaggctctaatgcttctttaaagcaaactgcttttgccgcaataatatgaactaatggaccaccttgatttgcagggaatacggatgattgtaattttttgtagatttcttcatcgccacaagatgaaagaattaaaccaccacgcggaccgcccaacgttttatgggttgttgttgtcacaacatgtgcatgagggagtggatttagatataaacccgctgcaattaatcccgctacatgcgccatatccacaaataaatacgcaccaacttcatctgcgatttcacgcattttcgcccaatccacaacttgtgaataagccgagaaaccagcaacgataagttttggtttacattctaatgctttttgacgaacatcttcataatcaattaagccatccgcagtaattccataaagtacggagttataaattttgccagagaaactgacttttgcaccgtgagttaaatgaccaccgtgagccaaatccatacctaaaatagtatcgcctgcattaatcaatgcaccatacaccgcagcattcgcttgtgatccagagtgcggttgaacattcacgtaatctgcaccaaataattctttcgcacggtcaattgctaactgttccacaatgtccgcatactcacaaccaccgtaataacgtttacctggatagccttccgcatatttattagtgaattgtgaaccttgcgcttccatcacacgtggactcgcatagttttcagatgcaatgagttcgatatgttcttcttgacgacgattttcatcttggatcgcttgccacaatactggatcgtaatcagcgatagtcatatttcttgtaaacattgtgttctcctgttatgtaatttatggcagatagtttaactgtttatggataaaaacttaattaaaatttcattcctaaattttcattacttaaatgaaattaattcatcatagcgtctaatttaatgaacatactcttgtttaccattagattctatttttaggtatccagcatcacctgtgagaatatttccattaacaacccccttatcgcaagtgctaactgaatagttatatcccattatattaataataaagctagataactgattatgaaatgaaatcttacatgattcaaaattgtccaacactagtttctgtatttcttcatttggactatatagaactaatggcacaatataattatcttcatcaaatgtcccttgcttataagtgtcgccttttacatattgaccatgatctgatgtataggcaattatccaatctttagaagatttattagataagtaatggtaaacctctgagataaagttatcagtatttagaatagtattatcataattatctgttgcgttattttttccaaacaccttctctttttcatctaataatgccccatagggaatatgactccctctatgatgtaaaacaacaaaatgataaccattatctaaattaatatttttaaaagcaggaagtaatttattatcaggcattgaatctcttaaagaatacccttcattatctggaaaacgaatatcatcaatccaagctcctcctaaaaaattgatcatatgcatatcatccctagcttgagctgaataaaaatatgtctgaaagccttgctctttcgctaaattaaataaattcgtatctcctttagctatctgttgtattccatttggataaggaattgcattaaaaaacattggtaaagaaattgctgttagctttcctcctgaataagttttaccaacaagagctcctgatttatattttaagctatctaaaaaaggagatgtttttctcccgtaaccaaaagcactaaaatgacttgaggtcgcactttcccccataattaaaattatattcttaattttcggagagcccgatttcataggcttagatttatgataaagaggaatattagataaagaaaatatctcataaggaacaattcgtcctataaaataacccaacgataaataattggattttaatcgagaataaacagtgttaggtgaaataaaacgctcatgggattttgttgtatacgctcgaacaaaaacatacatcatcacagcataaaaaataaagtcaaaaatccaagaaagtttatatacttttctttttatgaaacttaaacttaaaaacacagcaacttcaaataaaccaaataacaatggatatatgaatttatctatcattgttaagccagcatttgttatctcattaatttctttaaatgcaagtgagtaattaacaggtccaatccaagattggtatactgcataatgtacattattaacaacaatacttattgcaaataaagcgccaactaatattcttgtaattctatattttgaaaaaacaaacaaacagacaaacagacagacaaataactttcagtgtatctctcaatactagaaatattaaataattttctataaataacttctaatgaaagaagaattgcataatataatactacgatgacaaattgtcgcataagttgatataacctcataaagtaacaaaataataattctaatttattgtcagagcaatcgtaaacgttgccctaacaaaatcctaaatcctaggaaaatacaattctaccctgtacaatattttttatctaattaaattcaacaagatttctaactattttgcttgttctcgttccacagccctgtaaccaatgtctcgacgataaaaacgcccagaccattgaatttgctcagccaattttaacgctttttgttgtgcttcaaatacactttcgcctaacgcagtcacacaaagtacacgaccgccgtttgtgactagcttgccttcttgttctgcgacacccgctaagaaaacttctcgtttttgaccgcactttaggcggggtctcntagagtcgactgcaggcagcaagtatgc

SEQ ID NO: 569 - DNA, 14324 bp, H. influenzae
ggtatacgaaatcggactcggtaccccttgcccccaaaaccttttaattcgcccatttttaataggctttctttaatatcatcagcagtagtaaaggtattttgtccaacaagtgcaaatgcactaatcggcttatcatccattttttctaaaatgctttgccaattaaaataaacaccaagtaaaaaaaagacaccaagcaataccgcaaaagcccgaatatgaaaataatatttaggcttttgttctccaaaacgaatattctgtggcgtttttcttttcagaatgttcattacaggctcaactccaaaattttcacgacgagttgctcaaaagaaatacctactgtcgctgcagattttgggaataaactatggctcgtcattccaggattagtattaacctcaaccaaacggaaattaccttttgcatcacacattacatcaatacgactccaaccacgacatcccagtgcatcataagcacgttttactaatattgctaactcttgctcgcgttcaggcgttaaacctgctgggcagaaatattgcgtattatcagaaatatacttcgcttcataatcataaaattcgccctctggaacaatacgaattgcgggtaatacttgattgtcaagcacaggcacagttaattcatcgccagctaaccactcttcaattagaatggtattatcaaatttaagcgcatattccaccgcactttttaactcttctaccgcttttactttcgttaagccaacgctagagccttctaaagagggtttaaccattaatggtaagcctaattttgccacaacagcctgaggatctaattcagaaaaagtttctcgggtaaccactttcatatctgcaacaggtaaaccaaaagctttccacaacatttttgtacgcattttgtccatcgttaatgcagaagccatcacgccacaccccgtataaggcaaaccaatttgctctaataaaccttgcattgtgccatcttctccaccacgaccgtgcaaaatattaaatgctcgattaaagccatcctttttaagatttgcaacattatattctttaggatcaataggatgtgcattataaccttgctttaataatgcttctaataccgctttgcctgaattgaaagaaacttcacgttcagcagatgtgccgcctaataacaccgcgattttttcttgttttaagttcattttctatcctgttcttcttactgatgatacttttctaatactaagattttcaatcaatccatctggcattaattcttccaagattcagccaagccacgagaaattttacttacgctaccagcaccttgtgccaaaatcaaatcgccatcttgaataatttgatcgagaacatcgcctagttgcgaagtatctgataccaaaataggatcaactttaccaagattacgaatggaacggcaaagagatttactgtcagcgccaacaataggggcttctcccgctgcgtacacatcaagcataatcaaagcgtctactagcgaaagcacttgtacaaaatcatcaaacaaatcacgagtgcgcgaataacgatgcggttggaaaatcattacaatacgtttatctccccagccttctcgcgctgctttaatggttacgtctacttctgttggatgatgaccataatcatcaactaaacgcactttaccatttggacgaataaattcgcctagctgatcaaaacgacgaccagccccctgaaaatcagccagagcctctaaaattgcctcgttagcaataccctcttcttttgctacagcaagtgcagccgttgcatttaatgcattatgttttccaggaacattgagcaacacattaatacgttcattatttgggcaaatcactgtgtaatgaccttgaaaacctgtttgttcataatcttcaatgcgataatctgcctgctcactaaaaccatatgtaatcacttggcgaccaacttttggcacaagttccattaaaacaggatcatcagcgcacatcacggctaaaccatagaatggtaaattatgcaggaatttcacataagtggctttcattttttcaaaatcgccttcgtaagtatccatatggtctggctccatattagttacaacagataccattggctgtaaatgcaaaaacgacgcatcactttcatcggcttcggcaattaaataacgacttgcccctaaatgtgcattcttacccgccgatttcactaaaccaccatttacaaaagtcggatcaagtttagcttgggtgtaaatcattgaaatcattgctgttgttgtcgttttcccgtgtgttcctgcaacagcaataccgtgacgaaaacgcataatctccgccaacatttgtgcgcgttgaatcactggaatgcgtttttgtttcgatgcaactaattcagggttatcatcttttatcgcactagacacaacaacaacactggcacctttaatatgttcttctgcatgaccaatgtagatttttgccccagcttgagctaaacgttgagtgactacgccatcggcaatatctgaacctgaaatttgataaccttcatttaataaaatttctgcaatgccgctcattcccgcaccaccaatgccaatgaaatgaatttgctgtacacggcgcatttcagggataatttttctaatttcttcgtgggaatgtttcatttatttttccttttctcccaatgacaaaactcaactaaaagtgcggttaaaattcgcaacgtttttatttctaatattagcacttttggatataaaaaatacttatgactgaggctatttataaaacgccacaacccctagtttgaatattgtttaattacttcagctacacgttgtgccgcattaggcatcgacattgttttcgctttcaatgccatctgcaataaattttcacgagttaaattttttaaataattcactagcatttcaggcgttaaatctgcctgttctataattttcgccgcgtcaacatctgataaatatttcgcatttaaatattgttggcgatctttatgttggaatggtacaaaaattgctgcgactcccactgctgcaatttcacatacggttaatgcgccagaacggcaaataaccacatcagcccaagcataagcctctgccatattatcaataaattctgttattttaacttgttctaaattctcgccataaagttggctgacttcttctaccgcacctttacctacttgatgacgaagctctaatttatctgcaagctgggcgactactttaggtaaagtatgattaagcactctcgctccttgactaccaccaaccactaagacacgtaatttttcctcacgatccgaaaaacgaatatcaggatttggcatctcaaataaatcttctcgaactgggtttcctactacttcagcatgaggaaaagcagttggaaatgcctgtaatacacaggttgcaattttacctaataacttattcgttaaacccgctatcgcattttgttcatgtaaaatgattggtacaccacaaagttttgccgcaacgccagcggggccagaaacatagcctcccataccaagtacagcgtcaggcttttcttcttgaataattttttttgcctgcaacacggcacgaaaaatggcaaaaggcgcatttaacaaagcttttatacctttaccacgcaaaccagaaatttgaataaatcgaataggaataccatattttggtacaagttgagcctccattctatctttcgtacctaaccagcaaatatcccattcttgtttttgtaaagtttgagcaactgcaatggcaggaaaaacatgaccgccagtgccacccgccatcactaataattttttatttttcatcttttttatctctaatcatcacgcaagcgtgcttgacctatacgaaataaacgattttcgtgatcaattcgcaataaaataccaatagtggcggacataatgataatactcgaaccaccataactcacgagtggaaaggttaaacctttagttggtagcattccaagagccatacctaaattcacaaagccttgaaagaaaatccaaaaaccaatacctaatgcaaaaaaacctcgaaaacgttgttctaacattaaggattctcgtccaattttcattgcacgaaaaattaataaacctaataaaagaataacaatcaatataccgataaatccaaattcttcgccgataatcgccataatgaaatcggtatgtgcttcaggcagataatctaatttttgaattgaattacctaatccttcgccagtaatttctccccgcccaaatgctataagagagtttgttaattggaaaccagtgccataaggatctttaaagggttctaaaaatcctataaatcgctttaaccgataagaggcggtcaatactagccaaacgaataagattccacctaatgctatcaatcctacaaactgtaaaattttcgcccctacgataaaaagcatcccagacataataataaatagcacgactgtactacctaaatcaggttgcaataaaagaaaacaacccaatacaagcataacaataaacggtttaaaaatactaacatgtcgcgaccgcacttcatcataacgacgagtgaaataacttgctaaaaaacaagtcaaagccaattttgcaaattctgcaggttgaaagtttaagatccccaatgaaatccaacgttttgcgccattaaccgatgtaccgataaaagggacaagcaataataatatgacagaaaataaaaaaattttagcgtgccatttttcccattgcgaagaagaaatttgtaatgaaatataacaagtgagcaaagaaagtagcacataaatagcgtcgcgttttgcaaagtaaaaaggatcattaaataaacgagagctataaggaatagaagcagatgttactgccactaaaccaattaaaagcaaaataacaaataaccaaaatagtgcgcgatcatacaacaaaccttgaggtgtgatgcgtgtccattcatcgtaattttttttgatgttctgtaaaaattccatcttatttttattaatgactaaattaggctgaatattgcgctaaatgcgtaaattcttcgccgcgcttttcaaaagaagcaaactgatcgagacttgcacaagcaggcgacaataataccatatctccgctttgcaatgttgggcgtaaaaattctatcgcttgttccattgtttcaaacaaatagctttgtgatgaaaattttgcaagctgcacaccatctcgaccaaaacaataacaaataatgtgtggttgattaattaattcagctaattctgaaaaatcagccccttttccgtctccgcctagcaacaaatgcaatttaccctcaatataaagcccagctaatgcagcaactgtactccccacatttgttgctttagagtcattaatccaacgaataccattagcttgatgcactaattgaaaacgatgatctaaccctttgaaatgacgaagtgcggtacgaattgaatctaaattaataccgacagcttgtgccaatgctgttgctgccaaaatgttcatataattatggcgaccgactaatgttacttcttcacaaggcaaaattacttcatcttttaccattaagtattgcttgccattttcagtttttagccaataatccgcactattttccgcaaaagaaacggtttgtctcgcttgattttcaccttcaccaaaagtcagcttatcctcattattcaaaactccgacctcagcattatgataaatgcgtaattttgcttggcgataatcttctaaatccatatagcgatccatatgatcttcagtcacgttcaaaacagtcgcagccgcagcttttaagctataagttgtctcaagctgaaaactagaaagctctagtacataaagttcacaatcttcattcaacaatgacaaagcgggaatcccaatatttccgcccataccaactttcacgccagcagctttcgccatttcataaactaaagtagtaacagtactttttccatttgaacctgtaatccccacaattggctttgtcgctgcgcggcagaataattcaatatcgccgattacttccactcccgctttaagtgcggtttgaatttctggtgtttttaccgcaagccctgggctaataacaatcatatcgctttcaagtaaccattcctgatttaaactaccagtatgaagagggatattttgaggaagtttatcaataccagtaggcttttttcgggtatcaatcacacgaatattagcctgttgggataagagataatccacacaagaaagacctgttttgccaagcccaatgatcgtaatatttttgttttgataggcattcattttatttcttcttaattactataagttttaaattttgctgatgggaatatcaatttataacgtaaaagctcgctctttcaaaaactgaaagagcgaacctcacaacatttattaacgcaacttcaaggtgactaatcccatcaacactaacattaaggaaataatccaaaaccgaataatcactcttggctcaggccatcccttcaattcaaaatggtggtgaatcggtgccattctaaaaatgcgttgtttgcgtaacttataagaccctacttgcaaaataacagagagtgcttcaacaacaaatacaccacccattatcacaagcaaaaattcctgacgaacaagaattgctacgacacccagcgcaccacctaatgctagagaacccacgtcccccataaatacttgagctggataagtattaaaccataaaaatcctaaactcgcgccaacaatagctgtacagaacaccactacttcagaactgtatttaatatacggaatgtgcaaatattctgcgaaattcacgttacctgtagcccaagcaattaaagcaaacgcacctgcaacaagcgcagtaggcataatcgctaatccatctaaaccgtcggttaaattcactgcattaccggttccaacaatcacaaagtaagataacacaatatagaacaaacctaactgaggcataatgtctttaaagaatggaatcactaaacgggtggcatcagtgtcgtgaccaagccaataaagccaaaggattgccactaatgccaccacagacatccagaaatatttccaacgcgcaatcaatccatcagtatttttacgggtaattttacggaaatcatccacaaaaccaattgcgccgtatccaaataaaacaaataaacaaacccaaatataagaattagcaagatttgcccataataacgtacttacgccaatagagaataaaatcatcacaccgcccatagtgggtgtgcctttttttgcaaagtgactttcagggccatcatttcgcacttcttgaccaaattttaagatctgtaaacgtttgatcactttagggccaatccaaagtgagataaaaagtgcggttaataatgcaagaattgcgcggacggtaatataagaaatcgcattaaaggcggtttcgtaacgaacaagatattcagcaagccagactaacatttaattttatcctttaatgaatagatcacatcttccattttcattgagcgtgagccttttcccagcaccacaacttttttattttgttgtaattggttttcaataagtggaactaagaaatccaccatttcagttttatccgtaaaatgcttacccaaaacagcctcagaaataaccgcactttcattgccataagaacacaccaaatctaaatttaccaaattaacatattgtccaacttcacgatgaatagcgagagaattttcgcccaattctttcatatctgcgacacatagaataaggaaagcatcataactttttaggacatcaatagccgcacagagagaatctttatttgcgttataagtatcatctaataacaataaattaggcgttacttgaataggaaataaacgccctttcacttgtgaacgttgttctaatccagctttgacatcggcaagcgtagcaccaacattcatcgctagtgcggtagcagctaaagcattttttacattatgctctccaagataaggtaaactaatatcaatttcgccttgcggagaaactaacgtaaaggttgaaccttgttcgttaccttgaacatttttgacggaatagtccttgccgttgaaatattgaatggcgtgattactaatttctttttgccaaatatctaagtgattatgttcagcattgataatcgccacaccattttttgttaaacctcgataaatctcgccttttgcttgaacaactcccgctaaagaaccaaacccctctaaatgtgcgggcgcaatattattaatcaatgcggcattaggttgaactaattttgtggtgtaattgatttcattttgatgatttgcaccaagttcaatcacagcaaaacgatgtttttctgttaagcgaagcagagttaaaggcacacctatatcgttattgaagttaccattggtaaaaagtaccgcttctgaatctgctgcggtatgctgcaaaatacttgctgtcatttcttttactgtggtttttccagaagagccggtcatcgccacagtacgcggattaattttctcgcgtaaccattttgcaagctcgcccaaagcaatacgagtgtctttaaccacaagttgaggaactaaaatagacgagttttcttgctgaacaacaagcgcaagcgcaccctgtgacaccgcttgatcaagatattgatgagcatcaaatttttcgccttttaaagcaaaaaataagctatttgatacgctttttcgagtatccgtattaatttcttcaacttgcacattttcatcgccaattaatttagcttgaagaatctgtgcaagttgtacagtagagagtttaatcataattgagtgattattattttaagaaatcaagtgcaatttcttggtcggaaaaatgcacaacttccgaaccaataatttgataatgctcgtgaccctttccagcaattaaaatcacgtcattttctaccgcactttcaatcgcaaactggatcgcctgtgcgcgatcaggaataatccccactttttccatatttttaaagccagcgacaatatctgcttcaatttggctttgtggttctgttcgtggattatcttttgtcacaataatcttttcagcaaactgctctgcaacctgtgccattaacggacgtttgcctctatcacggtctccgccacaaccaaagatgcaccataattcgccttggcaatgttcacgcgcagcaatcaacgctttttccaacgcatctggtgtatgcgcataatctacaataacgattggtttatttggatattgaatcatttccattcttccacatactccttttaaagatttcgccgtagcgagtaaattttccaatgggtaaccaaacgataacaacgtggtcattactaataataaattacttacattaaaagcaccaattaatgggctatgcaaaacaccattaccccagctagattcaaaagtaatatctgcacctttaaaatgataatggatatttattgctttcatccattggtgtgaacctactttaaaatccgcattcatacttacggcaatagcatcaggtagttcagttagccattggtatccaatttcatcatcagcattaatcactttaatttgggtatctaattcagtgaacaagcgtttcttcgccgcagcataattttccatagattgatgataatctagatgatcacgggttaaattcgtgaaaattgccgctttaaaatgcaaggcttctacacgatgctgcgccaaaccgtgtgatgaaacttcaatagaggtaaaatctgcacctgcgtgtttgaaagttgaaagagatgactgaatttctactgctgaacctgtcgtatttttagcttctacaatttgccccaaaagtccattaccaatggttcccatcacagccgcacgatgccccaataattccgcccattgcgctaataattgagaaatagtggttttgccatttgttcctgtaacgccaacaagggttaaatttttagagggcgaatcataaaaaacatcagctaaggacgaaagatgacgtgcaagttgataatatttaactaccggcacattcctgataaacgccacagttaaatgctcgctagataattctgtctcagaaaccaccgcactcgcaccagaatgaagagcagaatcaataaattgatttccatccacctgatgaccttttatcgccacaaaaagatcgccagctttaaccttacggctatctaacaccatattatggagttctatatcattctttaattcaggcaaattaaaaagtgcggtgagttttttcataatttttccttaattcactttttgattcttgtgttcgccaatataaacaattcgttttgcacttttcgttgttgtgttttcagctgcttcagcatcttgcggaatagcatttgcacgtaacgcatagcccataatgttagagaatacaggggcagaaaccgcaccaccataatattctcctgcttttggatcattgatcaaaaccactaatgcataacgaggatcactaattggtgcaatacccgcagtaaatgccacatatttatttacataatgtccattttcaatcttacgtgccgtacctgtttttacgccgacacggtagccttccaccattgtgcgtttatttttaattgctactttctctaaaattcccacaatatctttagttattttttcagagaaaacccgtttcccaataactggcggatcaactttagtgatagaaagcgggcgataaacaccgaaactaccaagggttgcataggcacgagcaatttgtaaaggtgtcgcagtaataccataaccataagcgactgttgcacgctcaatatctgcccagcgtttacgatttgcattcaaaatcccaacttgttctccgatcaagcctaaatctgtcggtttacttaaacctgcattttgataagtttccattaatgcgctaggtggcatacgtaatgcaagacgacttacaccacggttactagagttcattaaaatctcgtctaaagtttgctgagcacgtggtgcaacgtccacaatttctttaccgcttaatttaaaggacgtagtatcaataatttcatctcgtttaacgacacctcgttgaagtgcggttaaaacaacgaaaggttttaccgtagaacctggctcaaaagtatcggtaattgcacggttacgcattaactctgatttcacgccgacacggttgtttggattataagagggcgcagtcgccatagctaacacttcccctgttcgaacatcaactaacaccgcagtaccagactccgcattattctcagacaccgcctttttaatctcacgatacaccatagattgcaatttttcatcaatacttaaggtaacatcttgtgcatcatattttttctcatcggagatatgtgcaacaatattcccacgtttatctttacgaacagtacgtgaaccgtctttaccaacaagcagggaattaaaacttttctcaatgccttcaataccatttccatcaatatccgtataacccaccacgtgtgcagcttcttctacacgaggataaaaacggcgatgctctgtttctaaaataatacccttaatttttaatctacgaatatagttagctttacttaattcaacttgacgtgctaaatacaaataaccagatttagaatttttctcaatttttttcactaaatcattttcagtcatacctaattcttcggctaaagctgcaattcgttctttatccgcaagcgaattttccttcaacatcgtttttggatctgccacaatcgcgctcatcggtacgcttacagataaaagctgaccattacgatctaaaatagaaccacgcaccgataatacttcatctttacgcaaagaacgcttatccgcttcatttgataacgtatcggcattaatagattgaacataagctgctcgtgcgactaaagcacacagaccaagtaaaataagaaccgtagaaagcatataacgtccacgcataaagcatttttcaaacaccttttgagacttgttttgctttacagtttcaggtgcggtcaattttctaattgttttttttgacttacctgatttacgcgaggaattaaatttcaccatcttttttacctattattctctaatttcaacttcttgctctgaagaaacaactttcatttttaatgtactaatcgcaatagattctactcgcgtgctatccccttccgtagcttcctgcacttgtaaattacggtattcattctcaagtgcttgacgctgtaaaattaacattccattttcagaaattaattggcgagttttatgggttatccaaatcgttcccattgcagaaactaaaatccctatcaacagcaacaccactaacttatttgaagaaaataaatcttcgactaaaatctgctgtaacggataacgaggcttattattttcagacatcgctaaattctctctgccacacgtaatatggcacttcttgaacgaggatttgcttgaatttctgcatcacttggctgaatggctttaccaataattcttaatttttgattacgctgaatttgatcttctcgcaatggtaaacctttgggaatatcctcgcccttactttgttttttcataaaatgtttcaccattctatcttctaaagaatggaaactaataattgataaacgaccttctggtgctaacatatctaacgcagaattaagcagactttctaattcatctaattccgaattaataaaaatacgaatagcttggaaactacgcgtcgcaggatgtttatgtttatctttaaaaggaactgcctgtgaaataagttccgccaattgactggtacgcgataaaaattctgtgctattttttaccgcacttttattgaaatcaacaatagcagtggcaatacgtttagcgaaacgctcttcgccaaaagttttcaacacccaagttaaatcctcaatggacacttgttttaaccattcttcagcagataaaccttgagttgtatccatacgcatatcaagcgggccatctttcataaaactaaaaccacgttctgcttcatcaagctgaggggaagacacaccaagatcaagcaaaataccgtcaattttgcccactaaatttaatttgtcacaaatttcaggaatatgcgaaaagctgttatgttcaatctgaaaacgcaagtcttggattttgtgtgcttctgcaatagcacgaggatcacgatctacagctatcaaacgaccattagaagaaagttgagaaaggataaaccgagaatgccccccacgcccaaaagtaccatcaatataaatgccattctccttcaatgccaagccattcacggcttcgtgaagtaaaactgtaatatgttcagatgaagaaaaggaattttcgctattcataaatttaagataaaagtactacattattttctataatgagaaatcatttaacgcatcagcagcaaaatctgtgctggagccaatttctatatcctctgcaatttgagtatgccattctacatcgctccaaatttcaaatttattaagttgccctaccaacattaaacctttttctaattttgcgtgttggcgtaatggcccactaagcaaaatacgaccctgagcatccatctcacattcagtggcatggccaagcattactcgctgcaaacggcgttgggtaggatcaaagttagaaagtgcgagaagtttttgttcgattttttcccattcatcaaggggataaagtaaaagacaggattggcgaatatctacagtacaaaccatttgcccttggttcttttcaagaatttcagcgcgatagcgagttgggatcgctacacgccccttagaatctaaattaaccgccgttgcaccacgaaacatattacaccttaaaaattgaacttatttttagaaaatctctaaaaatctccacaaaacaccacttttctccacttctggcaagtttataatttgttcgctcaacttgcaagtaattccacattaaagcaactgatttttatcaaaataaaaaagccgtttgaataaacaattcaaacggctttttcatcaaattttattgactaattatttatataag

SEQ ID NO: 570 - DNA, 14547 bp, H. influenzae
  misc_feature (14474)..(14474): n is a, c, g, or t
  misc_feature (14508)..(14508): n is a, c, g, or t
  misc_feature (14518)..(14518): n is a, c, g, or t
gaagaaaccggatgaaggcaaataaaaaaagtaggaaggagataacaaaggaacaaagaaaagaaaaaaaaaagaaaaaataagcatacagataagaacagaaacaaaaaaaacaaggaggataataaagaaaagagggatgttagacacaggaggaaaaagaagatggaagaaaaaaaaaaaagtaaatcggggcaatattaaaggcacaaaaataaaaaatgaagagcagtagaataagcctatgatgtaagttaaatagtcggcattaatctaaaaagagcaaaggagtatgaaaaagtgatcaaaaagctaaaaagttatgataaagtagtcaaggcctattatacaacgggcaattactcgattttattaaaggtaatgacacacacaattgcagaattacattccgttttggcgaccaagattcagttaattgatgaaattcaatccactgaaaccttgatttcaatgcaaaatccaattttgcgagatattaaaccttaagaacatagaaagtgcggtgaaatttttattcaaatttatcttggtgtttaaatttcaataaatctctccgctcttttttatttgggcgacgatcaggatggggcattgaaagggaattattttttcttgcccacgcgatttcttctctttttttcacgctactttcggtttcttgatagagtaattgtgcttctggcgcacctcggcgttgatcgcttaaggcgataatttttatttctttttcttcgtttccctggcgaagttttaacattgcgcccacttccacaattttacttactttcgcacgttgattgttgtaatgcactttaccactttcaatcatcgctttagcaatgctccgtgttttgtaaaatcgggcagcccacaaccatttatctaatctgacttctttttctgccattattttctccttattttgattcgacaaaatagtaccacaaagtatgctaatgaactgttattaaaaattttattctttaataggatttttattaaatgaaaaaaaataaaaacaggttaatttaaacatttttcaataaaacaaattttatgttaaaaaaacttgaaaaatagtcaaatttttgacaaggttgagtggttttctttttttaagctcaaggaacaatttatgcataacgaaaacttaaaagaattgaccgttcgaggaattattctcggtgcattgattacggtaattttcactgcatccaatgtgtatctcggtctaaaagtgggggtgacatttgcgtcatctattccagcggccgtcatttctatggcagtactcaaatttttcaaagattctagcattcttgaaaataatatggtgcaaactcaagcatcttcagcaggtacgctttcttctgtgatcttcgtcttgcctggtttattaatgatgggctactggcaagattttccattctggcaaacgatgttgatttgtgcagctggtggtacattgggcgtgttattcactattccattacgccgtgcaatggtggtaaatagtaatttaccttatcctgaaggggtagctgctgcagaaattttgaaagcaggtaatcatgcagatggcgacagcggtgtgaaagatattgcttacggtggtgttttagcgggattagtggcatttttaactaacggtttacgcgtgatggctgatggtagtgcttggattcaacaggaaagcggcgttccaattaccaatgggcttttcacttgccttactcggtgctggttatttaattggcattgtcggcggtattgcgatgttaatcggtgttattttgacttggggtgtggcagtgccatatttcacaatgtcagaagatattgccgcggatgcaagtttaattgattctgcgatgactgtttggaaaaccaaagtgcgttatattggtgtgggtacaattggtattgctgcgatttggacattgctgattttaatgaaaccaatgattgaagggatggttcattctttccgtatgctgaaaggtgggcaagaggcatcagaacatcgtattgatattgacctttctccaaaaacaatgatttatatcttaattgcgacggttgcgttaattgttatttcattacatcactttattgcggcggcaccaatttcgcctgagctttccattttattagtggtagtttgtactttcttagcggtatttatcggcttctttgtggcagctgcttctggttatatggcaggtttagtgggttcatcttcaagcccaatttctggtatcggaattatttctgttatcgtgatttcattagtattggtgtcaatcggtaatgcctcgggcttatttgaaactgtagatggtcagaaatttttaaccgcacttacattgtttacggcatctatcgtaatcactacagcttgtatttctaatgataatctacaagatttaaaaacgggtttattagttgaagcaacaccttggcgacaacaagttgcattaattatcggctgctttgtcggtgcacttgttattgcgccagtattagaaatcttatatcacgcgtatggtttcagtggtgcattgccacgtccagatatggatccttcacaagccttatctgcaccacaagcaacgttaatgaccgccatttctcaaggtattttcacaaataaattggaatggacttacatcttaactggtgtgggtttaggtgctgtgttaattacgattgatgcatttttgaaaaaagtcagcaacaaagtctttagcttgccagttattgctgtggggattggtatttacttaccaccatcaattaatacgcctgtgattgttggtgcattcctagcgtggattatggctcgccatattgcaaaacttggtaacaaagaagtgtcagctaaagcagaacgtttcggtacgcttttctctgcaggtttaattgtaggcgaaagtttaatgggtgtcattttagcattcattattgcggcttctgttaccactggtggttctgaagcgccattatccttaaatcttgaaaactgggatacaattggcgagtggttcggtttaatcgtatttatcgtgggcattgtgatttttgcatctcgcgtattacgtgcgaaaaaaatctgattaatccttaaatttattttagaataggttatcttctggataacctatttttcactatgaaatcttacttaaaaacacttattttttttcctctgattttacagatagtcgtcaccgcacttttgatttggttcgatgatgactcaagtggcgttatcgttcctttttctagctatgctctcacagcatttcttctcgccacaattcccgcatttttaaccgcacttttagccgcaaaattccgttacacacgttataacattgcttcgattgtattagtttcatcgatcatttcatttgtttattgcaatatggcatcttatttttatttgttattactcggcgaacaagacacttccttttggggctggttgaccgaagggggattgtccctcgggttaataagcacatgcggaatggttttttatgctctatttgtaatgccttggttgctgccaaaaacaagagaataattttatgctgacgctaaacgaacatttacttaaccaagtattgctgattgcttaccaagcgggtaagcatttgcaacagttttatcaaaaacaggttcatgttgaattgaaagaagacaacacgcctgtgacggaagcggatctttttgtgagccaatttttaaccgaaaaattgaccgcacttttccctaatgtccctgttctttcggaagaaaattgccatatttcctttgaagaacgtaaaaattggaaagaatattggttgattgatcctcttgatggcacacaacaatttattaatcgtaccgatcaattttctgtgttgataaccttagttcgtaaaaataaacccgtgttaagcattattcatgcgccaattttatcaataacttattatgcaatgcgtgatttcggagcgtttaaaaaacaactggatcaggtaaaaaaactcactaaaaacacgacgaattttgaccgccctttacgaattgcggtaggtgcaaccacttcacaagaaaaagtgcggtcgattttgccgaaggattttacttgtgaatttgttgtggttggttcaagtagcttaaaaagcggtttggtggctgaaggtgcagtagattgttatgttcgtttaggacaaacaggcgaatgggataccgctggcgcagaagtgttgctgaatgaaactcacggtgccatttttgactctcattttgagcctttaacctataaccaacgcgaaacattgattaatccgcattttgttatggtgggcgatcaatcgttcgattggcgttctgtctttcaatttaattgattggttcgattggtttttttctctagaatacggcattattttcgacattactcggaagccgaataaggaataattatgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcaaaaaaatgcgtgaggcgttaattcataatgaagaaacaacacctgacactttagatgctttctgctctcatctttattaccaagcagtgaatacttcggatgctcaagattacggcaaacttgttccacgtttagacgaacttcacgataaatatcaaacctgtggtaacaccctttactatatgtccactccgccaagtctttatggcgtgattcctgagtgtttggctgcacatggtttaaatacggaagaatatggctggaaacgtattatcgttgaaaaaccttttggttacgatgaaaaaacagcgcaagcattagacgtacaaatccaccgtttctttgaagaacaccaaatttatcgtatcgaccattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattacaagtccttgctatggttgcaatggagccgccagcgattattaacgcgaattcaatgcgtgatgaagtggcaaaagtgatgcatagtttgcgtccattaacttcggaggatatggagaataaccttgttttgggtcaatacactgcggctgaaattaacggcaaaatggaaaaaggctatctagaagaaaaaggtgtgcctgcagattctcgtactgaaacctacatctcattgcgttgtgaaattgaaaactggcgttgggctggcgtgccgttctatgttcgtacgggtaaacgcttaccagctcgtgtgactgaaattgtgatccattttaaaactacgccacatcctgtattcagccaaaatgcaccagagaataaattgattattcgtattcaacctgatgaagctatttcaatgcgttttggtttgaaaaaaccaggtgcaggttttgaggcgaaagaagtatcaatggatttccgttatgcagatttagcaggcacgcaagtattaaccgcttatgaacgtttattgttggatgcgatgaaaggcgatgcaaccttgtttgcgcgtactgatgctgttcacgctgcatggaaatttgttcagccgattttagattacaaagcgaatggtggtcgtattcacgaatatgaagccggcacttgggggcctgggcagccgataaattaatcgcaaaacaaggcaaggtttggcgtaaaccaagtggattgatgaagaaaaaagtgtaacgatgatgacctagggtaggtttaccctaggctagcaagagtactacccctttggggtagaattaccgtttcccaaaatggaactactatcacgtaattagccgtgggtatatttacttacgacatcataaacggaacagcaatgaataccatcactttcccaactgctcaacacgcagtcgaaaaaatcgcgcaagaatttgtgatttacagtcagttaaatcgtcctgtacatatttctctttctggtggatcaacacctaagttgctatttaaaaccttagccaaattgccttatgctgaacaaattaactggaaaaatctgcatttttggtggggagatgatcgtatggttccgccatctgatcctgaaagtaactatggcgaagtacaaaaacttttattcgatcatattcaaattccagcagaaaatatccatcgaatttgtggcgaaaatgaaccgcactttgagttaaaacgctttgaagaagaattaagtgcggtcattccaaacggtatttttgattggattattttaggtatgggaacagatggtcataccgcttctctcttcccacatcaaaccaattttgatgatgaaaacctagctgtcattgcaaaacaccctgaaagcggtcaaattcgcatttctaaaacagctaaactcattgaacaagccaaacgcattacctatttggtaacgggtgaaagcaaagcagatattttaaaagaaattaaaactaccccagcagaaaacttgccttatcccgctgcaaaaatcaaagcaaaaaatggggtgacggagtggtatttggataaagccgcggcaaggctgctctaatggaaattttagctcatattttaacttgcacttgtcacccttgaacatttctacattctctatttagaaatgttcaccattgaaagcaaaagtggtgttcgtcaatcgagggttatacaacggcttttggcagcagggattatttttggttatgccatcaaccaaatttcggtgatttatttctttttaggttgtgtgattatcgccgcagtttttggggcggttacgacgaagaataaggggatattggtaaagtaggagttgcctgcagtgttggcaaaattgatcgcttgtaggggcaaattacatttgccctataaaaacaattacagcggaatgtatgactacgaaatataatgcaggtattcatcatcgaagctcgattcgtttaaaacattataattatcgttctgaaggattttatttcatcaccatttgttgtaaaaataaagaatgtctatttgggcatatcattaatcaacaaatgcaattaaatgatttagggaattacgtaaaacagtgttgggaaaatattccaatgttctttccacaagtacgaattgatgaatttgtgattatgccaaatcatttacacggtattattgaaattattgaacaggtaaagggcaaatgtaatttgcccctacaatcgagagtaacgcagttgccacaaaagggaacatctcaaacaattggctcaatagttcgtggatttaaagcaggtgtaacatcttgggcaagaaaaaatagtgaaatttttgatgtttggcagcgaaattattatgaacatattattcgtgatgaaaaatcctatttgcagatttatgaatatattcaaaataatcctattttatgggaacaagatcaattatatgtagattaaaagggcgaatgtaataccctcctacaatttatctacatcatagacaaacatgtaggggctaattatattagccctcatcataaacaaagatttagtaatccaacaggagaaaacaatgtcagtaaaaggcgacatcggtgttatcggcttagccgtaatggggcaaaacctcattttaaatatgaatgatcatggctttaaagtggtggcatataaccgtaccacttcaaaagtggatgaatttttacaaggtgcagcaaaaggcacgaatattattggcgcatactctttagaagatttagcttctaaattagaaaaaccacgtaaagtgatgttaatggtgcgcgcgggtgatgtggtggatcaattcattgatgcgttactaccgcacttagaagaaggcgacatcattattgatggtggtaactcaaactatccggatacaaatcgtcgtgtaaaagcattggctgaaaaaggcattcgctttatcggttcgggagtttctggcggtgaagaaggtgcacgtcatggaccatctatcatgccaggtggtaatcaagaagcatggcaatatgtgaaaccaattttccaagcaatctcagctaaaacagaacaaggcgaaccttgctgtgactgggttggcggtgaaggcgctggccactttgtgaaaatggttcacaacggtatcgaatatggcgatatgcaattaatctgtgaagcttaccaattcttaaaagaaggtttaggcttgagctatgacgaaatgcaagccatcttcgcagaatggaaaaatactgaacttgatagctatttaatcgatatcaccactgacattcttggctataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaactgcgttgttatggcgtgaaggttgtatcattcgtagccgtttcttaggtaatattcgcgatgcttatgaagcaaatccaaatctttgttttcttaggttcagatagctacttcaaaggcattttagaaaacgcattaagtgactggcgtaaagtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacaccaactggactggtcgtggcggtaatacagcatcaactacttatgatgtgtagttaaaaacatcaataagaattaccgcactttaaactgttgccataaatttggatagtttattaatttgctgaaatattgggctctacataatgtagagctcaattatttatactaagggtatactttattgatggcagcgatcgtaaagcggttgtaattgttgaatggtgtgtgtaataaataaaatgggatctatttgatttaactcggctttttcaatacttttcccaatgcaccaaaaatcctcatctgaacgtaagatcagatttttttcagaaatgaccttcacttggcgaaaatcatcatattcactttcatcctctcgccaaatctcaaaatcagcaaattgtttgaaatcaaattgatcaagccactgattatattgttgcacattaatttgtgagcgatctgcacgatagcaatgccaatctaaacacactcttagtcggcgacgatttaatagcacagaaaagattgcggcagaattttggttaaactcgtatttaaaataagcgaagaaatgcgcccgtacctgccaaccattggtccagctttcaatatgcggtttcgcaaaaggcgtaccgagttgtgctgaaacagattgaattatcgctttccaattatcccaatgtaatttgtaatccgctttaatcgctggaatatcttctgggcagaattttttcatttgggcgaattgatagaaaggaatattgaacagttcacaagattcagcagtgagcgagagcatagcgtttccttaaaaatcactgtaatttttgaccgcactttgtgtgaagatctgcttgtcttcccagcgtaacatagtcattcgattattccacacacaaccagtatctagggcataaacaccttttggggtaggctcatccactaaacttgcccaatgtccaaagacaatgggaatttgtttataaagtggattacctaaattaaaccaaggcgtgagctctgtaggtgcatattttaaaggggatttacaggcaaaatccaagcgatgatctaaatagcaaaaacgcattcgagtaaaagcattaataatgtaacgatgacgcgctaagccctgtaaatcaggcgaccagcgatcaggttgttcggaatacatattttcaatgagataatgaaaatccccattttgtaaaatctgttccacttcagccgcacaagatttcgcagtttccaaattccaatcaggcgaaatacctgcatgcaccatcaggaagtttaactttttattatgtacaagtaatggctgatggcgtaaccaatgaatcagttcatcaaaatcgggcgcattaaaaatagcatcaacacgatcacgcggttttacttttttaatacccagtgcagtcgcaattaagtgtaaatcatgattgcctagcacggtttgtgccgaatcgccaagtgattttacgaaacgaaggcattcaagtgatttatccccacgagccacaagatctcccacaagataaagtttatcttgcgttggattgaagttcacacgttctaataaaagctgtaattcatcataacagccttgtaaatcaccaacgaaataggttgccatttttgaccgttcttttataaataaattttgagaattttaacacagacttttattgttgatttattcttttcgtatagtagaatgcaaaaaatttagttatttccatttttatttaaatatgagtgctattgaaaatattgtcattagtatggaaaatgcaactgaacgtcgcaaacatattactaagcaatttgaatcaaaaaaactttcatttagtttctttaatgcgtacacttatcaatcaatcaatcaatcaatcaatcaatcaatcaatcaatcaatcaatcaatcaatctccatattacataatatagaggaatctagaatacttactaaaggagaaaaaggctgtttaattagccatttcttattatggaataagtgtgtgaatgaaaatttggaatatctcacaatttttgaagatgatgtaattcttggcgagaatgcggaagtgtttttggcacaagatgaatggttaaaaacacgttttgattttaatgatatttttattattcgtttagaaacttttttacagccagttaaacttgagaaacaaactaaaattccacctttttattctaggaactttgatattttaaaatcgactcactgggggacggctggttatattatttctcaaggtgcggctaaatatgtaattgaatatttaaagaatattccttctgatgaaattgttgcagttgatgaacttatttttaataaattagttgatgttgataattatattgtctatcaacttaatccagcaatttgtattcaagaactccaagcgaatcaaagtaaaagtgtattaacaagtggattggaaaaagaacgagaaaaacgtccaaaaatccgtaagaaaaagacattgaaacagcgtttaactcggataaaagaaaatattatacgagctttaaatagaaaaaaatggaaagaacaacaacgtattaaagaaatgcaaggtaaagaaattgtccgttttatgtagaaagccaaggtgtaacaaggattacaccttttattatttttactcttctgaatctaatatttcatcgttattaacatctgctggtggattatctgccagccagttcgctaagcgcgcataatctgcgatagccaaattttctgcacgtgcatttaaatcaataccaagtgcggtcagattttcaggtgaaaatagtgttgaaagtgcattacgcaatgttttgcggcgttgattgaacgcttgggagcaaacacggttcaaccaatataaatcttttacagggtgcggcaattctttatgcggaattaaacgcacaacggctgaatccactttcggtgctggtttgaatgcagaaggaggtacttcaagtacaggcatcacttggcagaaatattgcgccataatggttaagcgaccataagctttgctatttggccctgcgcataagcgtttaaccacttctttttgcagcatgaagtgcatatcttgaatcacatcatgatacttaaataagtggaacattaatggcgtagaaatgttataaggcaagttaccaaatacacgtaatttttgccctttttctgctaaattctctgttgtataaagctcatcaaaatcaaattgcatcgcatctgtttcaataacggtgagcttttgatgtaaaaatggatggtgacgtaaacgttccgcaaggtctcggtcaagctctaccacagtcagatgatcgacaagttcaccaacaggctctgttaatgcgccaagtcccggaccaatttccactaagaattgattgggttgtgggtaaatcgccgccacgataccttgaattacagaagtatcatgtaaaaagttttgaccaaagcgtttacgcgccgtatggcctaagtgtttttttgaattcataagtactatttaataagaaaagtgcggttattatagagcctgtatttcttttgtaaattttagtgtaactgtcatgggtaatatcatttagcgatgagttccagtatagctttaatatgatgactcaaacttggattataacgaatacaatccattggattgagaatacggtgtagctgttcagatgcttgttttactgatttttgaattgcctcatctaaagtacttatgttttctctagaaaatgtatagccaaattcgttttttaatacttctaggcatcccatgttttcagaaaaaataactggcgtaccagataatatagattctagtccaacaagcccaaatggttcatattgagatgccataatagtgaaatctgccgcttgatataattcaggcatatttttgcaaaaaccaagtgaagaaattttaggattttcttctacaggcgttcctgcgaccactaagcgaataggtaactgagttttttcaaaatattttttcaaaatatcgaaaccttttcgcgtatggccagtagaagggaataggtaaatgatttcatcttttttgaaacctaacttttctctgagctttactctttcttcttcattgatttgtgtgaatttatctgtattaatagggggataaatcacatcaattttgttttcagagacatgatataactcaacgagttcttttttcattaatgcagaatgagcgatgacatatttggactgatttaaggatttttgttcacccatgattttaaatcgatctgatatgctgggctttttctttgatgcttgtaaatatcctttatgatttccaccacaaatgaccacgtcagatagggtgtaagaggttgtcagagagatttctgatgtttctttatatttatttgaaaaataggaaagaaacgaggttctccattttttaggaacaaaagaaagattaatcttaattggatataattagattatattcaggtaatgcagtatcaaacttggcagagtaaattttaggtgtaatgttagcctgagataatccattaacaatatcaataagatatcgttccatacctccaccgtattgaaatttttgacaggttaatgaaatatttgggtgattattattacttagtaatgttttattcatttgtatctacctagtaatggggttatttatgttgattatagggggtgttttgattttgtaaatcatttttcagttatgtcgaattgagttttttatgaacaatattattttttctttcgcagaaagctaaaaacggctataatccgcccgtttttcttaacttttccgcctaaagtgcggataaaaaatcgattatttttagaggatacaatggcgaaagaagattgcattgagatgcaaggcacaattttagagactttaccgaatactatgttccgcgtggagttggaaaacggtcacgtggttactgcacatatttccgggaaaatgcgtaaaaactatattcgtattttgactggggataaagtgaccgtagaaatgacgccttatgatttaagtaaaggacgtattattttccgcagccgttaattgcagaatatgtgagatagaccgatatatatcggtcttcttttttgctcaaaaagaactcaaactggttgcggaacgtaaaaaaatcggtataatccgcaacccttagccacattgaatttttcgttncccttgcctttgcagattggtggctgtactacgncaaaggctgnatgggtaccgagtccgatattcgtataac

SEQ ID NO: 571 - DNA, 11009 bp, H. influenzae
tctagtagatcccctaaatttatatgacacataattaaaagttggagaaaaaattatgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataattagcttaaaaaaggcggtgggcaaattgcttagtcgccttttttgtaactaaaatctaaaaactctataaaaatttaccgcactcttaaggagaaaatacttatgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacaaccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaataatttataaattaattctcatacaaaaagagcggtcaaaacttcttttattttgaccgctcttttattctgtatctgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatcgcacgcgcagtattacccgtatcaactaaatcatctaccacgataaatccttcgccaccatttggcacttgggctgcatgaagaacttgtagttctccctggttgttatgatcgtgataacttgcgatacaaacggtttcaatatgacgaagacccaattcacgagccaatacagccgctggaaataaaccaccgcgactcaccgcaataatacctttccattgagaagctggaagtaaacgttctgataattttcgggcatgcatttgaaacatatcccaagttaccacatatttttcgctcataattgcaccttagtttaaattttgcataaagatgcactacccgcgtttttcacagacgtaaatcaaatgtatgatgcattattgaataaatcaggggcaacaggtgtatttactgatttcccagatacttgcgtggaattcttaaaaggaataaaataatttctattataaccgtaggtaagtttacttacggttattaatgccgtctatgatgaaattatcttttcaattgaaaagtgtttttcagaaagacttactatatccttaatgaataggaacataatatgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaaaaccaatttaaatataatttagtttggggctaagctcattttttactggcttagcctttttaatttttcaagttcactcaagtaatcatcattactacagcctgaagttttgctatgatgttgcaagcctttcaaaatagaaatctaattcaatgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaattataaaaatagggcaagtatttcgtttgccctaaatttttctcccataaatattgcgcactgagtaaattagcactatccgcaacgcgatgagcttgagcttggtcaatattgaattgctcacttaaccctcaagcggtgcacgctcgaatatctgcaacttggaagttttttctaggctataaatgacgccttcgcgcaatgcaccgtcagaatagcgcatttgttgaatatgaaaaacctcaaacactgcacttaaaatcgctaaaccgggtacaaaaacatccacacggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaagcctaaatcttcgattttattgaccgcactttggcgcacgcgttgaaagttttctggggaaatgatgccatcggtaaaaaaattgagtcgcaaaactcacgcatcccatatgtcggctttcagccataagcggcgtgaaatcatcgccgataatcatttctgtcgagccgccaccaatatctataacaagctttctgcctttttctggctgagtatggcatacgccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcggcaaataaggctaagcaattcacgccacgtgtgatagcctcttgattaagcaccgcattttcatctaagccttccgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagcgtcattcataacattcctaaaattcaaatttataaagtaaatcaaacacttggtttgtgctagaaacggattgaaaataaagctgtggcattaggcgataacgtaatgtaacttctgctaacccatcaaataaacctacgccatattttatttgtaagcgattggtaatattgccacttactgtaaccttagatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccactactttctaacgaacgacctgttaataaataagaaagtgcttgatcttgtggtttgcttggttcactgaaaatagtgacttctgggctatcggctatgccaatcactctcactccagcagtaattttgctgtcttccattgtttcaggattacgaatagcctcaatattcaacgtaggttgtgccgcttgcccagaaaaactaataagccctttacgaatgagtaaatcttgtccgaaagaagcatagcgacctttggttaaattgatttgcccgaataaacctaaattgcctttgtcttgtttcacagaaagtaaaccatcaagattggtttttaagccataggcatcaaggctgacgtctttaccaatattgatgcgtaaatcagagcgaatatccattcctgatttcgtttttgcggcaaattcacgtttaatcagttcttctttgctcttgtgcgggccgtttaaaatcacttcatcttcgctgactggctcagcagtatctggcagactgtcaattttaatacgcgcccaaggaatatccactgttccgcttaaattcaattccttaggattggcttttatcgtgatatctggactgaaacgtagcttcgccatagatggaatatccacgttgaaattatttgcttgtgcattcaattctgtcgtccaatgttcaatattcgcccagtttgcacgtccagttaagtttaagtgactatctactgtttcgattttcccttgcaatgttgaacggttaccattaaagcgtagggcaatatcgccatctgtaatattgactggcatagatttcaatttggtacgaatattacgaatattgaagtcaccatttaataatggtttctctaaattcccgccgaaactcaacttcgagactaccttaccattcactgattcaccgctagtaagtagctgatttgcgatcgacaagtttaatcgttctatcgcaagggttccgccaagttggcgagttttaacaaaatcatttaaacgaatatcgcctacaattctgccttgattatgcaaattgatgtctgtttttaaaaccaaattattattttgaatgtcggcattaagggttaattttggaatatctaatttaaacgtgcggtaatccaatttttgagagaaagctaaatgattgccatctacttttgtgctaaattggaatggtttatccgtaaaccaagccacattaccttgcgcttgcaagtttcctttgaggctatcttgttcgataagtttattcattaaatccaaattaacacgtttgaattggaaagggatattaccttgcttgcctgcattgaatgcttgtgggaaacataattctatatctgtgttttgccagcaatgtgcggcaatattggcttgtgtttgtttgttatcgtaagacaccgcaatagcttggttagattttacatcgccaattggggtttcaaattttgcttgggaaagtgtgcctttccactggttccaagtgcggtcaaaaaggccgttaattcggaaatttgcagcaacaggctcgccttgagattttagattaattgggatttttgtctcgcctgataatcaagacaagtaaaggggttaatattttcccctaagaaagtgttcggattatattcattttccccccagaggggggattggtattagacctttatacttctttactaccgaaacctttcaagtaaatggagatgtcattcagatcgatagggcttgattcaccacaatcgtcctcccttttaatctacttaccccggttctcggccctctcaccccaactaaccatctc

SEQ ID NO: 572 - DNA, 7612 bp, H. influenzae
gggcgccgggatgaaaagagtgggttttcgaggcgggaactttatggggggggcgtgctcacacgaagaagctaccgcggggaaaaataggtttacataatcacggatcgattgcaataggaaaaacgttcccgcaaggcgaaacgctgaaatttacaggcattccaaattttgcgccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatggaaaaaaatttgaagaatttaaacgtaaaaacgagcaaaatttagccttagatggcggcgataatttaacctatattgcaccaacaatggtaaatctaaatttagctcaagaacgttatcctgatgtcgttttttacaaaactcgcgaacattaaaatgacaaagtgcggtaaaattctaccgcacttttccagaaaaaaagcgttgaaatttaattcaacgcttttcttttatttagagagattttcttgttttaatcgccaaagttgataaatatttaccacaactaaaaaggcatttaataatgcaacggggtatgctgtgataattacgctgtaaataacaaataaaatcgcgccgatactatttacaatgcgtaaatacacaatagatttaaataaaaaagatacagcaacaaaaaaagtcgccatataacctaaaaactcaataaaattaaaatccattattttgttctctttgattaaaaataaaaacggtgggtatgataaaagatttttaacgtaaggaaaagataagaaaaagaagcaaccgtttgcaagggaaatttatataaaaataagttgaacgagagccatatagaaaagcgtaccaacagcaatagatagaaacatatttttcttccagaaatgtaagccaagcacgactatccctgcaagcaaatcaggaataccgtgatagccagttaaaatctcaatatttttatagcaataaacgacaagcataccaaacattgcagggggtaaaacttttccaagataacggatatattgtggaatggggcgattaacaggaaatacaaaaaatggtaataaacgtgtaaattgtaccgccactatacaaattccaatggtaatgatttgttctgttaatgtcattttaaagattccaattttgtttctaatttagttatgcgcatagttagaattaaccaaatgccaattaatgttggaattaaaaaatattcttttcctataataagtaaaaaagcaaatgcaatccctaaacctaagagagagctttcgtgggatttttcttttagccaattttctgcaaaaataactaagaatagtgctgtcattgaaaattccacaccttttaaattaaaaggtaaaacagtaccaaataaattccccattgctgcgccaagtacccaataaatatgcaaatataagctcacaaaaaacatataccaacctttatctaagtgctgtgggatttttgccatataatttagggaaaaagattcatctacaagtgttgtgattaaataccaacgtttttttcctatatgtatgccatatttttctagcattgatatgccataaaaaatttggcgggcactaatcattaaggtaattaataatacgctgattggagagaaaggtgcaataagtgcgcctgctgcaataaattcaacagaacccgcataaataagtaaagccatcaaagtaggatataaaaatccgaaaccaagtgctttcatataaataccgtatgctatgccaagaaataaaaatcctgcaatcattggtacgctgtagggaaaagcagccttagccgcttcagtaattgggttagagtgttgattttgttgagataaattcattaattatgtctataaatttaaaacagaaagtccgggtaaagttgagaaactttgagatttgactgtttgataaaaatcttctaaataagaaagggattcatcttctttgcgaatcgccgcatatagattgctatataaaccttcttttgtgacttttcttgccacgacataacccttttccaaataaggcagcgcagcccaataagggatagtcgcaataccacgacgactcgcaacaagttgaatcattgcaatagtaagttctgttgtacggcgagtaggattaatgccttttgatttaagcactttacgccatagatctaacatatcgtcaggtacggggtaagttacccaagtttcatcaataaaatcttccgcttcccaaatatctttttctgctaaagaatgattttttgagcaaatcccaaccatttcataagaaaagagcggtttaaaaatgacatcatcattatgctctatttctgatactatcgcccaatctgctcgatgggaaagtaataaaccaacgggatcagtatgaaagccagatacaatatccagttctactagcccccaatgctgacggaattcatccatcgctggcattaaccaatcaaaacaagtatggcattccaccgctatacgtaactgtcctgcatcgccgtgttttacccttgcaagatcacgttcagcatcaatcactttcggcattacttcattcgcaagacgaattaaacgctctcccgctgaagtaaaacgaagtggattacttttacgctcaaataaaggcaagccaaattgttcttctattaatttaatttggtgagaaagggctgattgggttagatatacgtgctttgcagctagagaaacgctgcctgtctcttttaaagccaataaagttttaagatgtctaaattctagaaaggttggtttcattaataatattcatataaaattaagaattagggaaccagtataatacattaaaattagaaatatgctaattaataaaattaattatttagataattattttagttaaaatacaaaaccccagtccttaaactggggttctatatttattctttatctaatttgtttaattctgtttttacttaattaatttttatctatcttagataaatttatatttagaatttttatttgctaacctggcggtgccctactctcacatggggaaaccccacactaccatcggcattacagcgtttcacttctgagttcggtatggtctcaggtgggtccaccgcactatcgccgccaagataattctttgataactcgtcttctcttttatctctcgtctcttttatctctcgttactcagtctttactctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagatttttttacaaaacaggtttgtttttagagtttccttttcagttctctctttcactttcctgtcttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggtt

SEQ ID NO: 573 - DNA, 22958 bp, H. influenzae
  misc_feature (8952)..(8952): n is a, c, g, or t
  misc_feature (9015)..(9015): n is a, c, g, or t
  misc_feature (22946)..(22946): n is a, c, g, or t
atcttacgatgtctgcatgataacaggcttgttaaaaacatatgaaaaggtcaatgtattactcatgatgaatacaaacttttaaacaaagcatgtagcactaaacccgacaatgttccacaagcctacaaaatgagagattcatcttactatgttgaatactcaccagaaactgatggttttgtaccaatgagtagtgaaaactaaaatcgtcataaagagctcaaaaatgagctcttttttcattttatgtattacatataggttttatcattctaatcaactaaatgcatctagacatcatttagaattattctggcttacattaaatacctatatacatttatcaagtacagtgaacttaaaatgatgaaaaaatttccaaattttaaaccgcattctgacacggaaactgaagaattaattagcttactatttagaaaactcgatattgatgaactaatctttctgctacgtgttttacaacgtgatatccgtgcaaaatatacactcacaaaaataattaaaaaaaatatcaatttaaagttagattcataaattcctgtgttaagctcctaaaaagtatgtacgaaataggagataattatgaaaatacaagataacgtcggctattacttcacaattcaagatcttcaagatcgtttacgtgtaagtcgttcaactattctgcgattaattgaatcgaaaaaattaacatctatcaaatttggacgacaagttcgtattcctgaatcttagattctaagttaccttgaaacttgtaaagtataaaaaaataagccaccaaaaacatggtggcttttatttactatcttttatatcgtttaaaacacatcttcgcactgccttctgatattgataaacaggttgctatttctcgccattttagaccttgtgttcttaactatactattttctcatatttactttttaagtcattttgtgatttcacccatccgaattcttctgaccaacgattcaatgagcttacactaatactaaattgttctgctatttgctttaacgacatattaggtttattagctccaaattgattaaacaactctttcttgataatttgttgcttttcccatcgttttcgagaacgatttgactgaatttgttgaaacgatgattcagaaaatctttcccaaatccaacgagatgaacttctagcaattccttttaactccctgtatggtaatggtggattatgattctgatttaataactctaatgaagataataaatactgattaaattgttctaattgtttacctgaacatttaaacttcagaacctcacgataaccaatttttttgatctgattaaataaagaacaattccgaccttcaatatcttcattatcatttagataaaatacaggtttatttgataaatcaacaaaatcagctaaataatccagagtatatttaggtacattaaatacaaatgttctccaaaaatttgagtttggatttttagtgaatacaccaacatagtgttgatctgctcctaacttatcaatataagctcgttgtatctttttaaaataacttattggcttaaatcgagcattctttgtgttacaaataggtacctccaacgcatagatataatgacatcgaccgtttaatctattttgtaccactatattgggacttggaagtcctaacaattcccaatccattgcagaattttcccgatctagatctaacaccataaatttaataaacagatcattaaactgaatatacttatgagttaatgcaacatctttagggtataactgcaccccattatcaaaattatctgtctactttatccgttctgctaagctttgattaaaatcatctaatgtatatgctgattccatatttacctctttatatatgattgaatttatgtggtagacatatctatctaatatgccttaactgagattaatacaaaaaaagtattttttaacttaatatgattattttttagacacttaaaacatgaaaaagaatcgaatgcctaaatcttaagcaaaaaatatagatttgtaacaaaatatcatcccatatcagatattaataatttaaaagtaatataaaataatatctaattaaattagatctcaataacttgatgataaaaatattgtttaaggcatattacaaattgaatagataaaatttagagattttttggatacatcggatactttttgatgtattgtatatactagagataatgttacatataatcagtgaacaagtaataaacagctacaatgtacacacctaaaaatagtaaccaatttggtaaccaattatcaaaacatgaaagaagattgattatatttacaatggttagagatgatctatttaatttttgaaccacatcgtaacacttccttcaatatagggtagaatgtgcggtattatagcccataaaagtaggaaaaacgatgcaacacaaattgattgcctttattggtggcggcaatatggcacaagctattattcttggattattgaaacaaggttatcctgccgagcaaattattgtgaatgatccaaatgaagaaaaaagagcattttttgccaatcttggcgtggcaacttcagaaaataatgtggaaagtgcaatcaaagctgaggttgtgttgcttgcggtaaaacctcaaatgatggctgatgtttgtttgccactaagtgcggtggatttttcccgataaattgttaatttccattgctgcaggtatttcaactgaacgcttgaacgcattaattccaagcgtaaaatcgatagtacgcgtcatgccaaatacacccgcattagtgggggaaggcatggcggggttatttgcaccgaaaaatacgagtgaaaattaccgcacttttgcacaagatttattgggagcagtgggaagaacggtttgggtggatgatgaaactcaaatgcacgcagtcaccgctgcttcaggaagtagcccagcctatttctttttaatgctggaagcgatgcagcaagccttaatcaaaatgaatatagatgaaaaaacagcacgtgaattagtccagcaatctatgcttggtgcagcaaaaatggtgaccgaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctgatgcaagttcgtcctttttattggctcgcactgagctttctaggttactactgcgcttatggcgtatttttgcctttctttcccgcatggttaaaatcacaacaatatggggaggaaatgattggtttggttatcggcagtgcttatattttccgatttgcgggcggattatttttttcatcgctgattaaaaaagccaatcatattattattctccttacgcctattggcgttagcatcggcaattattatggcggctatgagtttagttgcgcataatttttggttgttgtttattgctatcggtttgtatgcttctgtgaattcagcaggaatgccgattggggattcgttggcatccacttggcaacgccaaatcggcttggattacggcaaactccgtttgattggttctgctgcttttattcttggtgtagtagtatttggtggcatgattggctgggttggcgagccataatatcgtgtggactttaatccgcacttttatctttctataccatcattcagcttttaaaaccgaccattcccccaaaagatgaaatacctgaaggtggcgttcaaaatgatgttggttttattgctttactgaaaaatccgatgacattacgagtcatggttgcagtagggctgattcaaggctctcatgcggcttattatgtttacagcacgatttattggacaagtattgggatctccgtttctcaaactagcttactttggggcattggcgtattagcggaaattgtattatttttcttctctcgtcgtttatttcaaaatatttctatcagcgtactgctttatatttctgcgcttgcgtgcatcggacgctgggctgtaataggatatattgacgatttctggttgatattcttattgcaacttatacacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgcagcattttttgtgattccacgcaagttaaatgcctttttgattgttcagcataaataggacgtatcgctttccttttaaaaaagtaatatgaaaaatcttgcgctcattgatttgtttcttaacgaatattggattgaaaaagggctttcagaaaatactgttcaatcttatcgtttggatttaaccgcactttgtgattggttggataaaaacgacttgtctttggaaactttagatgctgttgatttgcaaggttttctaggagagcgtttggagaaaggttacaaagccacgagcaccgcacgaatgttaagtgcaatgcgtaaacttttccaatatttatatcgggaaaaatatcgagtggatgatccaagtgcggtgctaagttcgcctaaattacccagtcgcttgccaaaatatttaaccgagcaacaagtgtcagatttgctcaatacgccagatgttaaagtccctttggaattgcgtgataaagcaatgttagagttgctttatgcgacggggcttcgtgtaacagagttagtttcgcttacgattgaaaacatgagcgtgcaacaaggcgtggtgcgagtgattggtaaagggaacaaggaacgtattgtgccaatgggggaagaagctgcttattgggttcgtcaatttatgctttatggtcgtcctgtgctattaaatgggcagaagtctgatgttgtgtttccaagtcagcgcgcacagcaaatgactcgtcaaactttctggcatcgtgtaaaacattatgccattctcgcggatattgatgctgatgcactttcccctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataatttcggggtaaatttttatagttttaaagattgattgtggatttcttattgattaattaatttgacacgcatcacaaattttgaataaaaaattagacagctcaagcatattttgctatcttgcgaagaatttcgacatttgttctatcgaaaagtaattttggattctaaaatgaaaaaaatcacgcttttttttaccgcacttttatgcttattttcaacttctgttttagccgaacctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaattaaaaaagccttattgagtacaataaggcttttttagtggttaaatttatctagtctgataatttctgcaaaccaaaatgacgataagtttgcgatgttgcaatacggccacgcggcgttctttgtagaaacccctgttgaatcaaataaggctctaaaacatcttcaatggtatcacgttcttcgccaattgcagcagcaagattatctagccccacagggccaccatcaaaacgctcaataactgcagacaacaactttctatctaaataatcaaatccagcatcgtctacatctagcattgaaagcgcttgttttgccacatttatagaaataataccgccattacgtacatctgcataatcacgcacacgtcgtaataaacggtttgcaattcgaggcgtgcctcgtgaacgacgagccacctcaaaagcggcttgttgttctaattcaagatttaaacagtccgcacttcttgcaacgatagatgttaaatcttctacagaatagaattccaaacgttgcacaataccaaaacgatcacgcaatggagaagtcaaagaacccgctctagtggtcgcaccaaccaaagtaaaagggggcaaatctaatttaatggaacgagcagcgggtccttcgccaatcataatatccaactgatagtcttccattgctggataaaggacttcttcaatagcaggggaaagtcgatggatttcatcaataaataacacatcatgcggttcaagattggttagcattgcggctaaatctcccgctttttctaatacaggccctgatgtcgtacgaatattcacgcccatttcatttgccacaatattagcaagcgttgtttttcccaaacctggagggccaaaaatcaataaatgatctaaggcatcttgacgtagtttggctgccttgatgaaaatatccatctgctcgcgtacttgcggctgcccaacataatctgctaatagtttaggacgaatagcacggtcgataacatcttcatcaaccttagcttgcccgctaataattctatctgcttcaatcatatttttcctacaatgcggcttttaatgcttcacgaataacttgttcactggttaattcaggtttagcaacgcgttttaccattttttctgcttctgcaggtttataacctaaagcaatcaaggctgaaattgcttcatcagatgaactttccgagtgggattcaatagatggggataatggaatatgcgtactttctacaaagaaatcactttgttttatgcctttaaatttacctttgagttcaactaacaaacgttcagctgtttttttgccaacacctggaattttagtgagtttagaaagttcttctctctctattgcgtaagcaaattgttcgaccgacatggcggataaaatcgctaaggctaatttaggcccaaccccatttgttttaattaattcacgaaataaagtgcggtctgttttctgggcaaatccaaagagtaagtgagcatcttcccgaacaacaagatgggtgaataaagtagtttcttgtccaatttctggtaaatcatagaaactcgtcatcggcaaaagcaattcatagcctacgccttgcacattgagtaaaatttctggaggttgtttttctaaaagaatgccttgtaagcgaccgatcataattcttccgaatgataaaaaaattaacgcatagaataaaataaaactggacgaacatccagttaaatttttaatctaaagcgtcctcggctatatctggtctttaaaagtgcggtcattttttcttgcgtttctgtcattttcacagaattggcaatatgtaaagaatgttgaatagaatgagcgtgtgtaatcgcaatagccaacgcatccgcggcatcggcttgaggtttatctgataacttcaaaatacgagtcaccatttcttgcacttgtactttatcagcagaaccaatgcccacaaccgtttgttttactaaacgtgcggcatattcaaaaacaggtaaatcattatttaccgctgcaacaatcgccgtgccgcgagcctgcccaagtttcaatgctgaatccgcattcttcgccataaacacttgctcaatcgcaaacatattaggttgaaattgcgtgatgatttcagttactccagcataaatgcgtttcaaacgggtgggtaaatcttcaacttgagtacgaattgcgccactaccgagatattctaaatgtctccctgtttggcgaatcacaccgtaacccgttacgcgagagccggggtcaatacctaaaataatgctcataatttctataaaaaataggtaattaaattacccatttattgcattattaaagttgagatgccacttcgtcacagatttctccgttgtgatatacgttttgtacgtcatcacaatcttccaacatatcaattaaacgaagtaattttggtgcagtttcaatatcaagatcgacggttgttgatggaatcatcgttacttcagcttcttgtactttaaaaccagctgcttcaatgccatcgcgcactgaacctaaatcttcccaagcagtatagatttcaaatgaaccatcatcttgtggttgaatatcatcagcacccgcttcgattgccgcttcagttaaggcatcttcatccgcttctgcgattaagattaaaccttttttgctaaataaataacccacagaaccttctgttcccaagttaccaccacatttagtaaaacttgggcgtacttgtgagatcgtacggtttgcattatcacttaaacattccaccataaccgctgtaccgcctgggccataaccttcatagattttggtttccatattggtatcatcgccaccacctacgccacgatcaatagcacggttgatagtatcgcgcgtcatattgttgctaagtgctttatctactgctgcacgtaaacgcgggttagcactcacatcgccaccaccaattttagctgcggtaacaagttcacgaattaatttagtaaaaattttaccgcgttgtgcatcttgtgctgctttgcggtgtttaatattagccccacttactatgacctgccattntatttccctccatcaatctttaagaatatattttctaattgcttccgcattattggaagattntgtcatttggattgcttgttcaggggaaacccattgatatgccaaatgctcactcaatactggaataaattctttttccgcctcacacaaaaacaaatgttctttgcagtgagtaatattcggtgcgtatttatagcggaaatgtggaaaaatttcaaattctatgctctcattgcaatcaaaaagcgcggtggaattttccgaaatttctaaccgcacttcttcccatagctcacgaattgctgttttttttggtgtctcaccactttcaatggtgccagtaacagactgccaaaaatcaggatcatcttggcgttggagcattaaaactcggtttgtatttttagcgtaaattacaacaagaacagattgattatttttgtattgcatcattaaaaatgcggtcaaatctgaccgcacttcattcctaatattccaaacttattctgctttaacgacagaaattgccaactcttccaatgcttgcggatttacaaaactcggggcttccgtcattaagcacgctgctgccgtggttttcgggaaggcaattacatcacgaatgttttctgttccagttaaaagcatggttaaacggtctaaaccgaatgctaaaccagcatgcggtggagtaccgaattttaatgcatctaataagaaaccgaatttctcgcgttgttgttcttcgtcaataccaagaatacggaacacagtttgttgcattttcggatcaaaaatacgcacagaaccaccacccacttcgtagccgttgatgaccatatcgtaagcattggctaccgcacttgttggatcagcctctaattgctctgggctgaaatcttttggtgaagtgaatggatggtgcattgctgcaagattaccttcttcatcacgttcaaacattgggaaatcaatgacccaaagcggttgccattcgtctaaacgagttaagccaagatcacaacctaatttcaaacgtaacgcacccattgcatcagtggtcgtttgccatttgtctgcaccgaagaataaaatatcgccagtttgtgcattcacacgttctgctaacgctttccatacctcttcatttaagaatttcgcaatcggactttgcacgccttcaagaccagcattaatatcgtttacttttgcccaagccaaaccttttgcaccgtagatgcctacaaattgtgtatattcatcaatttgtttacgagtaatttctgcaccatttggtactcgaatgactgcaacacggccatttggattgtttgctggctcattaaatactttaaattcaacatctttgacaatatctgctacatctaccatttctaatggattacgcaaatctggcttatccgaaccaaaacgacgcattgcttcttgccaagtcatcactgggaacttacctaaatctacaccaatggtatcaagccataagtcgtgcaccatacgttccataatttcgcggacttctggcgcagttaggaaagaagtttccacatcgatttgagtaaactcaggctgacggtctgctcgcaaatcttcatcacggaaacattttacgatttgataatagcggtcaaaaccagacatcattaaaagctgtttgaaaagctgtggtgattgcggcaatgcatagaatttgcctttatgcacacggcttggcactaaatagtcgcgcgcgccttctggcgttgctttggtaagcattggagtttcaatatcaaggaaaccattatcatccataaagcgacgcacaaagctggtgatttttgcacgggttttcaaacgctgcgccatttcaggacgacgtaaatctaaataacggtattttaaacgttgttcttcggtgttattttggttgaagtctaatggtaaaacatcagaagcattgtagatgcgtaattctttcgctaacacttccacttcgcccgtagccatatttttattgatttggttttcaggacgcgcaatcacttcacctttaatttgaatacagaattcattacgtaacccagcagccgctgtcaatgcatcttgatatttaggatcaaaacaaacttgcacaatgccatcacgatcgcgcatatcaataaaaatcaagccacctaaatcacgacggcgatgaacccaaccgcttaatgttacgtcttgtccgatattgttacggtttaatgctccgcaataatgtgtacgcatcatttcaaaatcctttgtactcttttaattatgctcaaaaatctgtcgcaattatagcggaaaaccaagagagataaaaaggttatttatgctgacaaatcaatcaaaaaagcaaagaaaagtaataaatgttcaaaataaaggcttttttgtgccatatcatcagattttttgttatattatgcggcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgctctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataatttataaatttcttctagaataacgactctttctctctgcctttaacacattatggtaaaagatactctattttctacccccattgctaaattgggggatttcatctttgacgagaacgttgctgaagtctttccagatatgattcaacgttccgtgcctggctattccaacattattacggcaatcggtatgctggcagaacgtttcgtcacggctgatagtaacgtttatgatctaggttgctcacgaggagctgccacactttctgcacgtcgaaatattcatcaacccaacgtaaaaattattggtatcgataattctcaaccgatggttgaacgttgtcgccaacatattgcggcatatcatagtgaggtacctgtagaaattctctgtgacgatattcgccacgttgaaattaaaaatgcctcaatggtcattctcaacttcaccttgcaatttttaccgcctgaagatcgcgtggcattgctcacgaagatttatgaaggattaaatccaaatggcgtattagtactttctgaaaaattccgttttgaagatactaaaattgatcatttactcattgacttgcaccaccaattcaagcgagccaatggttatagcgaattagaagtgagccaaaaacgcaccgcacttgaaaatgtgatgcgtacagattctattgagacacacaaagtgcggttaaaaaacgtaggattttcacaagtagaactttggttccaatgctttaattttggctcgatgattgcggttaaataaaacaacggtaatttgatcttcttgcttgcatacagcaattgaaatgattagtatatacttattaaatacatagtatatacgagagggtaaatatgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggatcgcttgtcacgcattgagtttaaatgccgttcttattacacataatgtaaaagaatttcagcgaattacagatcttcagtggcaagattggacaaaatagataattctgattttttattttacttatgacataatctgtttaactcaactaaaaaaggacaaaccaatgcaaattttacacactatgttacgcgtgggcgatttagatcgttcaatcaaattttatcaagatgttttaggtatgcgtttattacgcaccagtgaaaatccagaatacaaatatacgctggcttttttaggttacgaagatggcgaaagtgcggcagaaattgaattaacatacaactggggcgtagataaatatgaacatggcacagcatatggacatatcgctatcggcgtagatgatatttatgccacttgtgaagccgttcgcgcgagcggtggtaacgttactcgcgaagcagggccagtgaaaggtggatcaaccgtcattgcttttgttgaagatccagatggttataaaattgaatttatcgaaaacaaaagtactaaatctggtttaggcaactaaagtgcggtcaatttttattgtatttttaataacgtagggattcctacgttattttatttttaagagatagattatgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcagattgccaacgttctatcattgtggcgcacaatgccacttttgaccaaagttttgtgatggctgccgctgaacgtactggcgtaaagcgtaatcccttccacccttttggcatgtttgataccgcaagtttagcaggattgatgtttggtcagactgttctcgttaaagcctgtcaagccgcaaaaattccttttgatggtaaacaagcccattcagcgttatatgataccgaacgcacggcgaaattattctgctatatggtcaatcatttaaaagatttaggtggtttcccacatattgcttctgaactagaacaggaaaaaacaactgaaaaagagaccgcactttaagaaaaataaaaaactggttgcaatcgttttatttttccagtagtttaaaagcaattcttatttggagataaaaaatgaacattatccgtcgtcaccatcatcaccattcaactgaataatctttcaggtttttggtgtgcttggaagatttcttccgagctgacaggataataaaaatcttacccctcggaaggcaactttcgaggggttttgttttatttacgatataggaggcattaatttagcgttattctttattcaataaaaattttaaagtaaagtatttatcatttaatttacaaggaaaaacacaatgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaacgattataatcccccacttgggggatttttttatgactgttcaacaacttatccaacgcttagatcaaaaagttcaacaactttatcaagctcatttatccaaacgagaagaaaaaatcttcgccaaatttgaccgcactttatttagtgaaaatggacaaaatgtttccttttatctaaaagaaatcaatcaaacgctagatagaataaagacattagagtctaacgattctaatcactataattttctagctgagcgtttactcgcccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaaagaagtggaaaaccgtgaaaatacggaaaacaaatgattagaaataaaaaactaattcttccgaattagttagctcgtaaaaattgatggcggaggaatagggattcgaaccctaggagggcgtaaaccctcgccggttttcaagaccggtgccttcaaccactcgaccattcctccgtgatttaacgagcgtgaataatacgttctctaataaaaaccgtcaagtagaaataatctcatttttatcaagtgattatttttaccacagcttataaaaaatgcctttcctatttatgaacggaaaggcatttttgttgaatgaatttcagtgctttttattactacaatatatcgcagaaattaaccgcacttttgtcatctaaacaattattttacgcgagagacgtattcgccagagcgggtatcaactctgataacttcgccgatttggacgaaaagcggcacttttacaactgcgcctgtgcttaatgttgcaggtttaccgccagtgcctgcggtatcgcctttaagacctgggtctgtatcgacgatttctaattcaacaaagtttggtggcgtaacagtaattggtgcgccattccataaagtcacgatacaatctgcttggtctaataaccatttttctgcatcgcctacggcttttgcatctgcagagtactgttcaaatgtttctgggtgcataaagtaccagaatgcatcgtctttgtatgaataagttaagttaagatccataacatcagctgcttcaaccgaagtgccagatttaaagtttacgtctaatactttgcctgaaattaatttacgaatacgagtacgagtgaatgcctgacctttgcctggttttacaaattcattttcaacgatgacacaaggctcgccgtcttgcataaattttagacctggtttgaaatcactggtagtatatgtagccatatttgaaatatcctaaaaatgagagatggtttgaaaagtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataagatccgataaaatacacataattttttcgccacacttttgagcttctcaattttgtggctaattaatataaataagaacaagcatcagaggcaatccagtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataattttttgggcgagtaatcgccttttttctttttaagttattttctcaaggtaggatttatgttgaaaaaaacatctcttatttttaccgcacttttactggctggctgtgcgcaaaatgcgaatgtgacaacacctcaaacgcaaaaaatgcaagtagaaaaagtggataaagccttacaaaaaggcgaagctgaccgatatttatgtcaagatgataaagttgttcgtgttgtacacgccacgcataaaaaatacaaaaaaaatttgcattatgttaccgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataatcgtgcaaagcgaacttcaacgtggttttgttttgcatcgtcgcccttatagtgaaacgagcttattggtagatttattcactgaagaaagtgggcgtttaaccgtgattgcaaaaggggcgcgtgcaaagcgttcatcttggaaatcggttttgcaacctttcacacctttattgttgcgttggacgggaaaaagcacattgaaaaccctcactaaagctgaacctgccgcaattacactgcctttacaacaaattgccctttatagtggattttatgtaaatgaattactcactcgtgttattgagtctgaaactccaaatcctgcgctttttcaacattatttaaaatgcttaactggcttggcaacggaaactaacgttgagccaacgttgcgtctttttgaatttcaacttttacaaatgctcggttacggcgtggattttctgcattgtgcggggtctggcgagccagtggatttctcaatgacataccgttatcgtgaggaaaaaggtttcgttgcgtctttagtgaaagataatctcacgttttacggcagagatttgttagcctttgaagccctcgatttttccgatgatgcggtacgtcaagcagcaaaacgcttcactcgtattgcgctgaaaccttatcttggcgataaaccgctaaaaagccgagagttattcactcaaaatattttacttttaaaataatggttcttctttataccccaaagcaaaaaacaaacaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatgggcatgctacggcaaaaaaatggcgagtaaaaagttctgaacgtttagaacctaaatgtgctcattttatgcgttgtggtggttgccaaggacagcatattcctattgaaatgcagaggaaagcgaaacaatccgcattgtttaagcggttaagtaaattacagtcagaaccgatttcatttcaacctatgatttgtggcgatgcttgggcgtatcgtcgtcgtgtgcgtttgagtttatggtttaatccaaacacaaaacaaatcgacatgggctttcgtcagaaaaataccaacgatttaatacccgttcaatcttgcgaagtagcagaacctgcaattaattatttactgcctaaattaaccgcacttttagaaaaattttccacaccgaaacagcttgggcatattgaattggtggctgccgataatggcgtcgcaatgttgttacgttacacgaaaaaccttgcggaaattgaccgcactttattgctcaaatttgctgaacaagaaaaattaatgctgtttttacaaagcgacaaaggcattgaacaaatctatggcgatgcgccttattatcaattttctgatggcataaaattacattttgatattcgtgattttattcaagtaaatagtgcattaaatgaacgtatgatcaatacagcgttggattggcttgaattgagccaacaagattgcgtgttagatttattttgcggcatgggaaattttacgcttcctcttgccaaacgcgtgaaaagtgcggtaggaattgaaggcgtttttgaaatggtacaaaaagcggcgcaaaatgccgcaagaaaccaaatcaaaaatattgaatttttccaagccgatcttgaccaatcctttgttgaacaaccttgggctaatcagtcgttcaataaaattttgcttgatcctccacgcagtggcgcagctttcgcgttaaatgctttgtgcgagctgaaagcagagaaaattttatatgtgtcttgtaatcctgcaacattagtgcgtgatgcggaaattttatgtgattttggctacaagattgaaaaaagtgcggtgatagatatgttccctcatacggggcatttggaatcgataaccttattcactacaaaataactcggttattcggtacaatatccacccaaaataaaagcgacaggaagttgcttgctcttcatcaacaagggggtattatggttgctgttcgtggttntcatttgttaaa

SEQ ID NO: 574 - DNA, 25523 bp, H. influenzae
  misc_feature (14470)..(14470): n is a, c, g, or t
  misc_feature (14490)..(14490): n is a, c, g, or t
  misc_feature (14501)..(14501): n is a, c, g, or t
  misc_feature (14528)..(14528): n is a, c, g, or t
ggaattcggctcggtaccccgaggtgcagcaacgatggactggatggaacaagaacaaaagcgtggtattaccattacctctgcggcaacaactgcattctggtctggtatgtcacaacaattcccacaacatcgtatcaatgttatcgatactccgggacacgtggactttactgttgaagtagaacgttctatgcgtgttcttgatggcgcagtaatggtttactgtgcggttggtggtgttcaaccacaatctgaaaccgtatggcgtcaagctaacaagtatgaagttccacgtattgcgttcgtaaataaaatggaccgtactggtgcgaacttcttacgtgttgttgaacaattaaaaacccgcttaggtgctaatgcggttccacttcaacttccaattggtgcagaagaaaacttcactggtgtagttgatttgatcaaaatgaaagcgatcaactggaatgaagcagaccaaggtatgactttcacttatgaagaagtgcctgcaaatatgcaagcagactgtgaagaatggcgtcaaaatcttgttgaagcggcagctgaagcgtcagaagaattaatggaaaaatacttaggtggcgaagacttaactgaagaagaaattaagtcagcattacgtcagcgcgtattagcaaatgaaattattttggtaacctgtggttctgcgttcaaaaacaaaggtgttcaagcaatgcttgacgcagttgttgaatacttaccagcaccaactgatatccctgcaattaaaggtatcaacccagatgaaactgaaggtgagcgtcatgcaagtgatgaagaaccattctcttcattagcatttaaaattgcaactgacccatttgtaggtaacttaacattcttccgtgtatattctggtgttattaattctggagatacagtattgaattctgtacgtcaaaaacgtgaacgttttggtcgtatcgtacagatgcacgctaataaacgtgaagaaattaaagaagttcgtgcaggtgatatcgcagcagctatcggcttaaaagatgtaactactggtgatacattatgtgcaattgaagcaccaatcatccttgagcgtatggaattcccagagccagtaatctctgttgcggtagaaccaaaaactaaagctgaccaagaaaaaatgggcttagcattaggtcgtttagcacaagaagacccttcattccgtgttcacactgatgaagaatctggcgaaaccattatttctggtatgggtgagttgcacttagatatcattgttgatcgtatgaaacgtgagttcaaagtggaagctaatattggtaaaccacaagtatcataccgtgaaactatccgtactcgtgttaatgatgtcgaaggtaaacatgctaaacaatctggtggtcgcggtcaatatggtcatgttgttatcgacttatacccattagatccagaaggccctggttatgaatttgtaaacgaaatcaaaggtggtgtaattcctggtgaatacattccagccgttgataaaggtattcaagaacaacttaaatctggtccattagctggttacccagtagttgatcttggtgtacgtttacacttcggttcataccatgatgtggattcatctgagttagcatttaaacttgctgcgtctttagcatttaaagcagcattctcaaaagcaaacccagtattacttgagccaattatgaaagttgaagttgaaactccacctgaatatgttggtgatgtaattggtgatttaagccgtcgtcgtgctatggttaacggtcaagaagcgaacgagtttgttgttaagatcgatgctgaagttccactttctgagatgttcggttatgcaacagatttacgttcacaaactcaaggtcgtgcatcatactcaatggaaccgttaaaatatgctgaagctccaacaagtgtggcagctgcagtaattgaagcgcgtaaaaaataatttttgtaaaccagcggtgtaaaatatgattgttttataccgcacttcttaggaaacattagcaatgtctaaagaaaaatttgaacgtacaaaaccgcacgtaaacgtgggtacaatcggccacgttgaccacggtaaaacaactttaacagcagcaatcacaaccgtattagcaaaacactacggtggtgcagcgcgtgcatttgaccaaattgataacgcgccagaagaaaaagcgcgtggtattaccatcaacacttcacacgttgaatacgatacaccgactcgccactacgcacacgtagactgtccgggacacgccgactatgttaaaaatatgattactggtgcggctcaaatggatggtgctattttagtagtagcagcaacagatggtcctatgccacaaactcgtgaacacatcttattaggtcgccaagtaggtgttccatacatcatcgtattcttaaacaaatgcgacatggtagatgacgaagagttattagaattagtagaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggggataacatcaagatgacagtaagcttaatccacccaatcgcgatggatcaaggcttacgtttcgcaatccgtgaaggtggccgtacagtaggtgcaggcgttgttgcgaaaatcatcaaataatagatgaactcttgaatgtcttaaagataaaagacagaagaagtaaaaagaaaagtgcggagaaaattctccgcatttttttattctatatttgataattcgtttaaatatttattaagttaatagattttagataataagtcatttatttgattcctagaacaataaatacattgctccttataaatgacacttctataatttttaattaattggcattaatcaaataaactactatgttatgtccactcaaatttcacttacgctattttttccataagaaattacgtcaaacatacagaatttcccacaaaagtttagaatttatctgcctaatcataggcatggcttgcctgacttggtttacgaaaaaatatactccatatgttggaggaagtggtattccacaagtgattgcatcaattaatcttcctcatagtagctataaaaccaaattagttgaattcagccaaactatttggaaaattcctcttacctttttggctatgcttatcggtgtatcagttgggcgtattagctactggttttattcttgtcgcgattcaaggaaacagcccttattttccacgttatcaaggggcaacatcggtttcttgtctctatctttggcttgcaatttgtggggtgggttatggcattctaggtggcattttggacgattattagcaaaggtatcgcaggattatcacctgaaaaaggcgtggctgggttcgccaacatcctatttatattgctttattattgggtttagtgcttgccgcactgttggagtggaaatgacaggcgcgcaactcgttctcatttggctcttgatttccagcattattgcatccataatctcgcgccaatttagtcctaaaccattttaccactttgctgcaggccggtttcgccagcaaatgcaagctcgtcaagccgaagaattacgcagcaaaaccaaacaagagaaataaaaatgcctcaaaatctaccgcacttttaccgcggccgtttttctgttgcgccaatgttagattggacaacacgccattgtcgttattttcatcgccaattttcaaagcacgcattactttacaccgaaatggtcactgcgcctgcgattatccatgccaaatacgatcacttggattttgatttacaagaaaatcccgttgcgttacagctgggaggaagtgatcctgaacaactcaaatattgtgcaaaacttgctgaggaacgaggttatcacgaaattaatcttaatgtaggatgcccttctgatcgcgtacaaaatggaatgtttggcgcctgcttaatggcgaaagcagatttggtggccgactgtgtagaacaaatgcaaagtgcggtcaaaattccagtcacagtgaaaacacgtattggtattgatgaattagacagctatgaatttttatgtgattttattgagaaggttcaaggaaaaggttgccaagagtttattatccatgcacgaaaagcttggctttcagggttaagtcccaaagaaaatcgagaaattccaccattagattatgctcgagtgtatcaactaaaacgtgattttccacatctaactatcgcaattaatggcggcataaaaaccattgaagaaatgaaacaacatttgcaatatgtggacggcgtgatggttgggcgagaggcctatcaaaatccaagtttacttgggcaaattgaccaagccttatttgatcctaacgctgcaattgttaccgctcatgaagcggtacagtcaatgcttccttatattgaacaacaacttaaccaaggaatacaccttaatcatatcgtccgccatatgctaggcgcattccaaaattgcaaaggtgcccgtcaatggcgacgctatttaagtgaaaatgcgtttaaacaaggtgcgggagttgaagtaattgaaaccgccttaagctttgtagaacactaatcacaaaataagccgcaaaagtgcggcttatttttcagctgtttttcttacgcaatacgcatttgaaaaatcaccaattcagcttggcaacagaaagtgaaatctgcctttaataaatagccatcatccagttttgtaatttcagattgaatttcacaaggttcactttctacatcacgcgctttctgagtaaaaaatgcgagtgcttcttgcgcttgttcttcactgtcataaatatattcaataacctgactacaatcacgattatcgaaaagtgatttcatatcaaatgtgttacaacctacacattcaatcggtttttcagtttgaattgccataatattatcccttttattcagattattttgcagcaacaaaacctacagcttcatacactttcgccaaggtttcttgtgcttttgcacgagctttttccgcaccttgtcgtaagatattatctaataaagtttcatcattgcgatattgatggaaacgttcttgtaaaccagcaagtaaagttgagacttcatccgctactgcagtttttaaatgtccgtacattttaccttcaaattctttttcaagatcagcaattggcttatccgtaaccgcagaaagaatatctaaaagattagatacccccgctttattttgcacatcataacgaacaacaggcggctcatctgaatccgttacggcacgtttaattttcttcgccacagattttggatcttctaaaagtgtcactacattgttgcggttatcatctgattttgacattttcttttcgggatcttgcaatgacataatacgcgcgcctgcttttccaatgaaaatttcaggaatagtgaaaatattgccataaagcgcattaaagcggtttgcaatatcacgcgtaatttctaagtgttgtttttggtcatcgccaacaggcacgctttttgcttgataaagtaaaatatccgccgccattaacacagggtaatcaaacaaacccacgttaatattttctgcataacgcgctgatttatctttaaattgagtcattcggctcatttcaccgaaataggtgtaacagtttaacacccagcttaattgcgtgtgttctggaacgtgagattgaacaaaaatagtacttttatttggatcaattccgcacgctaaataaagtgcaagcacatcaagcgttgctttacgaagggcaacaggatcttgacgaacagtgatcgcatgtaaatcaactacgcaaaaaatacattcataatcttcttgcattttcacccagttgcgcaacgcacccaaataatttccgatagttaattcaccagaaggctgcacgccactaaaaacaattggttttgccataatcaatccttaataccttaaaactgttcacacatcatatcagaaactctaggcttttttaatgttcgagttcaaaagctaggttaaaaatgctatatttaacggaaacgttttcctaatatttactaatgaaaaactaccacgatattgttcttgcccttgctggcgtgtgccaatcagcaaaattggttcatcaacttgcaacagaaagtcgagcagattcagatacatttttaaccgcacttaatagccttttcattacccaaccacaacgaattgaagatgtttttggtggcgaagttcgtcatttaaaattaggtctagaaaccttaattcaccagctcaacgcgcaaggcgatcaaaatttaactcgctattggctaagccttttagcattagaaggaaaattatcgaaaaactccgatgccaaacaaacattgggcaatcgaatttctcgcctaaaagaacaagaaattcattacgctcgcgatagtgaaacaatgttatctattatggcaaatatttacagcgatattattagcccattgggtaaaaaaattcacatcctaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttattaatacaattctggagtaaacatttatgcaactctctacactgaccgcactttcccctcttgatggtcgttatcaagataaagtaacgccattacgtgctatttttagcgaattcgggttaatgaaattccgtgtagttgtggaagttcgttggttacaaaaattagcttcaacggcagatattaccgaagtaccgccattttctacgcaagcaaatgcttttttagatggaattgtggctaattttaatgaggccgatgctgcgcgtattaaagaaattgaacgcacactaatcacgatgtgaaagccgttgagtattttctgaaagagaaaattcaaaacgaagtggaactagtgaacgtttctgaatttattcacttcgcttgcacctcagaagacattaacaatctctctcacgcattaatgttaagcaccgctcgtgacgaagtgattttaccagaatggcaaaaactgattgatgaaatcactcgtcttgcagaagaatataaaacgattccattactttctcgcacacatggccagccagcttcaccaagcaccgtgggcaaagaaatggcgaatgtcgtttatcgcctaaaacgtcaatttaaacaactccaaaatgcggagatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcgctgaattttttgatgctgtagttcgctttaataccattatcattgattttgatcgtgatttatggggatacattgcattaaatcactttaaacaacgaactatagcaggcgaaattggttcttctaccatgccacataaagtcaatccaattgattttgaaaactcagagggcaatctaggattagccaatgcagtgatgacccatttaggtcaaaaattaccaatttctcgctggcagcgtgacttaacagattcaaccgtattacgtaatttaggcgtaggattaggttattgtttgatcgcttatgcttcaacacgcaaaggcatgagtaaacttgaagtaaatcaaccgcacttattagaagaactcaatcaaaactgggaagttttggctgaaccaattcaaaccgtaatgcgtcgctacggaatagaaaaaccttacgaaaaattaaaagaattaacgcgaggtaaacgagtgacagaacaggctatgcgtgaatttattgataagttggatattccacaagaagaaaaattacgtttacaaaaattaacacccgctacttatattggggctgcagtggaattagtagagaagctatcataggaatttggctctttttccaacaatattctttacaagaacatagcttttctctataatcctgcgcctgtgttagtcaatctaacaaatttctggttggtgcttgacctattcaagccccatccaagaccgtaggggagtaatcttaattatcctacgtagatggtgaacagaataagaatttttcttgcttctgggcgccgaagtcatcctaatcttaggattaggtaaattaattccgagtaatcggagtgtattcaggagctaaaagccaatggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggcgttacaatgcgtgtagttcgtaatactttattacgtcgcgcagttgaaggcacagattacgaatgcttaaaagatacgtttgtaggtccaacacttatcgcgttctctaacgaacacccgggcgaagctgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagcttaatcattaagcgtttcttacttcatctaactttatttattttaggaattgattgttatgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggcgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaataattctattttaaccactttaaaattcaaaaaaccgatgggaaaccatcggttttttcttatataaaagtttgttatagcttttacttaaaaacttaccatttgctatctttctaagatagaatattacccgtttttattgatgaataaagagaaaatttatgacaaaaaaagcattaagtgcggtaattttagcagctggaaaaggaacgcgcatgtattccgatttacccaaagtgctacatacaatcgctggtaaaccaatggtaaaacacgtgattgatattgcccatcaattaggctcagaaaatattcatttaatctatggtcacggtggggacttaatgcgtacccatcttgcaaatgaacaagtaaactgggtattacaaacagaacaacttggcacagcacatgcagttcaacaagcagctcctttttttaaggataacgaaaacattgttgtactttacggcgatgcaccattaattactaaagaaacattagaaaaattaattgaagcgaaaccagaaaatggcattgcattgcttaccgtaaatttagataacccaacaggctatggacgaattatccgtgaaaatgggaatgttgtagccattgtagaacaaaaagatgcaaatgcagagcaactaaatattaaagaagtcaatactggcgttatggtatctgatggtgcaagtttcaaaaaatggctagctcgtgtaggtaataataatgctcaaggcgaatattacttaacggatcttattgctctcgcaaaccaagataattgccaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgattgcgtaaaaattggcgcaggttgcgtattgaaaaatgttgttattggcaatgatgtagaaataaaaccctattcagtgctagaggattctatagtaggagaaaaagccgcaattggcccattttctcgtttacgcccaggtgcagaactcgcagctgaaacgcatgtcggtaactttgtagaaattaaaaaatctaccgttggtaaaggttctaaagtaaatcatctaacttatgttggcgattcagaaatcggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaatagaataaaaaatcctacgtattatcgtaggatttttttataaaccaattttacaaatcgtaattaaaatcacataaaaaatgaccgcacttaatgttaataatttatttgctagtttaggtttatgttgatgaagacggtatagcattctagctgtaacagctagaataaagggataaacccaaaaaagcgttgaaaataaattgatttgccagcttgatagatagggatttttactaaatgctgtagaaattaataatgccattggacacaataatataggcgaacaaaaggcagcaagaccccaagcaaatggactaaatttagttggtaaagattgttttttcatattttaaataattaaaaataaatagatacaagaaagaaatataataaatatgttgaatagtaaagaatattttaatgaaagtaacaatgtagaaatggcgcacccgaaaggattcgaacctttgaccgctcggttcgtagccgagtactctatccagctgagctacgggtgcgtagatgatgctttaattattcataaccactttaataagatagagccgttttaaaaatggcgcacccgagaggattcgaacctctgaccgctcggttcgtagccgagtactctatccagctgagctacgggtgcagaataaataaaacaaacaatggcggtgagagagggattcgaaccctcgatggagcttttaaccccatactcccttagcaggggagcgccttcagcctgctcggccatctcaccacaatcagtgtgagcggtataatacgttttttagaaaatatgtcaaaccattttttgaaaaacacctttgtttgaatattttatctacacattaaatctatttttgagtgaaaagctactaattatttaaaaattctaatattttaaagattgtttcctttcttaatttgtcctgttcaaatagaatttcgtgtttagcattgaatacaacttcacatctagcattcggaaaaagtacggttaatttttcaagattgttgttatctactattttttctttttcggcttgtaaaattaggattggaatttcaatcttaggaataactttcggcaagcgtttaattgcgttcaaacacaaatgtacccaacggaatgttggcccgccaagattaattgctggatttttacgatttacacgattcatccatttcattctggttttacagaaagttaattcattgtattccaagtgggcttgttgataaggccctttaccaaaaacataacgctcgccttgtcctaaaatattcattagggcaataatcagttcatctctaatgggatgttttaaaagaataccgtaaaaaggcgaagaaagtaccgctttattaatgtgatgatcataatttgccaaataataggttgcaatcaatgcgcccatcgaatgagcaagcaaatgctgcgttgaatagctgaaaagtgcggttactttttcgatgattttcgccatatcatcaacatagaaacgaaattcgtctaaatgccctttttgaggaataatacgctgtgaatagccttgaccgcgatgatcaaatagcaatacatcataaccttgatgataaaaatcataagcgagctctgaccatttcaacatattttctgcacgaccatttactaaaatcatcaattttctgaccgcactttcaggttgaatcaaatgacgataagctaattttatatttcgtttaccagaaagatattgggtaggaaattgctcaaaaaaaggcaataattctgcaagagcaaattgatgaaaataaggttctctgatcataattttttaatgaaaagggcgtagtaaatacgccctttgtagtgaaagtaaacttacgccaccaattgttttaagatacggcgaactggctctgccgcaccccataataattggtcacccacggtaaaagctgccaaatattcaggccccatagccaatttacgtaaacgccccactggcacgcttaatgtacctgttactttcgctggcgttaattcacgtaatgtggtttctttgtcatttggaattacttttacccattcattatgtgatgcaataatttgttcgatttcttctaatggtaagtcttttttcaatttaatggtaaacgcttggctgtggcaacgtaatgcaccgatacgcacacataaaccatcaacaggaattggattgtcgcttaaacctaaaattttgttggtttctgcataacctttccattcttctttagtttgccctgtttcaggaagaagtttgtcaatccaagggattaagctaccgcccaatgccgcgccaaagttatctgttgggaagttatcagcacgcatttttgccgtcactttacgttcaatatctaaaatagatgaagcagggtcttttaattcacttgaaactgcttgttctaataaacccatttgtgaaagtaattcacgcatattttttgcgccagcacctgaagccgcttggtaagttgccacagaaatccattccaccaaatctttttcaaatagaccgccgatagccataagcattaagcttacagtacagttaccgcccacgaaagttttaatgccttttttcaaaccttcagaaatcacgtgttggtttactggatcaagcacaataattgcatcatctttcatacgcaacgcagaagcggcatcaacccaataaccatcccagcctgttgcttttaattttggatagacttcattggtgtaatcgccaccttggcaagtcacgataatgtctaattttttaagttcttcaatatcgaatgcacttttcaggtcgcctgcatccttgccaccaaaaacaggtgctttttgacctgcttgtgaagttgtaaaaaatacgggattaagatttgcaaaatcattttcctgcgacatacgatccattaatacggaacccaccatcccgcgccagccgataaagcctacatttttcattgttgtttccttagtttgttgtgcttgaatagcattattaattacaagatagcgttagcanaatcaagtatttttaatganaattgatcttntgtgaaagaaattaaataaaaaataanaaagtgtggttaatttaaaagaaaatttaatttaatcactcttttctaagttatctacttcaacacttattacgccatcttctgctttaagtaaagcatacgcatctttcaacattgtggaatcaatggaaaagcaacgaatttgtaaccgcacttctccactactttgatctttgacttgtatatgttcaatacgatactgattatttactaacaattgggtaactttccctatgctttccgcatcattgacaagaatattgaatttcgtccgacgacgttgtgatttacgatgaacccaacgttgaaccaacggacttaatcgaatagacaccaaaatcatcacagtggcgatgaccgcatcaaacacgaaacccgccccagcagcaataccgatccccgcagaagcccaaataatcgccgcagtggttaaacctgaaatcgcatcatttttcttatgcaaaatcacaccagcacctaaaaaaccgatgccactaatcacttgagccgcaagacgcattggatctgtacgaatattttctgaaacttgtgcataatgctctgcggcttgaattgaaacaatggttagcacacaagtggtaacggcaataatggcacaagtttttacacccacaggtttacgtttaagttcacgttctaagccaataacactgccaagcaccatcgctaatagcattttgctaaaaataattaagtgatcaggattgaaaagtgcggttaaaagtaaagatgaattttccatagtgataaaaataagtcagacatactcgtctattctacatcacttagcttaaaatctttacccttccaagcctttaatttatcgcctttcttgcgaaaattgagtaaaatcttgcgtttgaaattttatagagcgaaaacggttatttttatgcaaaattcaaccccaagcattggctttgtaagccttggttgcccaaaaaacttggcatttgggttcgcttacattatgtgtatccctatccccatgtggatgatttaattccattaatggctgacggtacgctattgccgtatttagacattccattacaacacgccagccctaaaatcttaaaagcaatgaaaagaccaggcagtattgaccgcactttagaacgcattaaacaatggcgtgaaatttgcccagatttaacattgcgctcaacctttattgttggtttccctggcgaaacggaagaagatttccaattattactcgatttcttaaaagaagcccaacttgatcgcgtaggctgtttcaaattcagccctgttgaaggtgcacccgcaacagatatggctgaccaagtaccagaagatgtaaaagaagaacgtttccatcgcttcatgcaattacaacaagaaatttctgcaaaccgtttaaaacaaaaaattggtaaaacccttgatgtattagtggatgaaattgacgaagatggtattattggtcgttcaaaagccgatgcccctgaagtagatgggttagtttacgtagataatttaagcggaatcaatgtcaaagtcggtgacgtgattaaagtaaccatcacaaattctgatgaatatgatttgtggggcagttgttaagtaacaacaatctcaacgaaataaacaaaaaatccatcttcgtattgaagatggatttttttattagccgaacactttttccaagtgtgcttggtagtctgctaagtattgttctacttgcggacttttaaccacatcgttacataagaatgtcggcaggcgagtcaagccgatgaactcgttgagtttgtggaaatgcatatacaaaacatccacgcctttgccttcaaagaaatcgccttcgcgagtaaaggcttcaatcggtgcattccaagtcagtgaaagcatgtgttttttgccttgcaacaagccgcctgtgccatagccctcggttggattaacgctgtgtctgccatcactgtgatataacttgccgtgcccactggttaatacttcgtctatgtattttttcactgtccaaggctcatgcatccaccagctcggcatttgccaaatcacggcatccatccacaagaatttttcgatttcagcttcaacgtcataaccagcatcaattacagtttctttgacattgtgtccaagtgcggtcaaaactctttcgttttttgtgaagcgaatggttcaactcgccgtgagaatgaccaaacgccttaccgccgtctaataataaaatattcatctttttgctcttaaataattataaaaaatggggttgccattatgcctttttacgttaatttttaaaagtctatttgtctgccacgttatttctagactataaggaagattacagcccgtagggaataaaccctagttaaacgcgtgggcttaagcccaccctacattggctacattagctggaattgaaagtgcggtaaaaaattggtggaaatcaaacgaaaaatgaccgcacttttaaaataaaaaatcggcagagaatttccctgccgatttttattaacttttcaaaatcgccctcaatctatcaagttggttttgtgttttttcttgtttttgctcggtggtgagttttggtttatcgcgttcccatagcacatcgtcattaggtaattcagctaaaaatcggctgggttctgggcgaactaattctccatattgacgacgctcacgacataaagaaaaagtaagttctttttgtgctcttgtgatacccacataagccaagcggcgttcttcttccacgttgtcttcatcaatgctggtttggtggggtaaaatgccctcctccataccaatcaaataaacataaggaaattccaatcctttagatgcgtgtaatgtcatcagttgaacttgatcgctgtcgtcatcgtcttcgcctcgctccaacatatcgcgtaatgtcaggcgggttaccacttgattaaggttcatcggctcattggtttcatcgccttttaacatatccgcaacccagtcaaataacgtggcgacattcttactttgcatttctgctgctttagggtttgttgcgtattcgtacaaatattcttcataatgaatcgcagataacatagaacgtaccgcacgttctggttcagaacgttgaatttcatcattaagttctacaatccaacggccaaatttttgcaatgaatcataggcttttggtgtaatgcgttgaataagttcaaactcaaaaatagcatcaaacaaactgatgtgtttttcttgagccaactctccaagtttttgtaaggttgcggtgccaatttcacgcttcggtgtattcacaatacgcaggaatgctccgtcatcatcttgatttaccaccaagcgcaaatacgccatcatatctttgatttctgcacgagagaaaaaagaagtaccgcccgaaattttgtaaggaatacggttttgcatcagtactttttcgagtaatcgggattgatgattgcctcgatacaaaatcgcataatctttatatttggttttacggctaaaacgatgggcgatcaactcggcgacaatccgctctgcttcgtgttcttcattttttgcttcgatgacaagcaatttttcccctgtaccaatggttgaaaaaagtttcttatcaaacacgtgctcattgttatcaatcaaaatattggcacaatgcaaaatacgctgggttgaacggtaattttgctctagcttaatcacgttcaaacgaggaaaatcatcgcgtaaacgcaccatattttctggtcgtgcgccacgccacgaataaatagattggtcatcatcgcccaccacagtgaaacaagcacgctcacccactaaaagtttaatcagttcatattgactggtgttggtgtcttgatattcatccaccaacaaataacgaatttttgcctgccattttgaccgcacttcttcattttgcttgaacaataatgtcggcagcataatcaaatcatcaaaatcgagagcgttgtaagctcgaatttgtgtggcgtaacgctcataacattttgcgaaagtttgatatttagcatcacgtgccaaggcaaatgcctgttttggcgaaatcaaatcgttcttccagttagaaatcactgaaattaactcgcgcaataaatccttatcttcttttaacacatcagcggttagctcttttaacaacgcaaattgatcgtgctcatcaaacaaggtcatatttgatttaaagcccaacgctttatattcacgcttaataatgtcaaaaccgagcgtatgaaaagtggaaacaagcaatcctttggattgttctttgccaatggaatgtgccacacgctctttcatctcgcgtgcggctttattcgtaaaagtgacggcggcaatttgtttcggagaatacccgcacttttcaattaaatgggcgattttattaatgattacgcgagttttgcctgaaccagcgccagcaagcacaaggcaagggcctgtcacatattcaacggcttgttgttgttgaggattgagtttcataagaattattgagcccacgcatagggcagtaatacagtgtctaataaaaatgagagaggcaaatctaagattggcaatccccattgttgcgccatttcaagatcataagcaacccctgcataggcggtatatttttctgttggatcgataagtttgaccacggaaccacaaccagataaaacgataagtgcggttaaaaaaataaaggtttttatcatcgtgcttttaacgcattgaatacaggctcaggaactagctcagcgacatctccgccatgtaaataaatttcacgcacaatggtagaagaaacaaacgcccatttttctgctggtgggaaaaacagactatctacgccttttgtgagtaaacgattaagggcggccaattgcagttcatattcaaaatctgttgttgtgcgtacgccgcgaataatggcagaaatattgtgctgtttaatcacatttgccaacaaatcagaaaagccaaacacctccacattggataaatgtgcaacagattgacgaacaagctccacgcgttcctccaacgaaaatagtggctttttacttgggctattcgccaccgccactaaaacacgaggaaaaattaccgcacttctttcaataatgtctaaatgaccgttcgtaatcggatcaaaagtaccaggataaatcacgctcgtcatacattgcgctccaaataaggttttaataaatctaacaaacgctgtaatgcccctcggttttccatcagcacttcatagccagcattgcctaaacgttcgcgggcttcttttgagtttaataaggcttctacggcgcgttctaaggaatctgcggttgaattaacttccaacacaccttgcacttccaccaacattctaaatatctcgggaaaattaaaagtatgcttgccagtaattacaggcattttaaacgcaagaggttccagtggattatgccccccgtgtttcacaaggcttccacccacaaaagcaatatcggaaatgccatacatcaacatcagttcgcccatactatcgcccaaaatcacttgggtattttcatttggtaattcatttgtggaacgacgaataaattgaaatttttcctttttaagtaaatcagccaccacattaaaacgctctggatggcgcggaacgagcaataacaataaattcgggtattttgctaacaaagcgcggtgagattttaaaatgatttcatcttctccattatgcgtgctggcagcaatccatattgggcgatcttgtttccaaagcgttcgcaatgaatcaattttacgtaatagttcatcattcgtattgagatcatatttaatattgcccgtgatattcaatttttcctttggatagcccaaagtggcatagcgttttccactaatgttatcctgcgctgcaatcaagctaatttgcgaccacattgtttgtaagtgcgcttttatttttccgtaacgatgtgcagaacgcgcagataaacgtgcattagcgataacaaatggaatattgcgtaaaaataattgatgaataagattaggccaaagttctgtttccatcacgatacataatttaggttgtacaaaattaataaaacgatggatcgaaaaaggtaaatcaagggggagataataatgaaaaacgctgtctccaaaagtggctttgacgcgctctgaacctgttggcgtaaaagtcgtaaaagtaatggataaatgcggataatcttgttgcaattgacgaaccagcggtatcgcagcaatcacttcccctacggaggctgcgtggataaagattccttgtggtggtggacaaggcacattgccataaaaaccataacgttcagccaaacgctgacgataacgtggagatttaacactgagcaagccaataaaacacaatatcaacggctggcaaattaaaagcaagctggtataaaaaaaacgccacataaatgaaattcggttatacttgaaaaaatttcggctagtatagcaaaaaaaggattgaaaatatgcctacaattagcgttgcgatgattgtaaaaaatgaagcacaagacctcgccaattgcttagacaccgtaaaagattgggtggatgagattatcattctagattctggtagcacagataacactaaagaaattgcgctcagttatggggctaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtagttcgtctctatcgcacaaactatgcgcaatataatgattcacttgtacatgaaaaagtggaatttccagctggcacaaaagtagaaaaattgacaggggatttagagcatttcacttataaaagtattcatcattatctagtgaaatccgcaggttatgccaaagcctgggcagaccaacgccaagctaaaggaaaaaaagccacactttggcaaggaatttcgcacgcgcttggttgttttgtgaagatgtatttgttaaaagcgggttttttagatggcaaacaaggatttttattagcggtgttatcagcgcattcaacctttgtaaaatacgccgatttatgggagcgagatcagcataaacactagcgagttttgcaaggacaatcatttaaatgatcgtccaccagccccatagattgcataaacgcatagcacgtggtttcgccaacaaagacgaaaccacgtttttttaaggcttgagaaagtgctttcgatacttctgttttagttggcacagatcgcaaatcaggcacatcattgacaatcggtttatgattcacaaatgaccaaataaaattactgaaattttcaccgcacttttccattgccaaataagctttcgcatttttgacaatggcttctaacttggctcgatggcgaattaatcctgaattttgcatgcaagcatcaatatcaagtgcggtcatttttgcgatttttttcggatcaaattgatgaaaggctgcacggtaagattcacgttttttcaaaaccgtaatccacgaaagtcccgcttgctgcccttccaaacaaattttttcaaatagcttttggctgtcgaattcaggctttccccattccttgtcatgataatcaatataaataggttgttcgccaacccaagggcatctggttatttgttgcatattaaaacttgacaaaataaaacattttgatatattccgagccaagtggatcgagggtgcttggtcggcgttatagcttcagtgagtttcattgaggcttttcgctttttagggctaagggaaatgtttcagtcctttttgatcaaaattttcccccagtatttttcttccaccttcacaataaaatttctttttaaggatctcaaaggctcgatttggttgattactatctaaaatatgtctcccgataggtcttgccactaaatccgcaacttgcaaccccacagaattaatttgttttggcacaatctttacttgaaaaggcaaggactttttaaatttattttgtccatcacaaatacgtaaaaattccagctctaactctctatcctcattacgtccacggctttccacggcaacaaaagtgattttatcttcttgatgcttttcacaaacaaattcgtatagggtttctaaacaatgtttgagtgaaaaatgataagggtgtgttgtttcattttgtggcgtttttcgcttatcaatcacacaggcagcaagaataaaattagtattttcaataatagatgaaatacgttccataaaaccttcacgctgttcacgagaagtgaaaatattaaaatcgcctttttctttgcggatttcatgctcatgcaatatcaccatatcatgaccaaaataatcaaattttatcttctgtatctgtggaacaatattatttcgataatggtctttataaaaaatacagaatgcaagtacaaacacaggatagtttttatcaattgactgtaaactgtgatctccactttcatcgacatacaccataaaatcgctgtatttattttccattgccaattaccttattttaattgctcataaaccgcgacaaaatctggcattacgcctcgccataaatggaaagaatgtgctgcttgcgcgactaacattccaaagccatcgctaacattggttaaacctaaacttttgcataatgcgataaatggcgtgtctgtgcctttcgcatattgcatatcgtaaaaagctaagcctaattttaaaatttcaacatcaactggagcagttccaccacttaatccagcggaagttgcattaatcactacatcataggtttgtagtggaatcgaatccatagagacagcttgaatattgccgtaaggctgaaatctttcagctaattctttggttttcgaaaaagtgcggttagcaagcacaatgttttgttgagcttgtaaaagtggcaataatacgccttttgttgctccgcctgcccccaagattaatacgtgttgatttggacgaagccaatttaaacgctccaaatccgtcactaaaccaatcccatcggtgttatccgcataaagttttccatcatcgagtttttttagcgtattacaggcttccgccaattttgctcgttggctatattcgtctgccagttgataggcacgttctttaaaaggcgaagtaatattgcaacctttcgcaccctcctcaaaaaatgccaaaagctgttgttcaaaagaatcaagattgcctaattttgcgatgtattccatagtttgatgggtttgcgcggctaactgacgttgaattaatggcgatttactttgcgtaatcggattgccccatacagcataaagatccataaattatccctgtctaaaaagttgatttgtgcgtaagtctcgaatttcagatggattgcgtgcatctcccacaatttcatccaatacaggaaaatctgcaccgaattgtaaccgcacttcatcggcggtacggcaaggtggctctcctgttaggtttgcgctagtcgaagttaatgcaaaacccgtgagttcacataaggctttcacagatgggtgatcgcacaaacgtattgcaatgctatcaaattttcctgtgagaaaatgcgaggtggtggatttagctggcacaatccaagtcgttggacgttcatatttaccttgcagatgagaaagctgttcatcgttaatctgctcaaaatcgacaaaaggacggaaaaaatccaagctaggagcgactaaaatcagccctttttccactggacgttgctttaaatcgagtaatttttttaccgcactttcactttgcggattacagcccaaaccaaacacagcttcagtgggataagcaaccacttgattttgtcgaagggcttcggcgatttgttctctattcatttcattcttttacttttattgctcaaaaatatgacggcaagttttatttgcacactggaaaatttgtttttccccattttcgctttttaacaaagaaagaggaaaatggcacgttgggcaaggcacggaataaggcttggcaggcaaagaaaatttacatttagggaaattatcacagccgtaaaaaatctttccttggcgaccacgacgagaaatcaaatgccccgttttacattcaggacaagtaattttttcctcagattcagattcttcccgcaccacaaaatcgcattcaggataatggctacaaccaataaacatcccaaaactgccttgtttcaactgcaataaattaccgcacttcgggcaaatttcatcaaatgtttttaatactttatgctccgatcgttgcaaaggacgcaaataatcacattcaggataagcagagcaacctaaaaacagcccttttttgccttgtttaatttgcaaaagcgcaccacattgagggcaatattcctgttgtttgctatgatgaaaaaggctttgattcataatctatccttacgcttgaagcatttcttccaattcttcctgtgcagtcatccattccgtttctacatcatctaatgctttcttcacatccacttgttgagccaaaagtgcggtcaatttttctttattttccgcattaataaattcagtatctgccagttgattttctatgttcgcaagctcagaagaaaatttattcattttttcttctaattgcgggattttttacgtatggggggcaagttgggtgggcgtactctgctcacggcgggttttggttcttacgattttgaccgaatttcattacga

SEQ ID NO: 575 - DNA, 28871 bp, H. influenzae
  misc_feature (82)..(82): n is a, c, g, or t
  misc_feature (5660)..(5660): n is a, c, g, or t
  misc_feature (28833)..(28833): n is a, c, g, or t
cctttggttttggtttaggtacaagctggcaatcccgcttaattcagcaagctattttaaaaaatcggattcgtggactcgngaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccataaaacgaagaagatttctaccgcactttagatgaacgtttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctttgatttaactccctagcaaaagcacgcattttttaatgcgtgctttttgttaccaactttggcattccccaaaatctccgctaaaataaccgcactttttcttatcttctaggaaagcaatatgtcagatattctcaataacctcattcatcttcttaaacttgaaaaaattgatgatttaatctttcgtggtgaaagccaagatttaggttttcgtcaagtatttggcgggcaagtagtggcacaggcgttatctgcagcaatgcaggtggcgccagaagatcgcattttacattcttgtcatgcctattttcttgccccaggagacagccaatatccgattatttacgatgtggaaaccttgcgtgaagggcgtaatttttctgcattacgcgtaaaagccattcaacataaaaataccatttgtcatgtaaccacttctttccaagtgctggaaaaaggttttgaacatcaaaattcaatgccaaatgttggcgcgcctgaagactttacagatgaaaatgtgatgctacaaaaagtggctcaaaccttgccagaaccactcaatgaaaaatttgcggcagagcgtccatttgaggtacgtaccaaatatttgaataacccatttaacgggacaaaattgccagccgagcaatattcttggtttaaaaccaatggtgaaacgccgcttgatataaaaattcagcaatgtttattggcttatttttccgattttcactgtattttgaccgcacttcatccgcacgaaaaaggctttttacaaaaaggaatgaaagtggcaaccattgatcatagtatttggttccatcgtccgtttgatttaaatcactggcatttgcacgcaattgaaagcaataatgcttttggagggcgaggcttagctcgcgggcaaattttctcgcaaaatggtcaattaatcgcgacaacacaacaagaagttttgatccgttttaatgaataagagagaaaaatgaccgcacttatacacaattttggcaacagtgttgaaaccgagtcaaaccttgaaatcttatattaagaaatgatgaaaaaataaaaagactaagttctattaacattctgaacttagtctttttaatgaaattaatttaacgtttaaatttattgcttacgccaagttgttccattcggcccatcttctaatacgatgcccatagcgataagctcattacgcgcagcatcagcagtagcccaatctttagcagcgcgggcctcattgcgttgtttaatcagtgcttcaatttttgccacttcatcatcgtcagaacctgcttgtaagaatttttctggatcttgttgaagtaatcctaaaatcgcccccaattcacgcaaacgcgcggcaagtccattggctttctcagcatcctctgtttttaacttgttaatttcacgcgccatttcgaataaaacagaaagtgcatttggcgtattaaaatcatcgtccattgcttcacggaaggtttccacaaaattttctccgccaaaaacaaccgcactttgatccgttccacgtaaagccgtgtataaacgttccaacgcaccttgcgctaaattcaagttttcttcgctgtaatttagctggctacgataatgtgccgttaataagaaataacgtacagcttctgcattgtaatggtttaatacatcacgaattgtgaagaaattgccgagagatttcgacattttttctttatccaccataatcatgccagaatggatccaataattcacatattggccaccatgcgcacagcaagattgtgcaatttcattttcgtggtgtgggaacattaaatcagagccaccaccgtgaatatcaaaatgttcgccaagctgtttgcagttcatagccgaacattcaatatgccagccaggacgacctgcaccccaaggggaagcccaacttggttcgttttctttcgacattttccaaagcacgaaatccattggatttttcttgatttcattgatttcaatacgtgcaccagcttgtaattgctcaagatcttgacgggataatttgccgtattctttgaagctttctacatcaaacatcacatcgccattatctgcaacataagcatgtccacgtttaatcaatttttccacaatttcaataatttcaggaatatgatgggttgcgcgaggctcaaaatcagggcgtaatacattaagtgcatcaaaatctttatacatttcctgcaccatacgatccactagctgatcgcaggtttctttgttttctaatgcacgtttgatgattttgtcatctacgtccgtaatattgcgcacataagttaaatcgtaacccaaagaacgtaaataacgggcaatcacatcaaaacacacaaaagtgcgtccatgaccgatatggcacaaatcataaacagtgacgccacaaacatacattcccactttattttcgtggataggtttaaagatttctttttctctcgttaaggtattgaaaatttttagcatttttaagctcgtaaaatgaaataaaaacaaaccgcacttttatagcacttttacctcgattgtggaataatacgacccttaattttttagagggaaaacaaaatggttacattacacacaaattttggcgacattaaaattaaattggattttgataaagctccagttacagcagaaaatttcttaaattactgcaaagaaggtttttataataacacaatttttcatcgtgttattgatggctttatgattcaaggtggcggtatggaaagcggtatgcatgaaaaagcaaccaaagcaccaatccaaaatgaagcgaacaatcgtttaagcaacaaacgtggaaccattgcaatggcacgcacgtcagatccacattcagcgaccgcacaatttttcattaacgtggcagacaatgatttcttaaattatcgttcaaaagaaatgtttggtcgagaagtcgttcaagaatggggctatgcggtatttggtgaagtggttgaagggatggatgttgttgataaaatcaaaaaagtgaaaacaggcaacaaaggctttcatcaagatgttcctactgaagatgtagtgattacattggtttctattgagtaacaaatgagcataaaacaacatcgccctaaagttggagaaattctagaatgtgattatggtcaattttcgcatacctgtcacgttgatggacatattccacctgaaatggttaaaaaacgtttagttgttgttttgaatgcgaaactgaacgggcttattttagttgcaccaatttcatctacaattaatttagatggtataaaaaatggctatcatattgaaatagattcagaattaataaaagcaacaagcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtagatagaatacagtatagacttccgagcgtaacgccttagagcgatcatcatcgaaagatgagtttttaaacgccattgagcgatgaatcccctgattagcgataatcaggggattttttatagaatttagataaagatatttatgcacttcttcgacactcacacgcatcttgattatctccaacaatttactggggaaccgttgtcacaacttattgataatgctaagcaagccgatgtgcaaaaaaatactggttgtggcggtgaaagaagctgatttttaaaacaatccaaaatatgaccgcactttttcctgataatttgtgctatgggcttgggctccatcctcttttattcaagaacacgccgaaaagatttgattctgttagaacaagccttaaaaaaatcgtgatgcaaattgcacggcagtggcagaaattggtttagaacgcgcaattcctgatttgctcaccgaatgaactttgggcaaagcaatgtcatttttttgaaagccaactttatttggcaaagcaatttaatttacccgtcaatattcacagtcgaaaaactcatgatcaaatttttacttttttaaaacgtattccattatctaaacttggcgtggtacacggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagtccagatatgcctgtatttggttttcaaggccaacctaatcgaccagacgcgtattgtggaaagtttangagccctttgcaccttaagaaatgaacctgctgaattgattaaaaaacttacatggaaaaatgcttgccagattttttcttgatccacgtcacattactgaaattattttgaattaaattgcagtcttcaatggcttaaaatccatggtcacatcgggcaattatgcctcttattatttagcgcttttgccttccgaaaatggcgaaactattgataactgggtgcttccacttggtactcaaggcttaacttttgaagctgatagctggaatagcttaggtatgcgtagcaatgtttcttgctttatgcgcatgaccgatatgccattagatcgtagctggcgtgtagcgtggaactctcccctaattacatgtatgccgtggcaactggagcaaagatgaaagcgtattattgcgcgggccttatacatcattagtggatttatttgaatcggcattacctgatattttaatgctcgaattttctacgccaagagcgggagaattaagttcgttattagaaagtgaaatattaagacaaaaatgtattttaggcttaggcgtcatcaatcctcgttctgatgaagtggaaactgtaacacaaattgttcagcgcgcagaaaaagccttaaattaccttccaccagagcaaatatcaaaatttcagacaaaaaaattgccccattaaggggcaatcttatcaacgctctaaagttacttatagctttaagcaacgattaaatatgttggttaatgaagttagccaattgagtttttggtaatgcaccaacttgagttgcaacaacttgaccatttttaatcaataataatgttgggatactacgaacaccaaattgtgctggcgttgcttggttgtcatccacattcattttcacaattttaactttacctgcaaattcaggtgcaagttcatctaacactggtgcaatcattttgcaaggaccacaccaaggtgcccaaaagtctaataaaacggggatatctgaattaactacaacactttcaaaatctgcgtcattaatgtgtaatacttcgctcattttgttttccttattttgtgaatggattccctatataagggctttttttaaacttacaagtgcggtgcagaataacaccgttttaaaaaatgtaaactaatcgttttaattgccaaaagctaagacggcaaaacaatattttcacacactttacccgatttcaatttataaacatttgataaagtcacatccgcaatattggttagtgcttcttcggttaaaaatgcttggtggcctgttagcaatacattatggcaagaagataaacggcggaaaatatcatcttgaatgacttcgttagacttatcttcaaagaacaaatctcgttcattctcatacacatccatacctaacgccccgattttacgctgttttaacgcatcaattgcagcctgagtatcaatcaaagagccacgactcgtattaacgatcatcacaccatctttcatttttgcaaaagcctcgcgatttaataaatgatagttttctggcgttgctgggcaatgaagcgtaatgacatgagatttagcataaagctcatctaattcaacatattgtccaccaagctcttccaccagtggatttttaaaaggatcgtacgccaaaatattcatgccaaaacctttcaaaattcgcatcactgcgatcccgatttttcctgttccgattacgccgactgtgcgtccgtacatattgaaaccaattaacccctcaagagagaaattcgcttctcgggtacgctgataagcacgatgaattcgacggttcagagtcatcatcaaaccgatggtatgttccgccaccgcttcaggcgaataagctggaacgcggacgacttggatgcctaattcttgagctgcttttaaatcaacattattgaaaccggcacagcgcaaagccacaattttcacaccaagtgcggctaatttttctaatacttttcggctaccattatcattcacgaaaatgcatactacttcgcaatgctctgccaaacgcacagtgctctcgttcagcataaaatcaaaaaattctaaatcgaaattatatttcgcattaatgagctcaatatattttctgtcataacttttagtgctatagattgcaattttcatggtttgctccaattattttaagtttgcaaaagcctgtaataagtccgctttaatatcttctacatcttcaataccgactgaaaaacgcaacaaggtattagtaatcccacgagctacacgctcgggttctggaatatccatatgagtttgagtggcaggataagtaataaaactttctgtgccgcctagactttctgcaaaagtaatcaatttgatggattttaagaatgtattaacccaagcttcatcttgcaaacggaaagacaacatcccacctttatttggataaagcaccgattccacttgtggttgagcttttaaaaattccgcaatggcttgtgcattttcttgatggcgtttcatacgcaaagaaagggtcttcataccacgaatagtcagccaagaatcaaaaggagaaagcaccgcccctgcaccattttgaatataagcaatgcgatcacaaagttcttgccctttcgcaacaattaaaccaacaagtgcatcattatgcccagcaatatatttagttccgctgtgaattaccacatccgcacctaaatctaatggacgagaaagcacaggcgttaaaaacgtattatccacgatcaacattaagttatgttttttcgcaagttttgcaatttcaaccacatcacattcttccattaaaggattcgatggggtttcaataaaaatcgctttcgtatttgggttaatggcagcctcaattgctgaagcagatgctgtattaacataaacaggttttacactattgttatttttataagaaaaatctaataatcgataagtaccaccatacacatcgctagaaacaatccattcatctggggcggtaaaaagcgtcatcaaaacttgaattgcagccataccagaagaaaacgcaaaaccacgatctccattctctaatttagctatcgtttcttctaatactgtgcgagttggatttttggtacgtgtgtaatcaaatcccgtactttcaccgataccacaatgaccataagccgtagaaagaaaaattggtgcagaaaccgcgcccgtacgctcatcactgcgattgccagcttgagctaataaagtatcaatagcatattgttgtgtcataacatcctctaaaaataatgaaaaaattgaccgcactttacgtgttaaaaaacgtttagcattttggcacaaaggaaaaagtgataaaagtagaaattagaaaattacataaaatttcatttttccatcattttctgtgatttatttgaacaaaatgaactttttttaaacggttagacaatttttttaaatctgtaattgacagttatctgaatttccgtaaaatgcgcaccactaacagcgaatgcgggaatagctcagttggtagagcacgaccttgccaaggtcggggtcgcgagttcgagcctcgtttcccgctccaattcgtggcgtgttagcaaagcggttatgcactggattgcaaatccatgtagctcggttcgactccgggacacgcctccataatacgcaaatgttagttgtctatgtgcccgagtggtggaatcggtagacacaagggatttaaaatccctcgcctttcgaggcgtgccagttcaagtctggcttcgggcaccatctaattccaaaccaataatcagtacctagtccaatacttaactttaatttttaattatcgttaggtgaggaattatggacttctcttctgtttctaaaaaaccttatattattactgtcgcttgtactaaaggcggttctgcaaaaagtacaaatgctgccaatattggggcgttctgcgctgaccacggtttaagaactcttcttattgatactgatactcaaccaaccttaagctcttattatgctttaactgaagaagctcccggtggtatttatgagtttttaacccgtcgtgatattgaaccttcccatatcatttcaaaaacatccattcctaatttggatttaattcaatcaaatgacccatcaaacaatgtaagtcaaactctacgtaatgcccctgatggtgcaattcgatttagtcacttaattaaaaacattgataattatgatgttattgtggttgatactcgaggtactagagacattactgtcgatatgtctgtcttagcagctgacatcctattctgccctattcttccacacattcttttgcgaaagaatttatccgtggaactatcggaatgtatcaagatttagaaacctttgaatcatttggcttcaaattaccacctctcaaagctatcgcaaattgcgttgataatactaatgacgtgaaatttgtactcaatcaattgcatgtcctatttgaaaccaattttgatgaaagcaaaaccttccttgatttttcaatccctgcgcatgtggcatatagagaagctgcaacttattcattgccagtttatcgccatagccaagctgaatatcctgttatcaaagaactgtgttgcttgttactccctcaatttaaaacactttttgataaaccaatgaaaaaggaaggctaatatgactgataaacttattgcttctattgaagcggaaagtgcggtcattggtgctctcattattgataatgacaaatttgatgagatcgcaactttactgcgctctgatgatttttatgtctcagctcataaagtattgtttgaaggtgttagccatctattaacacaaggaaaacccgctgatattttaactttggagcagtatttcaaagataaaaaactgattgatcagatagggggattagcatacttagctgacattattcacaataccccttctgcatctaatatcactgcgtatgctgagattatttctcgttatagcaaacaacgtcgttttttgactctgggccagtttattgtaactgaaatgcaatcttcaaaagatgagattgaattaacttcttttgaggaaagtgttgataagcaatataccaatattgtcatcgaacaagagacggatggtgttgctgatcttaatgcaagtttcgagcgaatcctttctcgcatggaaacgtcctctattaatgccgatccagttagtggaacaccaacaggcattattgaattagatagagcaacaacaggcggtcaaccaggagaacttatcattattgcagctcgtccagcaatgggtaaaacaacctttgcacaaacgattgccgcaagtacgttagataaatttcctgacagccctatccaattttacagtcaagaaatgccagctgatcaactattagaacgttttatggcaatgcgctctcgcgtcagcttgcaatctattcgtcaagcgactgagcttgaagaggaagaatggactcgccttgctaatgcaatggggacaattaaaaaagactggaaagatcgtttgttaattgatgatgaagcttctttaacacctcatcgtttacgcgccaaagtacgtaaaaacactcgtctatacggcaaacctaaagcgattttcattgattatatccaactaatgagaactggaaataaaactgaaaatcgcaatttagaacttgccgaaatatccaatgatttaaagaaattagccaaagaaactggatgcccaatttatgcattatctcaactaaaccgaggtttagaaaatcgagctaataagcgtccaatcaatgccgacttacgtgactccggctctcttgaacaagatgctgatgtcatcattcatctttatagagatgaaatctataaccctgacacagaagataaaggcattgcggaaatcatcattggtaaacagcgtaatggcccgttagccacagtaaaaacactgtttcaaggtcaatacagcatttttgagaatttaacgacacaggatagatattatgaataatccatttattgctaaaaataaaaaacaacaaagtcaattagacgcgattgcgaaaggattaaatgttcaacctattaataatcagtctgctgcttatcaaacaacaacagcaacacattatcctgcgcaatctaaatacattaccgttacgttagataaattacgcccttatgaacacaaccctcgtaagacacgtaatcctaactttgaaatgattaaagagtcaattcgtcgtcgtgggtcttgatcataaaccaaatatcactcaacgacctggcgaacctttttatatcatcgctgacggtgggaatactcgtattcaagcattaaaagaactgtttacagagactcaagatcaacgtttttggtctattgaatgcttatataaaccctggaaaggtgaaagtgctgatagtgtagaagcggaattagatttgcttattggtcatttaattgaaaatgatacacgtgcagatttaacctttattgagaaagcgttgggaattcagcaagcgaaagaatactacgagaaaaagttaggaaaatccctttctgctcgcgagctttcaagtgagttagaaaaagatgggtatatcattcaattttcaatgattgcgaagatgggacgttgcattgagtatctttatccttatatcccggatgtactttttaacggtttaggtaatgcgccaattgataaattgcttgcgattcgtaataacgccttagccatttggcaaaattatcaatttgaattggaagtgtcctttgatgaaatttggggacacagcctagctcgttgtaatgatgaccaaccgtttcatatcaaagtattccaagaccatctcattgatgaaatgtcatccatgttaggtgatcgtgtaagttatgaagtcctttaccttgaaattgatctcgatgagcaaaaattcaagaaaatggcgcaaaaacaacacgaaatacaacaaagcgtacaagaaagcatccaagatgttcaagcgtttaatacgccacagccacaagaaaccgcattagacacattatctcaacctagcgtagtcaatactccaaaaatgactacccctgaaaaaaaatcaatacctgcgccagtattaaagcaagcaagtgttgaaatttctccttcatttgagaatgaagcagatgataaaacagaggatgaagagtttgatgaaactaatgctagttcagatggcctttcttttgattttgctaaaaatttaactcaacaatttggtattactccaggcatgagcattcaggagcaacgccaacaacgtgcagaagaaaatggattaggctttgcttgcgtaggccgtcaaccagttgatgatatttggaaaatttatcctggtcgtcagcataaagtagaagcttattcactagcactcgacattgcggaaagtgttggattaactgactacattgaacatgtagtaaaagagcctgttgattacacttaccgcgtaaaaccattagataaagatgtgagcggtgtagcacagatgtgttatgacttcttaaatttattacaaacagatgtgcacccacagacatctttcaccttattaccggaatatttactcaatactcaagaaattgatgataccacgctagttaaattattccgtttaattcgcctcgttcgctatattcgttcagaaggagatgcataatgagcatgttcagcaatttaaaccaagtggtattgaatgagattttggttaatttacaagaaggcaatatcaatgtttgccggaactatggtttctcaaaacaagaattgcaagaaattgaaaaactcagcacagaggaagtttatgaactggctaacaccaaagctccctttgccaaagttgaaattaatcacgatgcattttggcgattagtggctcgagtacgcatgtcgtcacaagaacgtcgccttattgatcgcgcattaatgttaggtgcatccatccaaatgctcaattcctacttcggcttaaccacttcaaaagtatctgctcgtcgtagcctacttggaaaacaagaaccaatgggacgtaagccagctgcaaccgaagaggaagaaaaattaatttgggacttatggcaagagcataaaggtgatgttcaaacaattgaatcaacagaaggactagagctgttaattttaattgcggaagaaaccggtattaatttaactgaaatttggaaacttgttagccgctggaatgcagcttaaaaaacataacgcccaacctagtgcgttacgttaagttgggcgttattcatatcgttagtaaggaacttgggaaagttcattggctattgtaaagatgtttaagcacattgcaacaataaaaatgaaatattctcagagagaattaaattatggaaacaaaattacaagagcatgggttgctcttttttggcaaccagcatgaaacagttccaacccgtttgctatttgatccttatttaacatcaagagcaaaattggcatggcaacttataaaatacaaagcaagagaatttcaatcaggcatgttcccatcatacgaagtgcttgcaaaattactttcagataaaccttatgatgaagcagaactctcgcgtaagctagttagccaaacgttgttattacttagattaactcgttggctaacactttgtgaaactgtacgtaatgagcaaggtcaagtattgggtaatttttacatccttcatgatgaacctatgccaatcattgatacgattcaattaaaccatgattacatcgcactccttgaaaaatccattcagcatcgagataactttgtgcgaggtgtagcaaaccatattgtagaaaacctgctctcagataatactcagtggcattatatttctcacattgactggatgcgagctcgccttcaagactatcaaaaacgtccaaaaatggatatttcagagcaagaagaatcaacatttattcaagaaaacttactaagttccaataaggaactcagtgaaaaaacaggggaactcagtaaaaatcaccttagttccaaaatggaactcagtaaaatcaagcagagttccaaaaaggaactcagtacccaaaatgatgataagtcattgatttcaggcttagttccaaaagggaactcaggtttttcacagtacagtacaggtactagtatttatataaatacgtactgtactggtaatgcggatgaaattgactggccgactaatattcagttttcatcattggaaaaaacagcaatttatgcaagcaatgcgtggacttgatttaggaatctgtaaagcgattttatttgagctagaacagcgtgtggcaaaaggtgaagtgaaaaaacccacaaggtatgtagtgacattaatccaacgtgcacaccgtggtgaatttaaaccatatttgtatgaacaatttttggctacacaagcgcaatcattatcatcaaaaaatcggttatcacaacatgatgaaactagcttagttaataatgtgaaagccgatagcacaataaaaccaatgcgagtgcaatctgaagaagagcgaaaagcgagagctgatcgcattcgacaatttaaggcttcaatttgcaattgaataagctgtataaaaagtgaatagtgtagaagggttctacaaagtacaaaatttaaccactgtaaagggactttacaaagtacaaattttaaccagtgtgcggggactgcacagtgaacaaaaattaaccactgtgctagggttgcacagtgaacaaaaattaaccactgtgctagggttgcacagtgaacaaaaattaaccactgtgctagggttgcacagtgaacaaaaattaaccactgtccaggggctggacaaagtacaaattttaaccaaatgataaaaggtgacataacatgacaacaacatacaaccaacagcttgggccgttacgcagtgagattacatttacgcttcatactcagtatgcaacacgtctttggaatggtcgtgacttagttaaaaatgaagccggggaagtcgttacatcatcaattctcagtattcctaatgctctatctctattgagtcaaattcagcaagctgccgaacaagatgatccttatgctgatgattatcttcttcgttttgaacaaaaagtattagggtttcgtaaagaaatgcaagatatgacctggagaatggttaatctctacagtgagaaaattcctgaaaactttcaaattgagcgttgtgccaatattgctccgattcaataccctatttttgtgaatactcagctgggttatcaattattgtatcttttggctgactttgattcgttagctcgtacagtgatgaccgcttcacatattgcattacttacaaaagatgatgcgtatgattggttagaatccggagctaaattaattcgtcgtgcatttggtgtgcttgagaattacagaaattccggtattacacgccaagatgcgcttgaaaataacgctcgctatcaagctgctgtaaaacgtatgaaatataccttaacgcctgacgtgctttccggtacaacacgtgcaacatttgctccaacaattaaaaaatcatcacttgctgaatcagatgataatggctctgttgaagtccaaattacagcaaataaaactgaataatggagattgggattatggataacgtgctcattccttctgatatgtataaacaattaggacgcacaaccccacttaatgactcgctgaaacagttattcagtgagttagactcagtgcaacagtatgaattactagctgaatcccttgctacagtccgtgaagctttaatgttgcagcagaatgaaatgttgcagaacgttcgtaaaagtgaacttagtgtattacctattcacatgatccgagataaagcttcatcatccggtgggacgtttttacgctggcgcagttttcaagcctctaagactggtgatgctgtgttaaatccggtatttaataatcctcagttatcttcagacttacgacaaaaacttgtctcagctgagaaagaacgcattttgattaatctgcaggtctccgtactaaattttatgatgagacagggtatcaagtgcggtagataaaattaaagagatagaagagtcatttataacattcacatttgtgaacgttggatcttctagtttgtaatcggctaatttatatagtttgtgatcggctcactaaaaggccttttaaaggtaaggggacaagccccttaccttaacgaaaaaaagcctttgcctttcgtggttgtgttaaaaaatctctgtgttttttactgaatttacccttaaggattagatgtaaaaaatgcacaatcttgacagttaattttgtgatttaggagaaatcaatatggctggaattaataaagtaattatcgtgggacatttaggtaatgatcctgaaatgcgaagcatgccgaatggtgaagcagttgcaaatatcagtgtagcaactagcgaagcttggacggataaaaacaccggtgaacgtcgtgaagtgactgaatggcatcgaatcgttttttatcgcaaattagctgaaatttgcggccaatatctcaagaaaggagcgcaagtttatattgaaggacgcttgcgtactcgtaaatggcaagatcaaaacgggcaagatcgttataccacggaaatccaaggtgatgtaatgcaaatgttaggtactcgccctcaaagtgcagatggtgcaaataattctcagccaatgccacaacaagatgcatcggcaaatgcttttgatgattcaataccattctgaactcaatataattaaggttaatcgtgatgaaaaaaataatttttgttttatctgccgtcgctgctttaagtggttgtgctgaattaaactcattgaatgatgcggttggtaatgttgcaggtcaactcagcagtgttcttggcggggggaatagttcctctagttcttccggtgtggcttacactcaaagttctcgttctcatcgctataacgtagaggattcaattacatcatctaaaaatattgactctctttacgtaaaaattaaacgtaatttaaaattcaaaacacgggaggaagcattaagtggattatccgggtatgagcgtcaacgttacgaatcgcttttagatgaagaaggacatgctcatgaagcgactcctggggtctattatcacatggcaaatagctatgttggcggtcgaaaaattgacataacgcttgcaaaagaggatggcaaggttagaatttcctggattgcatcctcaaatgaatctgattttgctcaatttgttaaatcagaagtgataaaagcaattaaataatacgacaacataaacatagtgtaggtaatcaatacctcattctcctttgccccaaccttagtggggctttttttatttcaggtgtttttaaatttcgataccgataataatgattattttgtatgatagataacgaaacaaatttgttttttgagatccatccaaacttttccttttcctcatattgtttaatatctcaaacgtttaccccttggctacaaggggtatttttctcctgtaattgcaaaaaataaattaagtggctcaaaatgaagtgaagataatgggcttgcatactttgacagaattttagctttctctttatggtttctaaccaaaataggaaactcctttacaccatttgcaagcaaccaaagcgttcttgtcataccatcattaagactacagcttatttctccatctttaatatgaacatttacatctgcaagtggaactggagaatccatacttttagcaaatccgttttcagcatgatgaaacttataatcttttctccatgttgactcatcgcccgcacatgtatttttatctacctcatacggtgatcgctgccataaagaaagaaacttttgagcatctacgatgacaatcatgttctcttgattagccatattttcaatatgctgtggataacgcatatacacgactttctgctctctcgttttcattctaaaaataatatatctatctcgacctgaatatctaagcgtatcaaccatcactccaattgatgaaggggtcagttttatcatgatttactcctcagtttaaaaagaattcctaattgtggtttatcttattacatcgaaaatatctctcaaatatcaatgagagaaaacatcatgaaattatttttatgtgaaaaaccatcacaaggcaatgatattgcaaaagtattaggtgcgacaaagcgtggtgagggttgtttatcaacacctgacggtcagcttacagttacctggggaattggtcatctagtagagcaatttaatcctgaagaatatgatcctgcctttaaaaagtgggcatttgagaccttgccaattatcccgggtaaatgggggctttcacctaaaaaagaaacaaaaaaacagttcaatgtcgtcatgaaacttatcaaacaagctaaacttgttgtcattgcaaccgatattgatagagagggcgaaactatagcaagagaattgctggatttggcaggatttcgagggcaaataaaacgcctttggttgtctgcactagatgataccagtattcgcaaagccttgggcgcacttaaaaataatgaggagacactacctctttactatgcgggacttgcacgtagtcgagctgattggcttattggtatgaatttctctcgtctctataccttattagcgcaacaacaagggtatcaagggaaacctttaagtgttggtcgggtacaaactccaacattaagcttggttgttaatcgtgaccgtgagataaaaaacttcattcctaagcaacattttgctttgcaagtaatgctttctgatggaaatcagcattttgctacgcaatatgttattccggagcaatattgtgatcctgatggactttgtttgtctgcccaagttatacaagcagcaaatcagcaaattcgccaatttggccaagcgaaagtggaatcagttgaaactaaacgtgaaagacaaaatgccccactttgctttgcattaagtgacttacaatcagaagctaaccgcctttatggactgggtgcgcaaagagtattggatatagctcaatcactttatgagactcacaaagcgacaacctatcctagaacagattgtggttatttaccggagtctcagtttgcagaagcgcctcaaattatccaatgtttgttgcaatccgataatcgattacacccccttgcaggtatgttaaaccttaatcaaaaatcacgagtttggaatgataaaaaaattactgctcaccatggcattattccgactatgattaaagctgatattagcaaaatgtctgatgaagaattaaagctctatgatctcatacgtcgtcgttatttagctcaattcttacctgtttctgaaacagataagacacaaattattttgaagtgcggtcaacatatattaagtgcacgtgggaatgtgcttattgctccaggttggaaaattctatttggcaaatcacttgatgaagatgatgacgcacctcaagccttgccgacgttaaagcaaggacaaatctgtcagatttctgattcagaaataaaaaccttacaaacatcaccacctaatcacttcacggaaggtacattgctcaccgcaatgaaaaatgcagctcgctttgtaactgatgagcgtttaaaacaacgcttacgagaaactgaagggcttggaacagaagctactcgggcgggaacgattcaaggtttgattgataaaggtttcttgaaaaagaaaggtaaatcactattagcgacagatgaagcaatgacgctaattgataatttacctcagatgttaaaagatccgggtttaaccgcactttgggagcaagcgctcaatcaaattgctgaaagaacgctttcgctagaagtgtttatgcaaaaacaagaagtctttgtgcggcatttgatggctgattgccttaaaaagggaatgagtttggggaatattgaaattcgtaaatgccctaagtgcggtgcaccaatgattaaaagaaatggtaaaaatggggctttttttgggtgttctgcttatccaaattgccaacatattgaaaatattgatagcaagaagaatactaaaagtacaaaaaatttaaagaaaaagtcgagtaaaagtgtgagtgagcaaatttcatctttacgaagcttattgaactaggatttaagcgcctgtgaatggcgagccctcaaaaatagtgctatactaaagccttcgtaagaccgttcgtgaattgtcggttatcaattcacactagccaaaaatgattccagcacgctgaaaggaatttctcacattgattaacgctccttgtgaggtgtgccacctagttaatcagagtaatgatggagtaacgccccaatttactctcgacttttcaaatcgctggccattgcggatttttaaagtgtattgcaaagtgcattttgaaaattcgcaatggcttgctactttttccttaccggagcccaccggtgaaacaatgggtgccctttgtgtcaatttgatgccacagatataaccgattgatggccacaaagtaatcggataaggcgagccgtaaaaatccgtatatggtaacgaacgtatcagtatttttatgaatcaaattagtttggcctacttaatttttatttaatcaatctatagtcaaaactataaggtcattcaggaaactgggtgaccttttcttttgactaaaatatctccaaatagaatttttaattttttatacatttaaggtttgctttagattttaataacaacagtttttaaggtgctgtgaaaacagcctttaagaagttgcacgattcttgagaagcaacgccttgccttagcgcaagtagaatcatagccaaaattttttccagcacactgaaaggagaatctacgaataattcgtaggtgtgccaccttaaactacccttaacctaaaataagattacttattctagtttaatcacaatttaacccttggcgggaaacatttttcccgtgttgggtaaggatgtttctccgcttttttactacttaggagaaacattatgtctactcaaaacgcacaaccaaaatatttcaatcttcatacttctggcattggttatttaagcgatattcgcgaaatcaagccgaaaaaaggagatgcattttgggcttgtcgaattgctgctcttacaggttcttccgattctccggaatatcgtttttttgatatgaacgtatccggtgaagaaactgtaaatttaatcaaacgctgtcaagaagctgttgaagctaagaaaaaagtcttggtttcctttgtaatgagtgatttgtggtatgacacattcacttattcaaaagatagcgaatatcacaaaaaaggtgatactggcgtgtcgattaaaggacgactctatcgtattaactttattaaagttgatggtgagttgaaatatcaagcaaaacgccaagatgagcaagggaatgactaacctataaactgatgaaagccaacaacaaaatttgttggctttttctttaccctgaaggggaaactccccttatgggtggtttctccttttttatttctatttgaggagaaacctatgaatacttacgctaaattttgccctaatgtttttgttgctaaatgtccggatgctcaccaaaaaggtgacgttatcatcttaaccagtaaatacggtaaagagactgaagtggagattcataatctcgtaaaaacctctgaggatgcgtatttttattccttcacccggtgtgatggagtgaatagtcaagttcgtgcagaacaaaaagctgagcgttatcaaaacgcagctaataatgcattaaaacgcagtgaacaatattgtgaagctgctaatgaaggccgtgaatttcttagcttgggagaaccaattaaaattggtcatcatagcgaaaaacgccatagagccttgattgaacgtaatgcaagacgcatggataagtctattgaagaaatgcgtaaagcagaaagttatgacggtaaaatcgcttattgggaacagatggcagggaaaattgatttatccatgccggaaagtcttgagttcttcaagtttgaattggaaaaagccaaagaaaaacaccaagagcttaaagataaacctgaattgcgaacacatgctttttctctcacttatgctaaaaaagcagtcaatgagcttgagaaaaaagtaaaattagccgaattactttgggcgtaaatttaacttttgaaaacataaattggagaaatatatgttttactatgtaaatagtggattagagctaattactttaacaacgcaagagtttataagtgagtttctaggaaaggcaactacccctaaagggattgagccaaatcatttctatgatcctcaaaccaagctagtttatgcatggtactctggcaaatgtgtagcaacttctgagtaccaatatacacctcaagaagcagaagctttacttgttgaattggcattggaaaatgctagtaataatggggatggatcaattatgttccaaccttcgccaacaaaagaagcactaattgctgatatgagtaattatttggaatattgtatagatgatgaatctgagcacgatttagaatttgcagcaaaaattaaacagattatcgacagtttaaaaacttctgattaataacattaactttaatgtgcgataagcattcttttcgcaccttacccataggggatatatcccttatgggcgatattccctattttagaaggaatatcgaatgtttaaattaaacgagcaacaacaagctattttagaacaggcacaggttattttaactaaagtgatggaagaaaagcccttttaccaaggtgcacaggaatttactgagccatcaatagctaaactctattttcaaaccattataggtaatgaggaaagagaaaatttcgtggtacttttcttggatagaatccacagattgattaaatctgaggtgatgtttcaaggatctgtttcagaaacttctgtgtcaattcgggagattattcgacaagcattaaagctaaatgcatcagcaattatcattgggcacaatcatccaactggaaatgttgagcctagtgatgctgataaatatataaccaagagattaaaggaagcttgtgaattaatggatattaaattacttgatcactttatcgtttctggttcagcatctttttgctttactgataatcatcttatttagctaacaacctttcacccattgggggataacaccctcaatggcagtgttatcccctttactttttacattttaaaaatttaggagaaacacttatgtgtaaggaaaatcgtattttagaacttggaaaaatcttcgtctctcgtcgtatcttagcggaattaactaccgaaaagatcaatgaggtcatctcgtggcatcaaaatggctgcattatcatgctggggaataaagattggattgaaaaaccgccacatccgctttcagaaattgttatgaatttctatcaagcagataatggtaaagacaccattcaactctctacttcagtagatgatgacgggaatcgaacaactaagatttctttttctgatgaaagtgaagatgagcaaagaggacactttgattgggatatatatcaatcaaaaagaacaccacttaagttaggggatgtttcgtgtactatctgcgctaaacagttattgggaatgccaaccattcatcgcttaattgaaaaacaattaggttatgattggggtgctacctgcgttgaagattggattgaaaacgatcatgccgtagagaaggataaacgcattgtgagccagcattttattgatggcgaaagtgtttttgtcatcactgaagcagatcgtagttctacaacgattatgctcggatatgaatattaatctatttaccttgaaagcctatctactttatgtagataggcttttcctttttaggatatgataaataaaactctttttaacagtataacgatgccttatttaacttcttcacaaactgaatgcctaaaatggttagctcttatcacgatgattatcgatcacattggtgtggctttttcaaatgcttacccagccctatcctggtgtcgggtgataggtcgattttcctacgtggcgtttggatttatcatcgcgcttaatttatctcgagataaagtaaactttaaaagttatttcacttggatgatagcaaccgcatttttatctgaaatcagttttacgcttttcgagcctaattatgaccgtttaaatgtcctatttcagtttttgtctgtaatcggggtaatatgggtatataaaaaccgtcaagacttaaatagctgggtcatgttttttggattgggcttttttattattctttccgcactctctgattatggtttacctgggcttttatattgcattggttgttacctattcttgcaaacaaaagatactcaatttcgtcttattacgatgctaacctgtgtattgctcgcacttttcgtcaatcacagttttattgataatttcggggaaactattgttgaaacaatcagtgttgttactgttgtggtcggtacaatgatatttattcttcaccctaaagggccttcgtcaatgtaatatctcaatctctcgaatgcctaagcttttcttttatcttttttacccggtgcacttaacaattattattggcattaaatatatttttctcagctaatttttctatctttacttcaagaagaataaattattcaaattcaggtgagagttatccatattaaggcattatttaaataccttaattggagcctcatcatgaaaaaatttctattaaccacttttgcattggttgtgctttcaggttgtgcacataaacaacaaacagccgatgagcaacaagcactagaaaatccaaatattcaacaaggtcagcatcaagttttacaaccggaagatcgaattgttcgtccggatatttacacagactatcagcctgaacgtacagaagtgttacgtgaaggtcgatacactttaattaatttctctccagaagaaggtcaaaaataccttctagaccaaagtgtcactgtcaacatgttaggtaaaaagaaacgagccttaacggcaaccgttgagcagggattacgcacgacgttaaaagatacaggcctttcactttgtcatggttttggtcagaatgaaccaacactttctacgctttattcccgtccattaccaaaagtacattatcaatttggcccgatggctttacgtgatgcccttcaaatgttagcagggccggcttatgaaattactatcaatgacgtttctcgtaccgtttgttttaaattacgcccagctgtaccggaacgtgctacaggggaaaagccgaaagtagaaaccacaacaacgacaacaactacaacagaaatcatcgaggaataagcaatgaatcatgtcaaaaaaatatcctatgtggcgatgatattagggatgttttctactgctgtatttgctgaagtcactgcggctaatacacttgctactcaatccctcaatcaacaaaacttggtgacaaataaattaaatcaacaagagttattagctaagtctcaagagtggggtttaactgagcaagaatggcaacgctaccaagagcttaatcaaggtgctcgtggtatatggtcgccaggtcttgaccctttaacctcgcttggtgtggagtctcgaaatgagcaggaaagagagcgttatgctcgactactggcaaaaaaaatgcacgaccgcatggagagagagctgcagttccaacgcacttatgatcgcgtatttgctgaaatgtatccaaatgagcaaccatttaaggttgaacctcatatttcagagcggtttggacgggtgatttattttactcgcctagaaaattgtgacaaatgtgaagcgaatgctgatcgtgtactgcaatatgtgaatgataaaacgcctatagatatttattttgttggcgtgaataataatgagcaaatctataattgggcgaaaaaacataacatcgacccaaataaagtgaatagaaaattaattacccttaatcatgataatggagcctggttacagtatgcagatggcaaaatgcctgctgcattccaaattcaacaggatgggcaatggcaacaaatcgtctattaaaaatcgtatttagcttaatcggtcttggcgttgcgactcactccgttgcatttaatggctttggaactgatattgatggctatattaaagatgcatctaatcgctaccaggtcgatgaagcgatgctacgtgggttagtaaaaattgaagatgggtggtatggaaatgtttccccaaccggggcaaccggtgtggggcaatttacccggggcacctggaattggcttgcaacaactgatgaggggcgagccttaggtatgactcaaatcactcgttacaatcgtgatacacctttcgaccctagaaaaaacaatcaacttaacactctagcaaccgcacttttagctagatggcatattaatcagttttttgagcgaggcataaaaccatcccatgaaaatttatatcttgctcataatatcggtatagatggtttacatcgagcgctacaaggtagagcaacacgtgaagatattctaaatatgaagcgtaacgggatgaaaaaaggaatgtcggtacaaggctttcttgtttatcaaagtgagcgttttaatgtcagtaaacaaatagctaacttccagcgcccttcagtatcaccacgttatcaaattgagaataaaccattaccagccaatttacattgggtttctcccaacagaaaccgctatgcgttgggttgagccagcgtcaaatcaaacaaatcaacaagctattcgttggcaaaatccaaccaattaatacgagaacagaattatgcagtataaatcctttttcctctctttggtctgcttaggagcagtagttcaggcgcaagctgaattaaaagttattggtgattttggcggagaagtgcagtccgtttttatgaagcattacaaccggatgaatcaatggttcaagcctaccctaatagcgttccttcaacattgaccgaagcggatattttacctgttatctcacatagaatgacaccgggccaaatacaaccagtcagaatgaatcttcctggaatgttgcctatttttcttattggaacagataacttatctaaaaattggctacacgctaattataattaccttaaaaaaattggtgcaatgggacttgtagtaagcgttaaaacaacaaacgaattaagcgagttacgccaattagcaccggatttaaccttaatgccaacgccaggggatgacttagcttcaagattaaatcttgctcactaccctgctttattgacttcagaaggattgtcgcaatgagtcaaaaacatgtattagaaggtttacttagaccgcctgttgaattttttccagctgccgtccatggtacttgtgctttggtttgttgcggtgcgccttggtcgctcgcattaaatcctcttattggatatggattaggggccgctttcgcaggtatgggggttatgcgttttcgtcaaggcatggaaattgtacgctatcaccgaaatttacgcagactccctcactatgctttgaccagtcgtcaaattccagtaagtaaaaaagccttgttcttaggacgaggctttgaatgggaaccaaagcatacgcaacgtctttatgactgtttctctgcaaatgggcaaatttattggaaaaatgggaagtggtttaaagccgctcgtgattatgaaaaagtgcatgataattggttatctagactcacttcaatggactctccattaaatccagtcagaccgctaccgccagttggcggcattnccagtgatgcatgggtaccgagtcgatattcgataaca

SEQ ID NO: 576 - DNA, 929 bp, H. influenzae
ttttccccagggaaccagcttatgccatgattccgaattcggggctcggtaccctagactgaccctttttggacttcaggtggctggagtgagccctgctcccccctggctccttcccagcctgggcatccttgagttccaaggcctcattcagctctcggaacatctcgaagcgctcacgcccacgggatctgaagggtgaaatattctccatccagtggtttcttctttggctggggagaggagctggtgttgttgggcagtgctcgcttagtgctccctgggggcagctcgtggtgaggctcccctttcttgcggagattctcttcctctgtgcgccggtctctcccaggacaggcacaaacacgcacctcaaagctgttccgtcccagtagattaccactggagtcttccagtgtgatgatggtgaggatgggcctccggttcatgccgcccatgcaggaactgttacacatgtagttgtagtggatggtggtacagtcagagccaacctcaggcggctcatagggcaccaccacactatgtcgaaaagtgtttctgtcatccaaatactccacacgcaaatttccttccactcggataagatgctgaggaggggccagaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagtacgtgcaagtcacagacttggctgtcccagaatgcaagaagcccagacggaaacggggattctttagagtcgacctgcaggcagcaagcttggcacttggcggcgtttacaaggcgggacg

SEQ ID NO: 577 - DNA, 374 bp, H. influenzae
  misc_feature (256)..(256): n is a, c, g, or t
  misc_feature (266)..(266): n is a, c, g, or t
  misc_feature (299)..(299): n is a, c, g, or t
  misc_feature (307)..(307): n is a, c, g, or t
  misc_feature (326)..(326): n is a, c, g, or t
  misc_feature (362)..(362): n is a, c, g, or t
ggatccattaccgaaaacttttgcacaaaaaaagtgctttcgccaatttgaatttcactgcgtgccatcagtcatttccccctacaaataatttaccgtccgcagtttcaagcgtccactcgcgagaacccacttcttttccaagctcaagtttcgccgatttaaccacccacgccgtgcttgcagcgaataatgagcgaccacgcaagtcttttaccgcaattggaaaggttgcgtttttactcactttatccgntgcatagagntcacttaacacatcattggtatcactggtttgnaataacgntaatgggacttttttacgnggatcctttaaagtcgacctgcaggcatgcaagctngcggaatcatgg

SEQ ID NO: 578 - DNA, 800 bp, H. influenzae
  misc_feature (358)..(358): n is a, c, g, or t
  misc_feature (376)..(376): n is a, c, g, or t
  misc_feature (435)..(435): n is a, c, g, or t
  misc_feature (443)..(443): n is a, c, g, or t
  misc_feature (445)..(445): n is a, c, g, or t
  misc_feature (466)..(466): n is a, c, g, or t
  misc_feature (468)..(468): n is a, c, g, or t
  misc_feature (476)..(477): n is a, c, g, or t
  misc_feature (481)..(481): n is a, c, g, or t
  misc_feature (499)..(499): n is a, c, g, or t
  misc_feature (502)..(502): n is a, c, g, or t
  misc_feature (504)..(504): n is a, c, g, or t
  misc_feature (518)..(518): n is a, c, g, or t
  misc_feature (521)..(521): n is a, c, g, or t
  misc_feature (529)..(529): n is a, c, g, or t
  misc_feature (537)..(537): n is a, c, g, or t
  misc_feature (549)..(549): n is a, c, g, or t
  misc_feature (566)..(566): n is a, c, g, or t
  misc_feature (570)..(570): n is a, c, g, or t
  misc_feature (583)..(583): n is a, c, g, or t
  misc_feature (586)..(588): n is a, c, g, or t
  misc_feature (592)..(592): n is a, c, g, or t
  misc_feature (599)..(599): n is a, c, g, or t
  misc_feature (605)..(605): n is a, c, g, or t
  misc_feature (614)..(614): n is a, c, g, or t
  misc_feature (617)..(618): n is a, c, g, or t
  misc_feature (621)..(621): n is a, c, g, or t
  misc_feature (623)..(623): n is a, c, g, or t
  misc_feature (629)..(630): n is a, c, g, or t
  misc_feature (635)..(635): n is a, c, g, or t
  misc_feature (637)..(637): n is a, c, g, or t
  misc_feature (640)..(640): n is a, c, g, or t
  misc_feature (642)..(642): n is a, c, g, or t
  misc_feature (646)..(646): n is a, c, g, or t
  misc_feature (655)..(658): n is a, c, g, or t
  misc_feature (666)..(666): n is a, c, g, or t
  misc_feature (673)..(673): n is a, c, g, or t
  misc_feature (677)..(678): n is a, c, g, or t
  misc_feature (680)..(680): n is a, c, g, or t
  misc_feature (687)..(689): n is a, c, g, or t
  misc_feature (691)..(691): n is a, c, g, or t
  misc_feature (696)..(696): n is a, c, g, or t
  misc_feature (700)..(701): n is a, c, g, or t
  misc_feature (709)..(709): n is a, c, g, or t
  misc_feature (716)..(716): n is a, c, g, or t
  misc_feature (722)..(722): n is a, c, g, or t
  misc_feature (746)..(747): n is a, c, g, or t
  misc_feature (750)..(750): n is a, c, g, or t
  misc_feature (752)..(752): n is a, c, g, or t
  misc_feature (757)..(758): n is a, c, g, or t
  misc_feature (771)..(771): n is a, c, g, or t
  misc_feature (774)..(774): n is a, c, g, or t
  misc_feature (780)..(780): n is a, c, g, or t
  misc_feature (785)..(787): n is a, c, g, or t
  misc_feature (795)..(795): n is a, c, g, or t
ggatcaagtaaatacacctggcttgcaagctctgcgtgaagaattggataatcttgtgttgaataaacagtaattatgggattaggcccctgggcgaacactgatagtggtaacaaaccgaaaagaaacagtgatttttttatagacataaccatcccttacgatgaaattggatagttgaaacattaacgaaatgacaggggggaatatataaaaaattctttttgattttgagataaattctccatttccaaaaaacaatttttaatagagattcgacagccttattaagtatgattggacttgataagtcgctgtgcaaacagctcttataagttgcacgattcttgagaagcancgccttgccttagtgcangtagaatcatagccaaaatgttatccagcattctgaaggatactctacgcaatcgtagnatgccacntnaagaccttccggggaaaatgntnccttcggnntgtntttttccaggaatttttnttncnattgggaaagactntgncccatccnctcattgnaccttgatgtcntcagtaccctttgaacncacntttatttgggggnaannntggncgttttngtgcgntaaacaacnccnntancnacaggnnttggntnatnancttnaacaaaacnnnngtttgaanacaaggnttanncnccgaaannngnatttntgtnncaaacggntaacacncttttnttttttttggggttggggggggcnnttncnggtannggagtttttcccnggnttcctnggagnnntgggaaanaaaaa

SEQ ID NO: 579 - DNA, 462 bp, H. influenzae
  misc_feature (368)..(368): n is a, c, g, or t
  misc_feature (389)..(389): n is a, c, g, or t
  misc_feature (399)..(399): n is a, c, g, or t
  misc_feature (401)..(401): n is a, c, g, or t
  misc_feature (406)..(406): n is a, c, g, or t
  misc_feature (420)..(420): n is a, c, g, or t
  misc_feature (423)..(423): n is a, c, g, or t
  misc_feature (425)..(425): n is a, c, g, or t
  misc_feature (431)..(431): n is a, c, g, or t
  misc_feature (446)..(446): n is a, c, g, or t
  misc_feature (460)..(460): n is a, c, g, or t
ggatcaaactcttcaattcaagttcaatcgctcaataaactacttagctataaatagaaacactacttaaaaaagtaatgatgaattttcagttaagcacctattaagacttcaaaattaaaaaatatttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcctctagagtcgacctgcaggcatgcaagcttggcgtaatcatggtcatagctgtttcctgtgtgaaattgttatccgctcacaattncacacaacatacgagcccggnaggataaagngnaaagnccgggggggcctantgngngagctnactcacattaattgnggtgggctcactgncc

SEQ ID NO: 580 - protein, 29 aa, Artificial sequence
  Synthetic peptide
KVVGEIGFEPTTHWSQTSCATKLRYSPSD

SEQ ID NO: 581 - DNA, 68 bp, Artificial sequence
  Synthetic primer
aaccaaccaaccaaccaaccaaccaaccaaccaaccaaccaaccaaccaaccaaccaaccaaccaacc

SEQ ID NO: 582 - DNA, 52 bp, Artificial sequence
  Synthetic primer
ttgcttgcttgcttgcttgcttgcttgcttgcttgcttgcttgcttgcttgc

SEQ ID NO: 583 - DNA, 84 bp, Artificial sequence
  Synthetic primer
aagcaagcaagcaagcaagcaagcaagcaagcaagcaagcaagcaagcaagcaagcaagcaagcaagcaagcaagcaagcaagc

SEQ ID NO: 584 - DNA, 42 bp, Artificial sequence
  Synthetic primer
aacaaccaacaaccaacaaccaacaaccaacaaccaacaacc

SEQ ID NO: 585 - DNA, 32 bp, Artificial sequence
  Synthetic primer
gcaagcaagcaagcaagcaagcaagcaagcaa

SEQ ID NO: 586 - DNA, 147 bp, Artificial sequence
  Synthetic primer
tgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaaga

SEQ ID NO: 587 - DNA, 12 bp, Artificial sequence
  Synthetic primer
gggggggggggg

SEQ ID NO: 588 - DNA, 22 bp, Artificial sequence
  Synthetic primer
tgcccattaacatcaccatcta

SEQ ID NO: 589 - DNA, 600 bp, H. influenzae
  misc_feature (3)..(3): n is a, c, g, or t
  misc_feature (11)..(11): n is a, c, g, or t
ttnaacaaganattgggacaactccagtgaaaagttcttctcctttactcatatgtatatctccttcttaaatctagaggatcaagcaacttaatttttggtttgcgacatagacaattttcttcgggcttatgcgggcaaatgagtacttcatcaaaggtaatgccctgagattcaaataatgccatcattacattgtggggcttatcaaaatttgtttgcggaaaagcatccgtaccaagcccatcttgattagaaactatcacaaaacggtatttcgctttcagtctgaggagtgcgggaatcactttcggttctaattttagtttctctaaactgtcaatttggaaatcagtttttggttcatcaattaatgtgccgtctcggtcgataaaaagagtaggttgcatatttttctccgtgtatgttatatgaatggtatgaggtttatcatttgctttatacaaacagtataaaactaaataatctcgaatcgctctgtgacttaaataggaggtggttcattttacctccttaattgcttcaacaactttctcacactcattccttgttcccacagtaatgcgaatacaattttgt

SEQ ID NO: 590 - DNA, 600 bp, H. influenzae
  misc_feature (22)..(22): n is a, c, g, or t
taacaagaacttgggacaaagnccagtgaaaagttcttctcctttactcatatgtatatctccttcttaaatctagaggatcagcatcacatcgggcggaataggaaaaaatatcgcctcgataaaacttacaaaagagagccaaaaaacagcaaaacgatgttttgaccattccatcgttttatcgtacatcgtgccgaaaattttcatatttttctctatttggtaaattcctgctctaaccaattttgcaaagaaagcaatgaatgatatgcggtaagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagataccggcctccatcggagaaactgtccgaggttatgttgacctgcaggg

SEQ ID NO: 591 - DNA, 600 bp, H. influenzae
  misc_feature (1)..(1): n is a, c, g, or t
  misc_feature (446)..(446): n is a, c, g, or t
  misc_feature (453)..(453): n is a, c, g, or t
  misc_feature (517)..(517): n is a, c, g, or t
  misc_feature (520)..(520): n is a, c, g, or t
  misc_feature (526)..(526): n is a, c, g, or t
  misc_feature (528)..(528): n is a, c, g, or t
  misc_feature (539)..(539): n is a, c, g, or t
  misc_feature (542)..(543): n is a, c, g, or t
  misc_feature (548)..(548): n is a, c, g, or t
  misc_feature (552)..(552): n is a, c, g, or t
  misc_feature (554)..(554): n is a, c, g, or t
  misc_feature (556)..(556): n is a, c, g, or t
  misc_feature (594)..(594): n is a, c, g, or t
nacagattgggacaactccagtgaaaagttcttctcctttactcatatgtatatctccttcttaaatctagaggatccacaataatatgttctatcttggcttcttttttccaatagttttcgttacgcactaagcgaacatattggttatatacataatcttttacttgataaggccctgtgcctactgggtgggtatctaattgagcaaggttgtcatctgcgcttaattgataggcatattcttgtgaaaaaataatggcatactggctggcaagatgcgacaaaatggaggaatctggtgcaaataattcaatttttacttgataaggcgaaagtgcggtcacagatttgattttttcgttaagtttaatgctatcaaaataaggaaaacgcacttttcttgcttgttcgtgaaacactctatattgtggattactataggnaaccatncgcctctgctaaggttggtaaataagtattatgccctaatacacgattaatcgaaaatacttcngtnttcagngntaaaaacaccntgnnggggnaaancnanggggtttgggggaaattttacccccgggacgtaaattnaataaa

SEQ ID NO: 592 - DNA, 600 bp, H. infleunzae
  misc_feature (9)..(9): n is a, c, g, or t
  misc_feature (524)..(524): n is a, c, g, or t
  misc_feature (531)..(531): n is a, c, g, or t
  misc_feature (557)..(557): n is a, c, g, or t
  misc_feature (585)..(585): n is a, c, g, or t
  misc_feature (588)..(588): n is a, c, g, or t
ttaacaagnaattgggacaactccagtgaaaagttcttctcctttactcatatgtatatctccttcttaaatctagaggatcgtagaaccataaggttttaccatcagaaataatctgggtttcttgaggggttttagtctccatacggaataaatttgggcgtttaatttgaagtttgccacttccttgttgaacattttttccacttccagaagtcactgtttgcacaaattctgcacttaatacatcgactttagctaaacgcatttgtaattcacttgccgcatcagccaatgccaaattactcaaaccaagtaaggtaagtgcggcaaattttaaggttgtttttttcattttactttccttttaaattagtattctggacgatgcgataaaatttcacgcttaccattttgcattgggctgacaatcccttgctcttccatttgatcctctagagtcgacctgcaggcatgcaagcttggcgtaatcatggtcatagctgtttcctgtgtgaaattgntatccgntcacaattcccacaacatacgagccngaagcataaagtgtaaagcctggggggnctnatgagggagcta

SEQ ID NO: 593 - DNA, 600 bp, H. infleunzae
  misc_feature (509)..(509): n is a, c, g, or t
  misc_feature (516)..(516): n is a, c, g, or t
  misc_feature (525)..(525): n is a, c, g, or t
  misc_feature (543)..(543): n is a, c, g, or t
  misc_feature (545)..(545): n is a, c, g, or t
  misc_feature (560)..(561): n is a, c, g, or t
  misc_feature (575)..(575): n is a, c, g, or t
  misc_feature (580)..(580): n is a, c, g, or t
  misc_feature (586)..(588): n is a, c, g, or t
  misc_feature (592)..(592): n is a, c, g, or t
  misc_feature (595)..(595): n is a, c, g, or t
ttaacagaattgggacaactccagtgaaaagttcttctcctttactcatatgtatatctccttcttaaatctagaggatctatacctgcaattaaaataacgaaagtcatacccactgcaataatcgcattaaccgaagtttggcgtaaaatattcaaaatattatctacgctaaaaaaatcaggattaatcattgatacaatcgcgataagaataatcaacgcaataaaagaacgctgttcaatcaaaaatcttcctatttgaaaattagatgtttcatttttcatcatacttacctactcttatttaccaatagctgctgctaataatttttcttgagttgcgtctttgcgagaaaattctgcactaattttaccttcacgcattaccaacactctatcgctcataccaagcacttctggcatatcagatgagatcctctagagtcgacctgcaggcatgcaagcttggcgtaatcatggtcatagctgtttcctgtgtgaaattgntatccgntcacaattncacacaacatacgagccngnagcataaaggggaannccggggggcctaanggggngctacnnnattnatngggtg

SEQ ID NO: 594 - DNA, 600 bp, H. influenzae
  misc_feature (12)..(12): n is a, c, g, or t
  misc_feature (14)..(14): n is a, c, g, or t
  misc_feature (597)..(597): n is a, c, g, or t
aagtactctgtntntctccttcttaaatctagaggatcgggattatcaagcacattactcgtttggctttcacggaaagattgcaagcgtgaaagcaacttctgcatcccaacttgctagaatttgtgcggctaacaatccagcatttgccgcacccgcagggccaatagccaatgttccgactgggattccttttggcatttgcacaattgaataaaggctatctacgccacttaacatagaactttttactggcacacccagcacaggcacaagggttttggctgcgatcatgccgggtaaatgtgccgcaccgccagccccagcaataattactttatagccatttttttgtgcattttcagcaaattcaaaaagtttatcaggcgtacgatgagcagagacgatttccacatgataaggtacttttaattcatctaaaatctgagttgcctcttgcatggtagcccaatcgcttttggaacccatcacaacagcaatttgtgcagtttttgacatgctattttctcaattttctaattaaaaaggtggcgtagaatagcatagattacatatattgagcaaacgtttgctatntat

SEQ ID NO: 595 - DNA, 600 bp, H. influenzae
  misc_feature (6)..(6): n is a, c, g, or t
  misc_feature (11)..(11): n is a, c, g, or t
  misc_feature (46)..(46): n is a, c, g, or t
ttatgngaccntgggacaagtccagtgaaaagttcttctcctttantcatatgtatatctccttcttaaatctagaggatcttcatcatctaaaactaatacgccagttccatgtttgaaagcattaattgcattaagtacgcgttcttcagcggtgttgccgaatggagataaaattgactgattcatagtaatttcctaatttgagatttcaattaaataccagaatcagggctgagaaatgcaaataaaatgaacgatttgggaacccaactcgttttattctctttcatccagactttactgtcggctttggaatttcaccaaatctgctgactttaaaagtgaaaatcaggacaatttcgcaggaaaaatttgccaaaaattgaccgcacttttaaacgctcgtgggctttaccaccggtagggaatttcaccctgccctgagaatgcgagctaagtataacgcaaaatacctaggcactaaatcagaacgtgaaaaatattttcatttagcctacaataaacacactcaattcttacgctatcaagagcagattatgtcaaaaacaaaagagaaaaaagtcggtgtcattttcg

SEQ ID NO: 596 - DNA, 600 bp, H. influenzae
  misc_feature (2)..(2): n is a, c, g, or t
  misc_feature (7)..(7): n is a, c, g, or t
  misc_feature (435)..(435): n is a, c, g, or t
  misc_feature (446)..(446): n is a, c, g, or t
  misc_feature (458)..(458): n is a, c, g, or t
  misc_feature (463)..(463): n is a, c, g, or t
  misc_feature (475)..(475): n is a, c, g, or t
  misc_feature (478)..(478): n is a, c, g, or t
  misc_feature (497)..(497): n is a, c, g, or t
  misc_feature (511)..(511): n is a, c, g, or t
  misc_feature (517)..(517): n is a, c, g, or t
  misc_feature (523)..(523): n is a, c, g, or t
  misc_feature (534)..(534): n is a, c, g, or t
  misc_feature (561)..(562): n is a, c, g, or t
  misc_feature (565)..(565): n is a, c, g, or t
  misc_feature (582)..(582): n is a, c, g, or t
  misc_feature (595)..(595): n is a, c, g, or t
  misc_feature (600)..(600): n is a, c, g, or t
tnacagnaattgggacaactccagtgaaaagttcttctcctttactcatatgtatatctccttcttaaatctagaggatctaagagatatttaatttcacgttctgtgtgatgaacaagactaagtaaatgtctatttttcatattgaaagccataataatctccttgtgttttgactatacattggggaataaacatacatcattcgagatactgcttgttgttcgaacagttgcattataagagaggtaaaatgaaatttgttgtcgtttttcaactggtaatgccagtatgtagaattttattgcgagatttttagtattattagaatttaataaaaataatctaactctttattgttatttgtttgatttctaatagtagatgaatttaaacgaaaatatgttttagtttatttttgatgaagaggaatgngtctatctatncttaataaaagngcggntatttttattgnagnttttaatatattgatcctntagagagcgacccncacgcntgcgcncttggggcgancatggggcatatagttgttccctgtgnnaangtgttatccgttcacanttccccacaaaanacgan

SEQ ID NO: 597 - DNA, 600 bp, H. influenzae
  misc_feature (6)..(6): n is a, c, g, or t
  misc_feature (394)..(394): n is a, c, g, or t
  misc_feature (442)..(442): n is a, c, g, or t
  misc_feature (451)..(451): n is a, c, g, or t
  misc_feature (480)..(480): n is a, c, g, or t
  misc_feature (493)..(493): n is a, c, g, or t
  misc_feature (498)..(498): n is a, c, g, or t
  misc_feature (506)..(506): n is a, c, g, or t
  misc_feature (508)..(508): n is a, c, g, or t
  misc_feature (512)..(512): n is a, c, g, or t
  misc_feature (515)..(515): n is a, c, g, or t
  misc_feature (521)..(521): n is a, c, g, or t
  misc_feature (553)..(553): n is a, c, g, or t
  misc_feature (578)..(579): n is a, c, g, or t
aacagnattgggacaactccagtgaaaagttcttctcctttactcatatgtatatctccttcttaaatctagaggatcagtacgagtccagtctaaaacaggcataaaattgtaacaaacagtgtcaattccgcattgagcaagcattgcgagagagtttgtttatagttattaatccatttttgataatttccagtactgagttttaatctcttcatgaactggtacactttccactactgaccagcttaaaccagcattctctatttcagttttgcagttttttaatttcttcgatactccacacttcaccgttaggaatatggtgaagtgcagtgactataccagttgcgcctgcttgacgaatatcagataaagaaacaggatcctctanagtcgacctgcaggcatgcaagcttggcgtaatcatggtcatagctgnttcctgtgngaaactggtatccgctcacaattccaccnaacatacgagccngaagncataaagngntaanccntggggngcctaatgagtgagctaactcacattaattgngttgggcttactgcccgttttcagnngggaaacctggcgcgccagct

SEQ ID NO: 598 - DNA, 600 bp, H. influenzae
  misc_feature (2)..(2): n is a, c, g, or t
  misc_feature (8)..(8): n is a, c, g, or t
tnacaagnaattgggacaactccagtgaaaagttcttctcctttactcatatgtatatctccttcttaaatctagaggatcaacctcgtaacttagcaaaatcagttaccgttgaataaagtgcggttgattttaatgtaataaaaaaaacggtgaaatttcaccgtatttttttagttaaataatcttctttgtttccgtgttttaatcacttgtgcgattaacaataatgtgagaataaccacatatagtgaaaaaataaccactagccattgcaccatcgttaaaccaaataatgaccattggctttcattacaagagccagttgggttaaatataaatggaaaccattgatgaaatggtaaagtctcgggaaaatttggaataaactcacattgtttccaaggagctggattcatttgcaaatcaagatgacgaaatgaaatcaataagcccttaatactgctgaataaacctaaagccaaggcgattaatcgaagtatgaaagcaagaggttgaagtaatgcaataatgcccgctacaaataagccaatcattgctaaacgttcataaacacagagcacacaaggttgtaagccc

SEQ ID NO: 599 - DNA, 600 bp, H. influenzae
  misc_feature (1)..(1): n is a, c, g, or t
nacaagattgggacaactccagtgaaaagttcttctcctttactcatatgtatatctccttcttaaatctagaggatcgcccgccagcaccccaggggaggaggacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtaggggctaattacattagccccgatatttcaccaataattgggcaaatgtaatttgcccctacgattaacgaaccaaagatgcaggttcttccacattcttcaacaacgcatatttttcgatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcatt

SEQ ID NO: 600 - DNA, 600 bp, H. influenzae
  misc_feature (3)..(3): n is a, c, g, or t
  misc_feature (9)..(9): n is a, c, g, or t
  misc_feature (495)..(495): n is a, c, g, or t
  misc_feature (498)..(498): n is a, c, g, or t
  misc_feature (538)..(538): n is a, c, g, or t
  misc_feature (600)..(600): n is a, c, g, or t
tanacaagnaattgggacaactccagtgaaaagttcttctcctttactcatatgtatatctccttcttaaatctagaggatccaatctcaatacgtattacttgcccattactatttaaaatcggtagccattcattgtgcgttttagaacggataaccgtgaaatatttgctgtgtgatggtttcgttagaaaaatattacgattaagcactacatccgcatcaataacataacaatcactaaagaagtcttgtgccagagaaaaggaataaatgctgttatattcgcgatatttttcgttgtaaatcaaggtgcagtcatattttttctttagatactcgaattgttcgtgtaaataccctgtaacaatgacaatattgtcgatatttgcttgacgtagaaaagtgagtgtccgttctaagttaggtgtgccgtgaatatctaacaatgatttatgtgtgctttgtgtgatgtctttaaaacgaccggcttantcntgcagctaaaataatcgcattcatttttgttcccctttgnaaaaaagtgtaccgatcctctagagtcgacctgcaggcatgcaagcttggcgtaatcatggn

SEQ ID NO: 601 - DNA, 600 bp, H. influenzae
  misc_feature (2)..(2): n is a, c, g, or t
  misc_feature (9)..(9): n is a, c, g, or t
tnacaaganttgggacaactccagtgaaaagttcttctcctttactcatatgtatatctccttcttaaatctagaggatcgctcattcgagagacacctccaacagcacgaatatctgcaggaattcgttccaaagccatcactgcagctgcaccagcagcttctgcaatgcgagcttgttcagggttttgaacatccatgataacaccacctttgagcatctgtgctaagtttttatttagttcataacgattttcagccatttctttgtcctcattatttggttatttgtattgatagctacgttttttattgtaatgtagaaaagtctttagaacaagtttgaaaaaatgcgtatatattaaaaggcataatgtctagtgtgcttaatttcagttttttgtataaacgaagtgtagaacgtcagaaggattgtccaatttaataatagaaaaaagagctactttagctgaaagaatttcgtccttaagtgccacaatagttattaaaaaaaccttgaaatgtttttaaaaacctttttctatgtggttagattttctgaaatttaagaaaaagcttgaaagggagtttacgctttcc

SEQ ID NO: 602 - DNA, 600 bp, H. influenzae
  misc_feature (3)..(3): n is a, c, g, or t
  misc_feature (544)..(544): n is a, c, g, or t
  misc_feature (561)..(561): n is a, c, g, or t
ttnacaaggaatcgggacaactagcagtgaaaagttcttctcctttactacatatgtatatctccttcttaaatctagaggatctgcaaaattgttgcaaccactaatacgatggctgcttcacgtacaccaccgagtttgtaagtgataaaaaataaaattaaagggataaagtcaaggagttgtttcatattgattaatccttcataaataagctgtagaaacgataagtcactactagcatgaaaatattaagtaatgcggtgaaaatgcctattaccatatcaaatatagcattattggaaaatgcgcttaattggaaaataagaattggcacgagaaaataaaccagtagggtgtaaataaacaatacgccttttcgagtatttcctcgcatccaaatttttcggatagtttgcgaaagtgcctcttgagtagaaagataatgtactaccgttaaattttaaacggacaaagaaccaaacgccaacaagcatcgcgataagtgacataatagagggcgatttttttgtgagtaatgcancaaaggcttcaccaagnaccagtaacattggtgcaaccattaatagatcctcttag

SEQ ID NO: 603 - DNA, 600 bp, H. influenzae
  misc_feature (1)..(1): n is a, c, g, or t
  misc_feature (8)..(8): n is a, c, g, or t
nacaaganttgggacaactccagtgaaaagttcttctcctttactcatatgtatatctccttcttaaatctagaggatccttgaaacatcacctcagatttaatcaatctgtggattctatccaagaaaagtaccacgaaattttctctttcctcattacctataatggtttgaaaatagagtttagctattgatggctcagtaaattcctgtgcaccttggtaaaagggcttttcttccatcactttagttaaaataacctgtgcctgttctaaaatagcttgttgttgctcgtttaatttaaacattcgatattccttctaaaatagggaatatcgcccataagggatatatcccctatgggtaaggtgcgaaaagaatgcttatcgcacattaaagttaatgttattaatcagaagtttttaaactgtcgataatctgtttaatttttgctgcaaattctaaatcgtgctcagattcatcatctatacaatattccaaataattactcatatcagcaattagtgcttcttttgttggcgaaggttggaacataattgatcctctagagtcgacctgcaggcatgcaagcttggcgta

SEQ ID NO: 604 - DNA, 600 bp, H. influenzae
  misc_feature (9)..(9): n is a, c, g, or t
  misc_feature (570)..(570): n is a, c, g, or t
  misc_feature (577)..(577): n is a, c, g, or t
  misc_feature (581)..(581): n is a, c, g, or t
  misc_feature (586)..(586): n is a, c, g, or t
  misc_feature (597)..(597): n is a, c, g, or t
  misc_feature (599)..(599): n is a, c, g, or t
ttaacaagnaattgggacaactccagtgaaaagttcttctcctttactcatatgtatatctccttcttaaatctagaggatcggcttctaacatttcgccgtctaaacgttcgttgttataaattgcaatcgccagcaggaaaaccaagcgttcggtaggtaaattcaaagaaaactcgcgatcttttgcccaagagacgagttcaggaatagtttgggatgtttcaatcattgaattgcaaagcgttaaaattgaacaaaaaattggaaagattatacaggattttttgcggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagataccggnctccatngganaaacngtcccagggtntnt

SEQ ID NO: 605 - DNA, 600 bp, H. influenzae
  misc_feature (7)..(7): n is a, c, g, or t
  misc_feature (561)..(561): n is a, c, g, or t
  misc_feature (572)..(572): n is a, c, g, or t
taacagnattgggacaactccagtgaaaagttcttctcctttactcatatgtatatctccttcttaaatctagaggatccacgtaatcagaattttctgcagaagatggcgatgccgcaccaccgtgatggcggcgaattaaatctaactccgccaaaatattcaaatcacgacgaatcgtttgagggctaacatctaaggcagcaaccaattcttccgtgcttaaatagccagattgttccaccagtttaataattttttgatggcgtaacgattgtttcatagcgaatcctttatccaaattaaacggacttactctagcgaatttttgcgcaatttgctatcaataaatccccaaatcaagccgacaatcaagcctgaaatatgtgcagcatttcccatttcaacaccaaataaggggctaataaaacctaatgcgatcctctagagtcgacctgcaggcatgcaagcttggcgtaatcatggtcatagctgtttcctgtgtgaaattgttatccgctcacaattccacacaacatacgagccggaagcataaagtgnaagcctggggngcctaagggtgagctaactcacattatt

SEQ ID NO: 606 - DNA, 600 bp, H. influenzae
  misc_feature (580)..(580): n is a, c, g, or t
taacaagaattgggacaactccagtgaaaagttcttctcctttactcatatgtatatctccttcttaaatctagaggatcaccattttcaagagattgagaaataaactctaaaatatcttttaccatattttcaatttcttttgcagataaagttggctgttttgctgacaatttttccataagttctgacttagtcatcctctatacttccttaatattatttaaattaagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagataccggcctccatcggagaaactgtccgaggttatgttgacctgcaggggggggggggcccctgaggtctgcctcgngaagaaggggttgctgactc

SEQ ID NO: 607 - DNA, 600 bp, H. influenzae
  misc_feature (1)..(1): n is a, c, g, or t
  misc_feature (6)..(7): n is a, c, g, or t
  misc_feature (378)..(380): n is a, c, g, or t
  misc_feature (402)..(402): n is a, c, g, or t
  misc_feature (405)..(405): n is a, c, g, or t
  misc_feature (407)..(407): n is a, c, g, or t
  misc_feature (411)..(412): n is a, c, g, or t
  misc_feature (430)..(433): n is a, c, g, or t
  misc_feature (439)..(439): n is a, c, g, or t
  misc_feature (445)..(445): n is a, c, g, or t
  misc_feature (452)..(452): n is a, c, g, or t
  misc_feature (455)..(455): n is a, c, g, or t
  misc_feature (459)..(459): n is a, c, g, or t
  misc_feature (481)..(481): n is a, c, g, or t
  misc_feature (486)..(486): n is a, c, g, or t
  misc_feature (492)..(492): n is a, c, g, or t
  misc_feature (503)..(503): n is a, c, g, or t
  misc_feature (512)..(512): n is a, c, g, or t
  misc_feature (519)..(519): n is a, c, g, or t
  misc_feature (529)..(529): n is a, c, g, or t
  misc_feature (537)..(537): n is a, c, g, or t
  misc_feature (539)..(539): n is a, c, g, or t
  misc_feature (544)..(544): n is a, c, g, or t
  misc_feature (546)..(546): n is a, c, g, or t
  misc_feature (548)..(548): n is a, c, g, or t
  misc_feature (552)..(552): n is a, c, g, or t
  misc_feature (561)..(561): n is a, c, g, or t
  misc_feature (576)..(576): n is a, c, g, or t
  misc_feature (579)..(579): n is a, c, g, or t
  misc_feature (582)..(582): n is a, c, g, or t
  misc_feature (584)..(584): n is a, c, g, or t
  misc_feature (597)..(597): n is a, c, g, or t
nacagnnttgggacaactccagtgaaaagttcttctcctttactcatatgtatatctccttcttaaatctagaggatcaacatctaagacaagattttttaatggactactggtattgggaacacttaattcatttggtaagcaatagaccatttccatttttgtattacgagtgcgaaccgcaccaaatttgctgagcattctcgatatttttgattgattaataccagtaaagccttgtttttttaaggcatcgacaatttcattttgagaaccaaagcgttcttgattgagtaattctttaaaagcacgagttaaattgtcagtcatctttattttttaatagtcaaaatttgcataagaattgcataaaaattnnnctttcatcaactggaatatggnttngnaccnnggggaagaaatttttttnnnnaaaatnggaacnagatccnttnaagncaacctgcaggcatgcaagctnggcgnaatcanggcatagctgnttcctgggnaaattgntatccgttanaattcccncnacatncnanccgnagcataagngaaagcctgggggcntangangnggctacccccatnatt

SEQ ID NO: 608 - DNA, 600 bp, H. influenzae
  misc_feature (454)..(454): n is a, c, g, or t
  misc_feature (459)..(459): n is a, c, g, or t
  misc_feature (517)..(517): n is a, c, g, or t
  misc_feature (523)..(523): n is a, c, g, or t
  misc_feature (542)..(543): n is a, c, g, or t
  misc_feature (550)..(550): n is a, c, g, or t
  misc_feature (566)..(566): n is a, c, g, or t
  misc_feature (576)..(576): n is a, c, g, or t
  misc_feature (588)..(589): n is a, c, g, or t
  misc_feature (592)..(592): n is a, c, g, or t
  misc_feature (595)..(595): n is a, c, g, or t
  misc_feature (599)..(599): n is a, c, g, or t
tttaacaaggaatccgggcacaactaccagtgaaaagttctctctcctttactcatatgtatatctccttcttaaatctagaggatcctttatcgctgtggagaacttcaaattgtactttttgacctgcttttaatgaacgatagccgtccatttcaatcactgaataatgtgcaaaaatatcggcatctacaccttctgcggaaatgaaaccaaatccttttgcattattgaaccattttacaataccaatttccataaaagacctctctaggcttagcctattaaaacaataaatcaacaagactctcgccttatcacctactaattaggtccgttatgtttaaatattttgaacggttatgcaacgagcaatattcaaaaatgataagtagatcctctagagtcgacctgcaggcatgcaagcttggcgtaatcatggtcatagctgttncctgngtgaaattgttatccgctcacaattccacacaacatacgagccggaagcataaagtgntaagcntggggtgcctaatgagtgnnctaactnacataaattgagttangctcactgcnccgttttccagnnggnganaccng

SEQ ID NO: 609 - DNA, 600 bp, H. influenzae
taacagcattgggacaactccagtgaaaagttcttctcctttactcatatgtatatctccttcttaaatctagaggatctattacagaaccatcatttccccaaatcaagaatagctttgatgaaaataagtaaaatcggtaagacaataggaatactcacgacatagcccgtaatggctaatgcccattcttcctttttcttacctagaaatttgataaaactgaacgccattttttcagcaactgggcagattgaagtttcaccatgtaaaggttctcgaataatgctacttacaaaggaagaagtcgctttatttggttttcctggacggatacaaattgtgagcaggcgaacacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaaataaaacgaattttagtatcagattcatcaaaatatgagaaagtggcgacattccatatttgtccactaacaaattttgatcctcta

SEQ ID NO: 610 - DNA, 600 bp, H. influenzae
  misc_feature (3)..(4): n is a, c, g, or t
  misc_feature (10)..(10): n is a, c, g, or t
  misc_feature (294)..(294): n is a, c, g, or t
  misc_feature (370)..(370): n is a, c, g, or t
  misc_feature (387)..(387): n is a, c, g, or t
  misc_feature (481)..(482): n is a, c, g, or t
  misc_feature (489)..(489): n is a, c, g, or t
  misc_feature (492)..(493): n is a, c, g, or t
  misc_feature (501)..(501): n is a, c, g, or t
  misc_feature (503)..(503): n is a, c, g, or t
  misc_feature (519)..(519): n is a, c, g, or t
  misc_feature (523)..(523): n is a, c, g, or t
  misc_feature (532)..(532): n is a, c, g, or t
  misc_feature (544)..(544): n is a, c, g, or t
  misc_feature (549)..(549): n is a, c, g, or t
  misc_feature (551)..(551): n is a, c, g, or t
  misc_feature (565)..(565): n is a, c, g, or t
  misc_feature (567)..(567): n is a, c, g, or t
  misc_feature (574)..(574): n is a, c, g, or t
  misc_feature (585)..(585): n is a, c, g, or t
  misc_feature (587)..(587): n is a, c, g, or t
  misc_feature (592)..(592): n is a, c, g, or t
ttnnacaagnaattgggacaactccagtgaaaagttcttctcctttactcatatgtatatctccttcttaaatctagaggatcatcaagataatcaagtacatattgttcaatttgaggaatgcgatttagacttggcaacatagtatttaactcatttaaaggtaaaaatggcaggttattgataatatcttaaggcgttaatgatgtcgaattagattttgagcatttttaaggagtgttttatggagtaaatgagtcaagaaaagtgtgttgtttggatgaaaaataaacnaaaaattcaaaagaatttgatcctctagagtcgacctgcaggcatgcaagcttggcgtaatcatggtcatagctgnttcctgtgtgaaattgntatccgctcacaattccacacaacatacgagccggaagcataaagtgtaaagcctggggtgcctaatgagtgagctaactcacattaattgcgnngcgctcnctnncccctttncncaggggaaaaccctgncgcnccagctgcntttaatgaatcngcccncncgcggggaggggcngnttgcgtnttgggcgccanancccgnctccatcg

SEQ ID NO: 611 - DNA, 600 bp, H. influenzae
  misc_feature (1)..(1): n is a, c, g, or t
  misc_feature (7)..(7): n is a, c, g, or t
  misc_feature (555)..(555): n is a, c, g, or t
  misc_feature (571)..(571): n is a, c, g, or t
nacaagnaattgggacaactccagtgaaaagttcttctcctttactcatatgtatatctccttcttaaatctagaggatcgtcatctttacgatatttttcatcaattcgtttttgcaatccaaagtcatttttatccgattcgttagaaaataaatcttctgtttgcgttaattgaggattttgaattcctatccaatttgcaatcccttctaagaaatttaaacctgatttaaacaccttatattctttgcgttccatatcatctgatgaaattttgaatagcggaatattatggtgctctcggctgaaacagttttgattgaacaaaagtatattgtttttttcatcttgttggtggcacaaaccgtgatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgntttccagtcgggaaancctgtcgtgccagctgcattaatgaatcg

SEQ ID NO: 612 - DNA, 600 bp, H. influenzae
  misc_feature (4)..(5): n is a, c, g, or t
  misc_feature (11)..(11): n is a, c, g, or t
  misc_feature (456)..(456): n is a, c, g, or t
attnnacaagnaattgggcacaactccagtgaaaagttcttctcctttactcatatgtatatctccttcttaaatctagaggatcatctttgataataagctgtaattttggttgaaaacctgaaatgctcatcccttgctgtttttggggtttcactgtaataaattcttggcgagaaaagggcaattcaggattaaaatgtttattgcctgtaagatagtgtaaaccttttgtgctgtaaccagaatgaacttcattttttttcaatggctttaataaaatacgacaaaaattcattgtttttcttcctgaatttgcactgcgcctaacatattttccccgttattaagtaaaaagcgaaacatatcgctttcatcaattcgttgatgaagtgcatatttgtgttttagccagccttctgggacgagggatgcaaaataagggaataaggtgtnagaatgaaaaggactttgctcaataggaaagctgagagagagcggtattccttgataatcgggattgtaagcaaaatgaaaacctcgatgatcctctagagtcgacctgcaggcatgcaagcttggcgtaatcatggtcatagc

SEQ ID NO: 613 - DNA, 600 bp, H. influenzae
  misc_feature (1)..(1): n is a, c, g, or t
  misc_feature (6)..(6): n is a, c, g, or t
  misc_feature (412)..(413): n is a, c, g, or t
  misc_feature (456)..(457): n is a, c, g, or t
  misc_feature (460)..(461): n is a, c, g, or t
  misc_feature (467)..(467): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (487)..(488): n is a, c, g, or t
  misc_feature (491)..(491): n is a, c, g, or t
  misc_feature (532)..(532): n is a, c, g, or t
  misc_feature (543)..(543): n is a, c, g, or t
  misc_feature (552)..(552): n is a, c, g, or t
  misc_feature (567)..(567): n is a, c, g, or t
  misc_feature (571)..(571): n is a, c, g, or t
  misc_feature (576)..(576): n is a, c, g, or t
  misc_feature (578)..(578): n is a, c, g, or t
nacagnattgggacaactccagtgaaaagttcttctcctttactcatatgtatatctccttcttaaatctagaggatcactgcattgagtaaacgactttgtgattcaatattattttcgagtgcagtcaggcgaaaataggtttcgattaaatacataaattttttaattgctgtctgatttggtttaagccgtttaaacgcatttcacttaaacgttgtgaaatgccgagttcgctaaaaaaggcaataatatcaaatgtattcaattcatccgctgttttgccattgatttgattgaataaaatccaaagcaagccattcataattctggcttcgctaaatccgctgaattgaaaagtgcggtcatgtttaggcataatttgaaaccacatttgtgcttcgcagccagnnaataggttgcatttgagcgagttcattatcgcttgggcgaggnnaannttttgnctncncnggaaaaatcaggnnatngcgatcctttagagtcgacctgcaggcatgcaagcttggcngtaatcatggncatagctgnttcctgggggaaatngttntccgntncaattccccacaacatacgagc

SEQ ID NO: 614 - DNA, 600 bp, H. influenzae
caagacttgggacaactccagtgaaaagttcttctcctttactcatatgtatatctccttcttaaatctagaggatctacagttggttctgtaaacatcccagaaccgattaaaataaaataacccgcgaatgcggcacaaatcaccgcaaaaagtgcgggcaaaatttggcttgtttttttcgtgttcatcattgtcttccctgaaaagaaaatatcgctattatccacctttcactcagaatttccatatttaacttcttcactcttgagcggttattttatagaataagccaatttttttaagccagaaggaaaaaacaatgagccaaccaatttataaacgtattttattgaaattaagcggtgaagcattacaaggagaagatggtcttggtatcgatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaa

SEQ ID NO: 615 - DNA, 1089 bp, H. influenzae
atgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacaaattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcagatttggctagatgaagctggtgtaaatgaaatcaaaactggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccattggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgattcatttaaatgtcacgggtaataacgatcatcataaaatagagagcttatttaaagcctttgggagaacattaagacaggcgattcggattgaaggaaatgaaatgccaagttcaaaaggagttttatag

SEQ ID NO: 616 - protein, 362 aa, H. influenzae
MQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQIWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATIHLNVTGNNDHHKIESLFKAFGRTLRQAIRIEGNEMPSSKGVL

SEQ ID NO: 617 - DNA, 1695 bp, H. influenzae
atgttacgtctaaatctgagatttttatcttttctgctctgtataagccaaagtgtagaattacaggctgcgccaagtgttccaacatttttaactgaaaatggcttaacttattgcacccacgcttcaggtttttcatttaatccgcaaacagcagatgcaggaaccagtatgaatgtggtcacggaacaaatttataacaaattatttgatataaaaaatcacagtgcaacattaacaccaatgctggcacaatcttattccatttcagctgatggtaaagaaattttattaaatttacgtcacggcgtaaaatttcaccaaaccccttggtttaccccaacacgtgattttaacgctgaagacgtagtattttcgattaatcgtgtattagggcataatacttatttaccaaccttagcagaggcgaatgttacctatagtaatccacaatatagagtgtttcacgaacaagcaagaaaagtgcgttttccttattttgatagcattaaacttaacgaaaaaatcaaatctgtgaccgcactttcgccttatcaagtaaaaattgaattatttgcaccagattcctccattttgtcgcatcttgccagccagtatgccattattttttcacaagaatatgcctatcaattaagcgcagatgacaaccttgctcaattagatacccacccagtaggcacagggccttatcaagtaaaagattatgtatataaccaatatgttcgcttagtgcgtaacgaaaactattggaaaaaagaagccaagatagaacatattattgtggatctttctactgatcgcagcggacgtttagtcaaatttttcaataatgaatgtcaaatcgcctcttatcctgaagtaagccaaattggcttattaaaaaatgatgacaaacattattatatgcaatctactgatggtatgaatttagcctatttagcgtttaattttgataagccattaatgcgagatcacgaaatccgtgctgctatttcacaaagtttaaaccgagctcgaatcattcatagcatttaccataacacagcaactgttgctaataacattattcctgaagtgtcttgggcttcaactgtcaatacgccagaatttgagtttgattaccatcccaaaatcgccaaaaataaattagcagataaaaaccttttgttaaatttatgggtaattaatgaagaacaagtctataatccagcaccttttaaaatggctgaaatgatcaaatgggatttagctcaagcgggtgtgaaagttaaagtgcgtgccgtaactcgtccatttttaactgcacaattacgcaatcaatcggaaaattatgatttgattctatctggttggttagctggtaatcttgatcctgatggttttatgcgtccaattttaagctgtggaacaaaaaatgaactcactaatttatctaattggtgtaatgaagaatttgatcaatttatggatcgtgccattaccacctcacatttaagttcacgcgcaaaagcctataatgaagcccaagaactcgttttacgtgaattacccattattcctattgccaatgtaaaacgaattttagtcgcaaatagtcgtgtgaaaggagtaaaaatgacgccttttggtagcttagatttttccaccttatattttattcaggagaaacactaa

SEQ ID NO: 618 - protein, 564 aa, H. influenzae
MLRLNLRFLSFLLCISQSVELQAAPSVPTFLTENGLTYCTHASGFSFNPQTADAGTSMNVVTEQIYNKLFDIKNHSATLTPMLAQSYSISADGKEILLNLRHGVKFHQTPWFTPTRDFNAEDVVFSINRVLGHNTYLPTLAEANVTYSNPQYRVFHEQARKVRFPYFDSIKLNEKIKSVTALSPYQVKIELFAPDSSILSHLASQYAIIFSQEYAYQLSADDNLAQLDTHPVGTGPYQVKDYVYNQYVRLVRNENYWKKEAKIEHIIVDLSTDRSGRLVKFFNNECQIASYPEVSQIGLLKNDDKHYYMQSTDGMNLAYLAFNFDKPLMRDHEIRAAISQSLNRARIIHSIYHNTATVANNIIPEVSWASTVNTPEFEFDYHPKIAKNKLADKNLLLNLWVINEEQVYNPAPFKMAEMIKWDLAQAGVKVKVRAVTRPFLTAQLRNQSENYDLILSGWLAGNLDPDGFMRPILSCGTKNELTNLSNWCNEEFDQFMDRAITTSHLSSRAKAYNEAQELVLRELPIIPIANVKRILVANSRVKGVKMTPFGSLDFSTLYFIQEKH

SEQ ID NO: 619 - DNA, 972 bp, H. influenzae
atgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaa

SEQ ID NO: 620 - protein, 323 aa, H. influenzae
MMKNETSNFQIGRFLIEQRSFIALIILIAIVSMINPDFFSVDNILNILRQTSVNAIIAVGMTFVILIAGIDLSVGSVLALTGAIAASMVSIELPIFLVIPVVLLIGTLLGGISGVIVAKGKVQAFIATLVTMTLLRGITMVYTDGRPITTGFSDNADLFASIGTGYVLGIPVPIWIMSIVFAVAWYILKHTPIGRYIYALGGNEAATQLSGINVNKIKVFVFAVSGFLSALAGLIVTSRLSSAQPTAGVSYELDAIAAVVVGGTSLMGGKGRVMGTLIGALIIGFLNNALNLLDISSYYQMIAKALVILVAVLADNYLGTKKL

SEQ ID NO: 621 - DNA, 495 bp, H. influenzae
atgtcaaaaactgcacaaattgctgttgtgatgggttccaaaagcgattgggctaccatgcaagaggcaactcagattttagatgaattaaaagtaccttatcatgtggaaatcgtctctgctcatcgtacgcctgataaactttttgaatttgctgaaaatgcacaaaaaaatggctataaagtaattattgctggggctggcggtgcggcacatttacccggcatgatcgcagccaaaacccttgtgcctgtgctgggtgtgccagtaaaaagttctatgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcacataa

SEQ ID NO: 622 - protein, 164 aa, H. influenzae
MSKTAQIAVVMGSKSDWATMQEATQILDELKVPYHVEIVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELLSRLQSFRESQTSNVLDNPDPRT

SEQ ID NO: 623 - DNA, 648 bp, H. influenzae
atgaatcagtcaattttatctccattcggcaacaccgctgaagaacgcgtacttaatgcaattaatgctttcaaacatggaactggcgtattagttttagatgatgaagatcgtgaaaatgaaggcgatttaattttcccagcagaaacaatcacgtcagaacaaatggcaaaattaattcgttatggcagtggtatagtttgtttatgcattactgatgaacgttgccaacaactcgatttaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaa

SEQ ID NO: 624 - protein, 215 aa, H. influenzae
MNQSILSPFGNTAEERVLNAINAFKHGTGVLVLDDEDRENEGDLIFPAETITSEQMAKLIRYGSGIVCLCITDERCQQLDLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 625 - DNA, 1005 bp, H. influenzae
atggctttcaatatgaaaaatagacatttacttagtcttgttcatcacacagaacgtgaaattaaatatctcttagatctctcccgagatttgaaacgagccaaatatgccggcacagaacaacaaaaattaaaaggcaaaaatatcgcgctcatctttgaaaaaacctccacccgcacacgctgtgcatttgaagtcgccgcttatgatcaaggcgcacaagtcacctacatcgaccctaattcctctcaaattggccacaaagaaagtatgaaagataccgcccgcgtattaggcagaatgtatgatggtattgaatatcgtggctttaaacaaagtatcgttcaagaactggctgattatgctggagtgccagtattcaatggtttaaccgatgaattccacccaacacaaatgcttgccgacgtacttaccatgattgaacattgcgacaaaccattaagtgaaattagctatgtatatattggggatgctcgcaataacatgggtaattcacttttattaattggtgcaaaattaggtatggatgttcgtatttgtggacctaaagcattattaccagaagcaaatcttgtggaaatgtgcgaaaaatttgcgaaagaaagtggagctcgtattactgtaactgaagatatcgacaaagcggtgaaaggcgtagattttatccatactgatgtgtgggtttcaatgggtgaaccattagaaacctggggcgaacgcattaaattattacttccttatcaagtcacacctgaattaatgaaacgcactggtaatccaaaagtgaaatttatgcactgcctacctgccttccataacagcgaaaccaaagttggtcgtcaaattgctgaaaaatatcctgaattagctaatggtattgaagtaactgaagaggtatttgaatcgccaatgaacattgcatttgaacaagcagaaaaccgtatgcacacaattaaagcggtaatggtagcaagtttggcataa

SEQ ID NO: 626 - protein, 334 aa, H. influenzae
MAFNMKNRHLLSLVHHTEREIKYLLDLSRDLKRAKYAGTEQQKLKGKNIALIFEKTSTRTRCAFEVAAYDQGAQVTYIDPNSSQIGHKESMKDTARVLGRMYDGIEYRGFKQSIVQELADYAGVPVFNGLTDEFHPTQMLADVLTMIEHCDKPLSEISYVYIGDARNNMGNSLLLIGAKLGMDVRICGPKALLPEANLVEMCEKFAKESGARITVTEDIDKAVKGVDFIHTDVWVSMGEPLETWGERIKLLLPYQVTPELMKRTGNPKVKFMHCLPAFHNSETKVGRQIAEKYPELANGIEVTEEVFESPMNIAFEQAENRMHTIKAVMVASLA

SEQ ID NO: 627 - DNA, 1185 bp, H. influenzae
atggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaaacgcaaaactgaaatagagaatgctggtttaagctggtcagtagtggaaagtgtaccagttcatgaagagattaaaactcagactggaaattatcaaaaatggattaataactataaacaaactcttcgcaatcttgctcaatgcggaattgacactgtttgttacaattttatgcctgttttagactggactcgtactgatctcgcttatgaattaccagatggttctaaagcattgcgctttgatcatatcgctttcgcagcatttgaacttcatattttaaaacgtcctgatgcagaaaaagcctataatcaagaagaacaagttgcagcaagaacctattatgacaagatgtcagagcaagatataacgcaattaacgcgtaatattattgcgggcttacccggtgcagaagaaggttatactcttgatgaatttcaaactcaattagatcgctataaagatatttcacccgaaaaattccgtacgcatttggcttattttttaaatgagatcgtacctgttgcccaagaagtaggaatcaaaatggcgattcatccagatgatcctccacgcccaatcttaggcttaccgcgcatagtttcaactattgaagatatgcaatggtttgtagaaactcaaccattaccagcaaatggttttacaatgtgtacgggttcttatggcgtacgctccgataatgatctcgtaaaaatgacagaacaatttgcagatcgtatttacttcgcacatttacgttctactcaacgtgaagataatccactaaccttccatgaagcagctcatctagaaggagacgtagatatgtttaatgtggtaaaagccttattaaatgaagaatatcgtcgattaaatcaaggagaaacgcgtttaatcccaatgcgcccagatcatgggcatcaaatgttggatgacttacgtaaaaaaaccaaccctggctactctgccattggtcggttaaaaggtctagctgaatttcgcggtttagagatggcactaaaaaaagtgtatttcaataagtaa

SEQ ID NO: 628 - protein, 394 aa, H. influenzae
MEQAWRWYGPKDPVSLSDIRQAGATGIVTALHHIPNGEVWSIEEIKKRKTEIENAGLSWSVVESVPVHEEIKTQTGNYQKWINNYKQTLRNLAQCGIDTVCYNFMPVLDWTRTDLAYELPDGSKALRFDHIAFAAFELHILKRPDAEKAYNQEEQVAARTYYDKMSEQDITQLTRNIIAGLPGAEEGYTLDEFQTQLDRYKDISPEKFRTHLAYFLNEIVPVAQEVGIKMAIHPDDPPRPILGLPRIVSTIEDMQWFVETQPLPANGFTMCTGSYGVRSDNDLVKMTEQFADRIYFAHLRSTQREDNPLTFHEAAHLEGDVDMFNVVKALLNEEYRRLNQGETRLIPMRPDHGHQMLDDLRKKTNPGYSAIGRLKGLAEFRGLEMALKKVYFNK

SEQ ID NO: 629 - DNA, 534 bp, H. influenzae
atgctcgcgctattaaaacaattttccgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcattattgcattacttcaacctcttgctttcatacttcgattaatcgccttggctttaggtttattcagcagtattaagggcttattgatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaactaa

SEQ ID NO: 630 - protein, 177 aa, H. influenzae
MLALLKQFSEKRFVWFLLAFSSLALESTALYFQYGMGLQPCVLCVYERLAMIGLFVAGIIALLQPLAFILRLIALALGLFSSIKGLLISFRHLDLQMNPAPWKQCEFIPNFPETLPFHQWFPFIFNPTGSCNESQWSLFGLTMVQWLVVIFSLYVVILTLLLIAQVIKTRKQRRLFN

SEQ ID NO: 631 - DNA, 816 bp, H. influenzae
atgaacagcaaattatccctttccaccaaactttcctccagcggtaaaacccagcttgctgaatactttgcgacgccaccgtttaaagtgataacgttgccaagttacgatgatgcgtgggcgaatggcttgaatgcgatgcagatgtcctcctcccctggggtgctggcgggcgatctgttagagattgatatttcgttggcaaaattgaccgcactttctttaaatacgcaggcatttactcgggtgcaggcgatgaatgaaggcgacagtgcgatgcaaacaacccatattttgcttgcggaaaacagtcgtttattctatttgccgcatccgttggtgttacataaagattccgtttttaagcagcaaacccagattgaaatgggcgaacaaagcgagctgatttacggtgaaatcgtggcgattgggcgggtgttgaatgatgaacgttttgccttccgccagttttcttcccatttgaagatttatactttgaaagacgatggcaaaaaacgaccgcttgtcagtgattgtatccagtggctgccgtctaaaatgaatcttaccgctttgagtcagatggaaaattattcccatcaaggttcgctgacttatctaaatttggcgaaaaataatgcggaaatcaaacaacaggtgcaagccttgcagcaacaaagtacggaagaaaaagatctactgataggcatatcacaactcaatgaatatggtttaatggtgcgggtactcgggtgtcgtgcagagcaaattcagaaattatttgagaaaattggtaggctattgaaatctgtgtaa

SEQ ID NO: 632 - protein, 271 aa, H. influenzae
MNSKLSLSTKLSSSGKTQLAEYFATPPFKVITLPSYDDAWANGLNAMQMSSSPGVLAGDLLEIDISLAKLTALSLNTQAFTRVQAMNEGDSAMQTTHILLAENSRLFYLPHPLVLHKDSVFKQQTQIEMGEQSELIYGEIVAIGRVLNDERFAFRQFSSHLKIYTLKDDGKKRPLVSDCIQWLPSKMNLTALSQMENYSHQGSLTYLNLAKNNAEIKQQVQALQQQSTEEKDLLIGISQLNEYGLMVRVLGCRAEQIQKLFEKIGRLLKSV

SEQ ID NO: 633 - DNA, 702 bp, H. influenzae
atgaatgcgattattttagctgcaggattaggcagtcgttttaaagacatcacacaaagcacacataaatcattgttagatattcacggcacacctaacttagaacggacactcacttttctacgtcaagcaaatatcgacaatattgtcattgttacagggtatttacacgaacaattcgagtatctaaagaaaaaatatgactgcaccttgatttacaacgaaaaatatcgcgaatataacagcatttattccttttctctggcacaagacttctttagtgattgttatgttattgatgcggatgtagtgcttaatcgtaatatttttctaacgaaaccatcacacagcaaatatttcacggttatccgttctaaaacgcacaatgaatggctaccgattttaaatagtaatgggcaagtaatacgtattgagattggatcattaaaccagtctagcttgtcaggggtatcttattggacaactcgggattgcgatatcattctaactttgctcaaagaatacacaagtgaagtgcggttaaaaaatccaaaactttattgggataccattccgatggaatatatagagaaattaaatatctatacggaacaacttaacagtgatgatatatttgaaatggataaccttgatgactatcaccacattttacaaaaattgacaccaaacaaggaaaaataa

SEQ ID NO: 634 - protein, 233 aa, H. influenzae
MNAIILAAGLGSRFKDITQSTHKSLLDIHGTPNLERTLTFLRQANIDNIVIVTGYLHEQFEYLKKKYDCTLIYNEKYREYNSIYSFSLAQDFFSDCYVIDADVVLNRNIFLTKPSHSKYFTVIRSKTHNEWLPILNSNGQVIRIEIGSLNQSSLSGVSYWTTRDCDIILTLLKEYTSEVRLKNPKLYWDTIPMEYIEKLNIYTEQLNSDDIFEMDNLDDYHHILQKLTPNKEK

SEQ ID NO: 635 - DNA, 876 bp, H. influenzae
atggctgaaaatcgttatgaactaaataaaaacttagcacagatgctcaaaggtggtgttatcatggatgttcaaaaccctgaacaagctcgcattgcagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaataa

SEQ ID NO: 636 - protein, 291 aa, H. influenzae
MAENRYELNKNLAQMLKGGVIMDVQNPEQARIAEAAGAAAVMALERIPADIRAVGGVSRMSDPKMIKEIQGAVSIPVMAKVRIGHFVEAQILEAIEIDYIDESEVLSPADNRFHVDKKEFQVPFVCGAKDLGEALRRIAEGASMIRTKGEPGTGDIVQAVRHMRMMSQEIRRIQNLREDELYVAAKDLQVPVELVQYVHKHGKLPVVNFAAGGIATPADAALMMQLGAEGVFVGSGIFKSGDPIKRASAIVKAVTNYRNPQILAQISEDLGEAMVGINENEIQILMAERGK

SEQ ID NO: 637 - DNA, 558 bp, H. influenzae
atgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataa

SEQ ID NO: 638 - protein, 185 aa, H. influenzae
MKQLLDFIPLILFFITYKLGGVREAAIVLVVATILQIVILKWKYGIVEKQQKIMASAVVFFGLLTAYFNEIRYLQWKVTIINGLFAIVLLVAQFQFKTPLIKKLLGKELQLPEKAWNTLNLGWALFFIICMLVNIYISHNMSEEAWVDFKSFGIIGMTVIATIISGVYIYRYLPKDGSNSKDGEK

SEQ ID NO: 639 - DNA, 666 bp, H. influenzae
atggaaaacaatgatgaattaatgccacgggaaaaattgctggcattcggagcaaaagcattaagtgattatgaactacttgcgatttttttacgtactggtatcaaagattgtcctgttatgtcactttctaaaaatgtattaacgcattttggctccttgcacgctttactttccgcagataaaaaagctttctgttctgtaaaaggcttaggtattacgcaatttattcaactgcaagcgattacggaaatgaccaagcgttatttaaagcaagagatgttaagtacgccgattattaatgatcttgaaacggtaaaactttttttactcactgaattgcaacacgaggaaagagaagtatttatggttttatttttagataatcaacatcgtttgattaaaaaagagcggttatttttaggtacaattaatgtatcagcggtttatccgcgagaaattattaaagaagcactctattgtaatgcggcagctttaattttggcacataatcatccttcaggtataacggagccgagttattcggatcaacttattactaaaaaaattcaagatgcggctgaactaatggaaattcgcgtgcttgatcatttaattgtagggaaaagcgattgttattctttcgcggagaattgtttattataa

SEQ ID NO: 640 - protein, 221 aa, H. influenzae
MENNDELMPREKLLAFGAKALSDYELLAIFLRTGIKDCPVMSLSKNVLTHFGSLHALLSADKKAFCSVKGLGITQFIQLQAITEMTKRYLKQEMLSTPIINDLETVKLFLLTELQHEEREVFMVLFLDNQHRLIKKERLFLGTINVSAVYPREIIKEALYCNAAALILAHNHPSGITEPSYSDQLITKKIQDAAELMEIRVLDHLIVGKSDCYSFAENCLL

SEQ ID NO: 641 - DNA, 1335 bp, H. influenzae
atgattgaaacatcccaaactattcctgaactcgtctcttgggcaaaagatcgcgagttttctttgaatttacctaccgaacgcttggttttcctgctggcgattgcaatttataacaacgaacgtttagacggcgaaatgttagaagccgatcttgtggatattttccgccacacgatgaatgcttttgagcaatccaccgatgccattgcaacacgagcgaataatgcaattaatgaattagtgaaacaacgtttgttaaatcgttttagtagcgaatttactgagggcttggcgatttatcgtttaacaccattaggtgttggtgtgtctgattattacattcgtcagcgtgaattttccgcattgcgtctttcagtgcaactttccattgtggcagatgaaattcaacgtgcttctgattctgcggaagagggtgtggagaataatgaaagtgaacattattggcgtcgtaatgtgtttgcgccattaaaatattccgttgcagagatttttgatagcatcgatctttcacaacgtattatggatgaaaatcagcaaagtattaaagatgaaattgcagagcttcttactaaagattggcaagcggcaatttcaagctgtgaacgtttattagatgaaacatctgggaatttgcgtgaattgcaagatacgctaaatgccgcaggggataaacttcaagcgcaattattgcgtattcaagattgtgtgattgggcgagatgatttgtattttatcgatcagttgattacggatttgcaatccaaactagaccgtattattagctggggacaacaagccattgatttatggattggttatgaccgccatgtacataaatttatccgaactgccattgatatggataaaaatcgtgtgttctcacaacgtttacgtaattctattcatcattattttgagcatccttggttcttatggacagcgcaagctgagcgtttagtcgatctgcgtgatgaagaaatggtgttgcgtgaagatgatgctttaggtgaattaccagaagaattgcaatacgaatccctttctgatttacacgatcaaattgtagagcatatgcaaggcttactgattgcttatcgtgaaaataaccgtccgattgatttgagtttagtgttaaaagaacaactggaaaattatccactttctcgtcattttgatgtggctcgaatcattgttgatcaagcagtacgccttggtatggcgaatgatgatttatcgggtatttatccagattggcaagcaattaataaacgtggtgctgaagtgcaagcgcatgtgattgataagtattaa

SEQ ID NO: 642 - protein, 444 aa, H. influenzae
MIETSQTIPELVSWAKDREFSLNLPTERLVFLLAIAIYNNERLDGEMLEADLVDIFRHTMNAFEQSTDAIATRANNAINELVKQRLLNRFSSEFTEGLAIYRLTPLGVGVSDYYIRQREFSALRLSVQLSIVADEIQRASDSAEEGVENNESEHYWRRNVFAPLKYSVAEIFDSIDLSQRIMDENQQSIKDEIAELLTKDWQAAISSCERLLDETSGNLRELQDTLNAAGDKLQAQLLRIQDCVIGRDDLYFIDQLITDLQSKLDRIISWGQQAIDLWIGYDRHVHKFIRTAIDMDKNRVFSQRLRNSIHHYFEHPWFLWTAQAERLVDLRDEEMVLREDDALGELPEELQYESLSDLHDQIVEHMQGLLIAYRENNRPIDLSLVLKEQLENYPLSRHFDVARIIVDQAVRLGMANDDLSGIYPDWQAINKRGAEVQAHVIDKY

SEQ ID NO: 643 - DNA, 768 bp, H. influenzae
atgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaggaagttgcaaagttgattcctaacggtgcatcgttgtttattgatattggtacgacgccagaggctgttgccaatgcgttgcttggccacgaaaaactcagaattgtgacgaacaatctgaatgccgctcatcttttacgccaaaatgaaagttttgatattgttatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaa

SEQ ID NO: 644 - protein, 255 aa, H. influenzae
MKQSLRHQKIIKLVEQSGYLSTEELVAALDVSPQTIRRDLNILAELDLIRRHHGGAASPSSAENSDYVDRKQFFSLQKNNIAQEVAKLIPNGASLFIDIGTTPEAVANALLGHEKLRIVTNNLNAAHLLRQNESFDIVMAGGSLRMDGGIIGEATVNFISQFRLDFGILGISAIDADGSLLDYDYHEVQVKRAIIESSRQTLLVADHSKFTRQAIVRLGELSDVEYLFTGDVPEGIVNYLKEQKTKLVLCNGKVR

SEQ ID NO: 645 - DNA, 285 bp, H. influenzae
atgactaagtcagaacttatggaaaaattgtcagcaaaacagccaactttatctgcaaaagaaattgaaaatatggtaaaagatattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctagagtggatgttcaggcttaa

SEQ ID NO: 646 - protein, 94 aa, H. influenzae
MTKSELMEKLSAKQPTLSAKEIENMVKDILEFISQSLENGDRVEVRGFGSFSLHHRQPRLGRNPKTGDSVNLSAKSVPYFKAGKELKARVDVQA

SEQ ID NO: 647 - DNA, 456 bp, H. influenzae
atgactgacaatttaactcgtgcttttaaagaattactcaatcaagaacgctttggttctcaaaatgaaattgtcgatgccttaaaaaaacaaggctttactggtattaatcaatcaaaaatatcgagaatgctcagcaaatttggtgcggttcgcactcgtaatacaaaaatggaaatggtctattgcttaccaaatgaattaagtgttcccaataccagtagtccattaaaaaatcttgtcttagatgttgatcacaattcgatgttaatcgtaataaaaacgacgcccggtgctgctcaattaattgcacgattacttgattccattggaaaatcggaaggcattttaggcactatcgcaggcgatgatactatttttgtcacgcccacaaacgataaacctattgctgaattattgcaaaatatccaacgtttatttgaaaacgcattgtaa

SEQ ID NO: 648 - protein, 151 aa, H. influenzae
MTDNLTRAFKELLNQERFGSQNEIVDALKKQGFTGINQSKISRMLSKFGAVRTRNTKMEMVYCLPNELSVPNTSSPLKNLVLDVDHNSMLIVIKTTPGAAQLIARLLDSIGKSEGILGTIAGDDTIFVTPTNDKPIAELLQNIQRLFENAL

SEQ ID NO: 649 - DNA, 219 bp, H. influenzae
atggaaattggtattgtaaaatggttcaataatgcaaaaggatttggtttcatttccgcagaaggtgtagatgccgatatttttgcacattattcagtgattgaaatggacggctatcgttcattaaaagcaggtcaaaaagtacaatttgaagttctccacagcgataaaggatctcacgccacaaaaataatcccaattgcggatactcaagaataa

SEQ ID NO: 650 - protein, 72 aa, H. influenzae
MEIGIVKWFNNAKGFGFISAEGVDADIFAHYSVIEMDGYRSLKAGQKVQFEVLHSDKGSHATKIIPIADTQE

SEQ ID NO: 651 - DNA, 3084 bp, H. influenzae
atgttgccaagtctaaatcgcattcctcaaattgaacaatatgtacttgattatcttgatgatcttcaacaccaacattttgagggggatattgcgacaaattattcggatagattaagtctggctacggataacagcgtttaccaacagcttccacaggcgattctttttccgaaaactattgctgatatagtgcgtataaccaaattggcaaatttatctgaatatcaatcaatcagctttacgcctcgcggtggaggcactggcactaatggtcaatccatcaataacaatataatagtggatctttctcgtcatatgactgccatcttagaactcaatgtaaaagaacgttgggttaaagtacaagcaggtgtcgtaaaagatcaacttaatcaatttttaaaaccacatggtttattctttgccccagagctatccaccagcaatcgagcgactttaggcggaatgattaacacagatgcctcggggcaaggttcattgcaatacggtaaaacctctaatcatgttttggcattacgtgccgtattaatgaacggtgaaattttagatacaagtgcggtcaattctgttgatgttttagaaaacattgatgcgcttgaattaagtgagagcagcaaaagactccatcaaacaatcgcgcaacactgtaaagaaaaaagagcggcaatcattaaagatttaccacaacttaaccgttttttaacgggatacgatctcaaaaatgtattcaatgaagatgaaagtgaatttaatctcacgagaattctcactggttctgaaggttctctcgcatttatttgcgaagccaaactcaatcttctgcctattccgcagtatcgcacgctcatcaatattaaatatcgttcttttgacgcggcattacgcaatgcaccttttatggtgaaagccaatgcgctttctgtggaaaccgttgattccaaagtcttaaacctcgccaaacaagatattatttggcattctgtgaatgaacttcttacagaagatgaaaaagatccaattctcggtttaaatattgtggaatttgctggtaataataaagaaaaaataggccgccaagtcaccgcactttgtcacttacttgatgaaaaaatcgaacataaccaagatcacattattggctatcaagtttgttctgatttaccctctatcgaacgtatttatgcaatgcgaaaaaaagcagtgggcttacttggtaatgcaaaaggtgcagccaaaccgattcctttcgtggaagatacttgtgtccccccagaaaatcttgcggattacatcagtgaatttcgcgctttattagaccagcaccatttacaatatggcatgtttggtcacgtggatgctggtgtgttacacgttcgccctgcacttgatttatgcgataaagaacaagtgaaattatttaaacaaatttcagatgaagtggcagaacttacgattaaatatggtggattactctggggagaacatggaaaaggcgtgcgatcccattacggcgaaaaattctttaccccagaactctggtacgaacttcgttatatcaaaaccttgtttgatccgaacaatcgcttaaatcccggcaaaatctgtacacctttggattcccaagaggaactttattctattctttcgccaatgcgagctgataaggatcgccaaattcctatccaagtgcgtgatgaatttaagggtgcgatgaactgcaatggaaacggattatgtttcaattttgatgaacacagcattatgtgcccatcgatgaaagtcagtaaaaaccgtgtattttcgccgaaaggtcgcgcagcaatggttcgagaatggcttcgattgatggcgaatgaaaatgtttcgcccgcacaattagacttccgtaaaacagaaataaaactaaccgcacttgtgaaaagactaagcaatacggttaaaaaatggcgaggcgattatgatttttctcacgaagtaaaagtcgcaatggatacttgccttgcttgtaaagcctgtgcgagccaatgcccgattaaaatcgatgtaccaagtttccgtgcgaaattctttcatttctatcacagccgctacttacgccccgcaaaagatcacattgtggcaaatttagaaatcgctgcgccttatatggcaaaacaggcaaaattctttaattattttaccaagctaaaagtcacgcaaacattagtggaaaaaacgctaggcatgaccgatttgcccttgctttctgaacccaatttgcaacaacagctggtagaaattcattatcaaggcaaatccttggaagaattggaaggcctaagtgcggtagaaaaaaacgatattttatttattgtgcaagatccttatacctcttactatgatgcgaaagtggtacgagattttgttatgcttacgcagaaattaggcttcacaccaattctgttgccatttaaaccaaacggcaaagcaatgcacattaaaggtttcttaaaacgctttagcaaaacagcagaaaaccaagccgagtttttaaatcgaatggcaaaattaggcattcctcttgtgggcgttgatccagccatcgtgctgtcttatcgagatgaatacaaagaagcactacaagaaaaacgtggcgattttcacgttctcaccgcacacgaatggttaaaacaaagattacaaaatgcggatttacaagagaagttaaaaaacatcgccaaaactgaccgcactttcgattggtatttattccagcattgtacggaatctacctttatgccaaacagcccaaaagaatggcaagaaatttttggaagatttggacaacaacttaatgtagaaaaagtaggatgttgcggtatggctggtgtatttggacatgaagtgcaaaatcaaaaaatgagccgagaaatctacgatgtatcctggcacaaaaaactgcatgaaaaagatccgcacttttgtttagcaactggttattcttgccgcagtcaggtaaaacgttatgaacatgtggtgttaaaacaccctgtgcaggcattattagaaattttagcgtaa

SEQ ID NO: 652 - protein, 1027 aa, H. influenzae
MLPSLNRIPQIEQYVLDYLDDLQHQHFEGDIATNYSDRLSLATDNSVYQQLPQAILFPKTIADIVRITKLANLSEYQSISFTPRGGGTGTNGQSINNNIIVDLSRHMTAILELNVKERWVKVQAGVVKDQLNQFLKPHGLFFAPELSTSNRATLGGMINTDASGQGSLQYGKTSNHVLALRAVLMNGEILDTSAVNSVDVLENIDALELSESSKRLHQTIAQHCKEKRAAIIKDLPQLNRFLTGYDLKNVFNEDESEFNLTRILTGSEGSLAFICEAKLNLLPIPQYRTLINIKYRSFDAALRNAPFMVKANALSVETVDSKVLNLAKQDIIWHSVNELLTEDEKDPILGLNIVEFAGNNKEKIGRQVTALCHLLDEKIEHNQDHIIGYQVCSDLPSIERIYAMRKKAVGLLGNAKGAAKPIPFVEDTCVPPENLADYISEFRALLDQHHLQYGMFGHVDAGVLHVRPALDLCDKEQVKLFKQISDEVAELTIKYGGLLWGEHGKGVRSHYGEKFFTPELWYELRYIKTLFDPNNRLNPGKICTPLDSQEELYSILSPMRADKDRQIPIQVRDEFKGAMNCNGNGLCFNFDEHSIMCPSMKVSKNRVFSPKGRAAMVREWLRLMANENVSPAQLDFRKTEIKLTALVKRLSNTVKKWRGDYDFSHEVKVAMDTCLACKACASQCPIKIDVPSFRAKFFHFYHSRYLRPAKDHIVANLEIAAPYMAKQAKFFNYFTKLKVTQTLVEKTLGMTDLPLLSEPNLQQQLVEIHYQGKSLEELEGLSAVEKNDILFIVQDPYTSYYDAKVVRDFVMLTQKLGFTPILLPFKPNGKAMHIKGFLKRFSKTAENQAEFLNRMAKLGIPLVGVDPAIVLSYRDEYKEALQEKRGDFHVLTAHEWLKQRLQNADLQEKLKNIAKTDRTFDWYLFQHCTESTFMPNSPKEWQEIFGRFGQQLNVEKVGCCGMAGVFGHEVQNQKMSREIYDVSWHKKLHEKDPHFCLATGYSCRSQVKRYEHVVLKHPVQALLEILA

SEQ ID NO: 653 - DNA, 222 bp, H. influenzae
atggaacgcaaagaatataaggtgtttaaatcaggtttaaatttcttagaagggattgcaaattggataggaattcaaaatcctcaattaacgcaaacagaagatttattttctaacgaatcggataaaaatgactttggattgcaaaaacgaattgatgaaaaatatcgtaaagatgacgatccagccattgatattcgtcctaaacacggagcatattga

SEQ ID NO: 654 - protein, 73 aa, H. influenzae
MERKEYKVFKSGLNFLEGIANWIGIQNPQLTQTEDLFSNESDKNDFGLQKRIDEKYRKDDDPAIDIRPKHGAY

SEQ ID NO: 655 - DNA, 1032 bp, H. influenzae
atgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagacaagtacggaaaaataggtgcagataatgagcaatatgtgagttatgaacaaattgctaagtttattttgcagcacactgaaaatcatttagctcagcaacgagaaatttttcgtcgaattatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaactataa

SEQ ID NO: 656 - protein, 343 aa, H. influenzae
MNFCRILLKPLKKNEVHSGYSTKGLHYLTGNKHFNPELPFSRQEFITVKPQKQQGMSISGFQPKLQLIIKDDHFDSVDQQGHYILKPSPEEYPFLAENEHATMRIMKELGFDVPENGLVSFAGEQNQKEFAFVIKRFDRDEQQTEIHQEQLDGAMNIRDKYGKIGADNEQYVSYEQIAKFILQHTENHLAQQREIFRRIIYAYLLGNNDLHLRNFSFIYPKNSHPKLAPIYDFVSVSPYPEIFNSTLLALPLLAREEGNATLAKGFNTQYGEYIGDDFVEFGENIGLNKNVIIQKLIPEITQEKEKVEQIYSQSFMPQPHIDCVLKTYRKRLALLNVLNEPEL

SEQ ID NO: 657 - DNA, 798 bp, H. influenzae
atgtatttaatcgaaacctattttcgcctgactgcactcgaaaataatattgaatcacaaagtcgtttactcaatgcagtgatcgatcaatggcggtataacgggcaaattatcggacgtgaaattcctttatatttagcggaagaagatggtgcacaaggttttgctatgcgtgtcatttgccctgagcaagatagtcttttcccacaaaataataacgcagaagtgaatcgtgcattacaagaagcagaaaagtgcggtgtaatttttgatggttttcaacttgtgggcgatgatttcaattcagatcaaacagcagaaaatacatcgccagcttggcaagtgctttacacaacccatttacaaagttgctcgccgattcatagtggagaaaatttcgcaccaattccgttgtataaacagttgaaaaatcaaccgcacttaagccaagatctgattaaatggcaagaaaattggcaagcctgcgatcaactacaaatgaatggtgcggtattagaacaacaatctttggcagaaatttcggagcaccaaagcacactttcaaaacacggacgatatttagctcaagaaatagaaaaagaaactggcataccgacttactattatttatatcgtgtaggtgggcaatctttaaaatctgaaaaatcccgttgctgcccttcttgtggtgcaaattgggcgttaaaaaacgcgatttttgatacctttcattttaaatgcgatacctgtcgattcgtttcgaatctatcgtggaatttttttgtaattaatttataa

SEQ ID NO: 658 - protein, 265 aa, H. influenzae
MYLIETYFRLTALENNIESQSRLLNAVIDQWRYNGQIIGREIPLYLAEEDGAQGFAMRVICPEQDSLFPQNNNAEVNRALQEAEKCGVIFDGFQLVGDDFNSDQTAENTSPAWQVLYTTHLQSCSPIHSGENFAPIPLYKQLKNQPHLSQDLIKWQENWQACDQLQMNGAVLEQQSLAEISEHQSTLSKHGRYLAQEIEKETGIPTYYYLYRVGGQSLKSEKSRCCPSCGANWALKNAIFDTFHFKCDTCRFVSNLSWNFFVINL

SEQ ID NO: 659 - DNA, 891 bp, H. influenzae
tgaaccaaccaaccaaccaaccaaccaaccaaccaaccaaccaaccaaccaaccaaccaaccaaccaaccaaaataataaaaccgttgcggtagtaacttcaacaataggtcgtccagaattatctttggctattaaaagcgtacaaaatcaaacttatccatgtaagcattatgtatttgttgatggcaatattttctgggataaagccaaatctatattggaacaatttcctgatgtaattcctatttatttgccaatgaatacaggaaaaaatggaatacttaacggtgcaattaacgcagtagcagcttttcttgttgaagaagacattatttgttatttagatgatgacaatcagctacgagaagatcacgtggaaagcttagtaaacgtgattgagcaaggtgctgattttgcttattccttgcgatctttttacgattcaaatcatcaatttatttgcaatgatgattttgactctctcggaaattggaatacaaaaagcgatattttcgtagatgttaaaatagaagatattcagaaacaaatacattttacttttaatgaagttaatggacatattgatactaattgttacgccgtacctcgtgagattgcacaaaaaacttcatatagttggaacacaccattaattggtgatcgcagctttttatctgccttaaaaagtttggggttaataggtcaaacttcaggaaaatataccgttaaatacagagctgatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataa

SEQ ID NO: 660 - protein, 295 aa, H. influenzae
TNQPTNQPTNQPTNQPTNQPTNQNNKTVAVVTSTIGRPELSLAIKSVQNQTYPCKHYVFVDGNIFWDKAKSILEQFPDVIPIYLPMNTGKNGILNGAINAVAAFLVEEDIICYLDDDNQLREDHVESLVNVIEQGADFAYSLRSFYDSNHQFICNDDFDSLGNWNTKSDIFVDVKIEDIQKQIHFTFNEVNGHIDTNCYAVPREIAQKTSYSWNTPLIGDRSFLSALKSLGLIGQTSGKYTVKYRADFNKLIAVRRVFPQLSLSDEDNNNISAKILEVINQQNIEYYGGRPWAKE

SEQ ID NO: 661 - DNA, 1365 bp, H. influenzae
atgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgtgttatagagcaagctttaacaaacaataaagatttagctaaagctgctgtagcggtaaaccgtgcgctttatagtgcgaatttagtgggtgcaaatttagtgcctgcatttaatggttcaacttcatcagcagcacaacgccgagttgatatcagtacaaactctgccacttcacacaaaggttctttaaatgtgagctatacattagatctgtggcaacgtttggccaatactgttgatgcggcggaatggtcgcacaaagcaactgcagaagatatggaatcggctcgtttatcattaatcaattctgtagtaacaacttattatcaaattgcttatttaaatgatgctattagcacaaccaacgaaacgatcaaatattacacggatattggcaatattatgcaaacgcgtttagcgcaaggcgtggctgatgcagccagcgttgatcaagctcaacaagccatattaacggcgcgtaataacaaattaaattttgaaacccaacgcaaaacagcagaacaaacactgcgtaatcttctcaacctaaaaccaaatgaagcattaaatatcacgttcccacatattatgaatgtgaaaacggcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacagttggtacggcattacataaccctgtggctgctggcacagtaggaattagcttgccattcttaaattggaacaccgtaaaatggaacgttaaaatttctgaagctgactatgaaacagcacgtttaaattacgaacaacgtattaccacggctctcaataatgtggataccaactattttgcctttacccaagcgcaaagtacattaagtaatttacagcaaacccatagttacaatcagcgtatcacacaatattatcgaaatcgctataatgcgggcgtgtccgaattgcgcgaatggttagttgcagccaatacggaaaaatcatcacaacttgcgattttgaatgcaaaatatcaagtgctacaaagtgaaaatgcggtatatagctcaatggcgggatattatttgtaa

SEQ ID NO: 662 - protein, 454 aa, H. influenzae
MFKMKNITLALLMSGALVGCANIGDSYQASLEDYKQYEEITKQYNVKENWWSLYDDAQLNRVIEQALTNNKDLAKAAVAVNRALYSANLVGANLVPAFNGSTSSAAQRRVDISTNSATSHKGSLNVSYTLDLWQRLANTVDAAEWSHKATAEDMESARLSLINSVVTTYYQIAYLNDAISTTNETIKYYTDIGNIMQTRLAQGVADAASVDQAQQAILTARNNKLNFETQRKTAEQTLRNLLNLKPNEALNITFPHIMNVKTAGVNLNVPVSVIANRPDVKAAQFRLSSAFKNAKATQKSWFPEVNLGASLSSTASTVGTALHNPVAAGTVGISLPFLNWNTVKWNVKISEADYETARLNYEQRITTALNNVDTNYFAFTQAQSTLSNLQQTHSYNQRITQYYRNRYNAGVSELREWLVAANTEKSSQLAILNAKYQVLQSENAVYSSMAGYYL

SEQ ID NO: 663 - DNA, 2115 bp, H. influenzae
tgacaaaggaaaatttattatgaaactcgaagcaagcaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaa

SEQ ID NO: 664 - protein, 703 aa, H. influenzae
QRKIYYETRSKQASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 665 - DNA, 1398 bp, H. influenzae
tgaaacaaccaacaaccaacaaccaacaaccaacaaccaacaaccaacaaaaatatattgcccgaaattgttgtgtatggcgacaataataaatcactttcttccgttaaaacactctcttctgacgagataagtaaaacgcctacatcaaacggtaatatcactgattatcttcgttctaatccccatattcgttatgaaaatagcgaccaagatggttttcaacgtggagaaatcaagcctgaaaatatttcaattaacggtgccgatccaaatcaaactgcttattttgttgataatgtcaatataaataatgaacttactgctgatagcgatatttttgatggttctatgcaagttgtacccggaattagtcacactcaagcttatttctttgatgcgactatgctttctaaagtggaggtacaagatagtaatatttctgctagcttagggggatttatggggggtgccgttatagccaaaacaaaacaatatagcggcactgatagcataaaacttaaatatcgcacgacaaattcctcttgggcaaaaatggaagctggagactcagtacaaaaaatacttaaacaagtaagaccagatcttgtcggagtggcagagctacaacctaaatatgataaacaaacattcaatattttggctgaaaaaaggctaaatgataatttaggaatggtttttggctatagccgtagaacatcatctattgaacaaaatcgtttaattggctttgatcaaaatgccaataataaagcacagttagacaaacaaaatcatcaacgactttccgataatcttttattaaatttcaattggacaccgcaagaaaaagaacgtattgaactcggtttacgttattcaaattataaagaattgaaatatttccaggaaaatataaataacaacgtaagcgattatcatcaagcattggggacaacactagcttgggtgcattcattcaactctggcgtttggacaaataccttagcatacgatcgttttaaagataagcgtaaatcatcctcaaatagtgttgaaacaacatctgtgttagatgaatattatgaagcgctttataattttgaaaaaggcgggcatggtaatagccgtttaacccaagataatttacatttttctactgaatatgtaatggatcctttttatttagcttctacggagcattctgtttctattggtggaatttatcaggcaactaaatatcaattctatcgtccacaagatgttcattcaaaaataacattatctactttgcaaagtgatgggagtatgaatattttcagatcagataaaagtacaacaccaaaagtcgtgttaaaaccagctatcaaaatatcgctatttatgctgaagatttaa

SEQ ID NO: 666 - protein, 464 aa, H. influenzae
NNQQPTTNNQQPTTNKNILPEIVVYGDNNKSLSSVKTLSSDEISKTPTSNGNITDYLRSNPHIRYENSDQDGFQRGEIKPENISINGADPNQTAYFVDNVNINNELTADSDIFDGSMQVVPGISHTQAYFFDATMLSKVEVQDSNISASLGGFMGGAVIAKTKQYSGTDSIKLKYRTTNSSWAKMEAGDSVQKILKQVRPDLVGVAELQPKYDKQTFNILAEKRLNDNLGMVFGYSRRTSSIEQNRLIGFDQNANNKAQLDKQNHQRLSDNLLLNFNWTPQEKERIELGLRYSNYKELKYFQENINNNVSDYHQALGTTLAWVHSFNSGVWTNTLAYDRFKDKRKSSSNSVETTSVLDEYYEALYNFEKGGHGNSRLTQDNLHFSTEYVMDPFYLASTEHSVSIGGIYQATKYQFYRPQDVHSKITLSTLQSDGSMNIFRSDKSTTPKVVLKPAIKISLFMLKI

SEQ ID NO: 667 - DNA, 1869 bp, H. influenzae
atgtcatctattaaatatcgtccagaaattgatggactacgcgcaattgctgttatttcagtcattatttatcatcttaatgaaaactggttatcaggcggttttcttggggtggatattttctttgttatttctggttttctgattacgggtattattatcacagaaattcaacagaattctttttcgcttaaacaattttatactcgacgtattaaacgaatttatcctgcttttattacagtgatggcattagtgtctttcattgcgtctgttatttttatttataatgatttcaataaattaagaaaaaccattgaattagctattgcattcctatctaatttctatctaggattaacacaaggttattttgatttaagtgcaaatgaaaaccctgtattacatatttggtcattagccgtagaagaacaatactatcttatttttccactaatcctcattttagcttataaaaagtttagagaaattaaagtattatttattataacgctaattttattttttattttacttgccacctcttttattccagctaatttttacaaagaagtattgcatcagcctaatatttattatctctccaacctaagatttcctgaattacttgtaggatctttgttggcaatttatcataatctttcagcaagcaagcaagcaagcaagcaagcaagcaatgttattgcaatattaagtacattactattattttcctgcttatttttaatgaataatgatattgcatatattccaggtattactttaattctcccttgtatttttacagcattaattattcataccacatcacaaaataacattattaaattatgtttatccaataaagtgatagtatttattggaaaaatctcttattccctttatttataccattggatttttattgcgtttgcttattatataacgggcgaaaaacaaattaataatcaatctatcgctatagtaataatattaacaataattttttcagttctaagttattatttaatcgaacaaccaattagaaaatcgaaactaaactttaaacaaagttttctttatatttattttattccttctcttttactcttaggatttaatctttataaaagacaaacaatacgagctgaaaaagaacacattgaacaatcaattcctgtttctaatgaaaatcattatcctgctaaggtcattattttaggcgattctcattcttcacatttagaagcttttctaaactatgtgggaaataaagaaggctggaaagcagatattttcaaagataaatttgaatgtagctttattgtgaatgaacaatatcaattagatcctaattgccaatctgtatggcagaaagattctcaatataaagcgatatttatttcagcattttatgacttgagaatgggcggacagccagtacctcgctttagacccgaaactttcatagagccagattttaaagcacgttttaaaaacacagtgaaacaactagcgatgcaaaagcccgtatatgtttttgctaataatagctcagtaagccgttctccactgcgtggttacttattagaaaattatggacttgaaaaatatttaacgccaattcatcgtatgggcgatattgatgcgagtaacaaaattattcatgatttagtcaaagatattcctaatgtttattgggtagatgctcaacagtatttaccaaaagatagtgttatggcagaaggaaaatacttgtatggggatcaagatcacttaacaaattttggtgcttactatatggcaaaagaatttagtaaatatcaacgagtgatgacacctgaacaagtgaaaaaactctacgagtaa

SEQ ID NO: 668 - protein, 622 aa, H. influenzae
MSSIKYRPEIDGLRAIAVISVIIYHLNENWLSGGFLGVDIFFVISGFLITGIIITEIQQNSFSLKQFYTRRIKRIYPAFITVMALVSFIASVIFIYNDFNKLRKTIELAIAFLSNFYLGLTQGYFDLSANENPVLHIWSLAVEEQYYLIFPLILILAYKKFREIKVLFIITLILFFILLATSFIPANFYKEVLHQPNIYYLSNLRFPELLVGSLLAIYHNLSASKQASKQASNVIAILSTLLLFSCLFLMNNDIAYIPGITLILPCIFTALIIHTTSQNNIIKLCLSNKVIVFIGKISYSLYLYHWIFIAFAYYITGEKQINNQSIAIVIILTIIFSVLSYYLIEQPIRKSKLNFKQSFLYIYFIPSLLLLGFNLYKRQTIRAEKEHIEQSIPVSNENHYPAKVIILGDSHSSHLEAFLNYVGNKEGWKADIFKDKFECSFIVNEQYQLDPNCQSVWQKDSQYKAIFISAFYDLRMGGQPVPRFRPETFIEPDFKARFKNTVKQLAMQKPVYVFANNSSVSRSPLRGYLLENYGLEKYLTPIHRMGDIDASNKIIHDLVKDIPNVYWVDAQQYLPKDSVMAEGKYLYGDQDHLTNFGAYYMAKEFSKYQRVMTPEQVKKLYE

SEQ ID NO: 669 - DNA, 4629 bp, H. influenzae
atgaacaagatatatcgtctcaaattcagcaaacgcctgaatgctttggttgctgtgtctgaattgacacggggttgtgaccattccacagaaaaaggcagtgaaaaacctgttcgtacaaaagtacgccacttagcgttaaagccactttccgctatattgctatctttgggcatggcatccattccgcaatctgttttagcgagcggtttacagggaatgagcgtcgtacacggtacagcaaccatgcaagtagacggcaataaaaccaccatccgcaatagtgtcaatgctatcattaattggaaacaatttaacattgaccaaaatgaaatggtgcagtttttacaagaaaacaacaactccgccgtattcaaccgtgttacatctgaccagatttcccaattaaaagggattttagattctaacggacaggtctttttaatcaacccaaatggtatcacaataggtaaagaagcaattattaacactaatggctttactgcttctacgctagacatttctaacgaaaacatcaaggcgcgtaatttcacccttgaacaaaccaaggataaagcactcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaataaccatcagcgacataataaacccaaccattacttacagcattgctgcccctgaaaatgaagcaatcaatctgggcgatatttttgccaaaggtggtaacatcaatgtccgcgccgccactattcgcaataaaggtaaactttctgccgattctgtaagcaaagataaaagcggcaacattattctttccgccaaagagggtgaagcagaaattagcggtgtgatttccgctcaaaatcagcaagccaaaggtggtaagttgatgattacaggcgataaagttacattaaaaacgggtgcagttatcgacctttcaggtaaagaagggggagagacctatcttggcggcgacgagcgcggcgaaggtaaaaacggcattcaattagcaaagaaaacctctttagaaaaaggctcaacaattaatgtatcaggtaaagaaaaaggcgggcgcgctattgtatggggcgatattgcgttaattgacggcaatattaatgctcaaggtagcgatatcgctaaaactggtggctttgtggagacgtcggggcattacttatccattgacagcaatgcaattgttaaaacaaaagagtggctactggaccctgataatgtaacaattgaagctcctagcctttctcgcgctgacactgacattagttcagaatttccaatcggtgacggtactgaaaacagccctaaaaaaaacgccgacaaaacaatactgaccaatgaaaccatttcaaattttctgcaaaatgccaaagtgatgaacataacggcaaagagaaaacttaccgttaatagctcaatcagtatcggaagtagatcccacttaattctccatagtgaaggtcagggggacggaggcgttcagattgatggagatattacttctgaaggcggaaatttaaccattaactccggcggatgggttgacgttcataaaaatattacgcttggtacgggttttttaaatattaccgctgggggttctgtagcttttgagaaagggggcaataacgcacgtaacgcaacagatgctcaaattaccgcacaagggacgataaccgtcaataaagatgataaacaatttagattcaataatgtatctattaacgggacgggcgagggtttaaagtttattgcaaatcaaaataatttcactcataaatttgatggcgaaattaacatatctggaatagtaacaattaaccaaaccacgaaaaaagatgctaaatactggcatgcatcaaaagactcttactggaatgtttcttctcttactttgaatgacgatgcaaaatttacctttataaaattcgttgatagcggctcaaattcccaagatttgaggtcagcacgtagacgttttgcaggcgtacattttaacggcaccggaggcaaaacaaacttcaacatcggagctaacgcaaaagccttatttaaattaaaaccaaacgccgctacagacccaaaaaaagaattacctattacttttaacgccaacattacagctaccggtagcagtgatagctctgtgatgtttgacatacacgccaatcttacctctagagctgccagcataaacatggattcaattaacattaccggcgggcttgacttttccataacatcccataatcgcaatagtaatgcttttgaaatcaaaaaagacttaactataaatgcaactaattcaaaatttagtcttaaacaaacgaaagatttatttgaaaatcaatacacaggagacgccattaattcaactcgtaatctaactattcttggcggcaatgtcactctgggcggggagaattcaagcagtaacattacaggaaatatcaccatcgctgccgaagcaaatgtcacattacaagcttacgccgacaatagcatcaaaggtcataagaaaaaaactctaactcttggtaatgtgtccacctctggaaacttaagcttaactggctcaaaggtggaggtaaaaggcgatcttgccgttttaaacggtgccacttttaaaggagaaaccaatgacagcctaaacattaccggcacctttaccaacaacggtaccgccgacattaatataaaacgaggggtggtaaacatccaaggtgatattaccaataaaggtggtttaaacattaccactaatgcccaaaaaaatcaaaaaaccattattaacggaaatataaccaacaaaaaaggcaacttaaatattacgaataatggtaatgatactgaaatccaaattggcggcaatatctcacaaaaagaaggcaatctcacaatttcttctgacaaagtaaatatcaccaagcagataacaattaaagcaggcgttgatgagaaggattctagttcaagcacagcaagtgatgccaatctaaccattaaaaccaaagagttaaaattggtagaagacctaaacatttcaggctttaataaagcagaaattacagctaaagatggtagtgatttaactattggtaacaccaatagtgctgatggtactaatgccaaaaaagtaacctttaaccaggttaaagattcaaaaatctctgctaacgatcacaatgtgacactaaatagcaaagtggaaacatctggtaatactgacaacactggagacggcagtggcaataatgccggcttaactattgccgcgaaaaatgtagaagtaaaaaacaacattacttctaacaaaacagtaaatatcaccgcgtcagaaaaacttaccaccaaagcggatgcaaccattaatgcaaccactggtaacgtagaagtgacagccaaaacaggtgatattaaaggtgaagtcaaatccacttccggtaatgtaaatattacagcaaacggcgacacgcttaatgtaagtaatgtttcaggcaatgctgttaccatcactgcagataagggcaaattaaccacccaagaaagctctacgattagcggaactgagagtgtaaccacctcaagccaatcaggcgatattggcggtgcaatttctggtaacacggtaagcgttaaagcaaccaatgatttaattaccaaagcaaattcaaaaattgaagcaaaaacaggcgaggctaatgtaacaagtgcaacaggtataattggcggcacaatctctggcaatacagtaaatgttacagcaaatactggtagtttaactattaaaggcggtgcaaaagttgatgcgacaaatggagctgcaaccttaactgcagaatcaggcaaattaaccactcaagcaggctctactattacctcaaacaatggccagacaactcttacagccaaggatggcagtatcgcaggaagtattgatgccgctaatgtgacattaaataccacaggcactttaactaccgtagtgggttcaagcattaacgcaaacgaaggcaccttagttattaacgcacaagacgccacactaaatggtgatgcatcaggcgaccgtacagaagtgaatgcagtcaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 670 - protein, 1542 aa, H. influenzae
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQENNNSAVFNRVTSDQISQLKGILDSNGQVFLINPNGITIGKEAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAATIRNKGKLSADSVSKDKSGNIILSAKEGEAEISGVISAQNQQAKGGKLMITGDKVTLKTGAVIDLSGKEGGETYLGGDERGEGKNGIQLAKKTSLEKGSTINVSGKEKGGRAIVWGDIALIDGNINAQGSDIAKTGGFVETSGHYLSIDSNAIVKTKEWLLDPDNVTIEAPSLSRADTDISSEFPIGDGTENSPKKNADKTILTNETISNFLQNAKVMNITAKRKLTVNSSISIGSRSHLILHSEGQGDGGVQIDGDITSEGGNLTINSGGWVDVHKNITLGTGFLNITAGGSVAFEKGGNNARNATDAQITAQGTITVNKDDKQFRFNNVSINGTGEGLKFIANQNNFTHKFDGEINISGIVTINQTTKKDAKYWHASKDSYWNVSSLTLNDDAKFTFIKFVDSGSNSQDLRSARRRFAGVHFNGTGGKTNFNIGANAKALFKLKPNAATDPKKELPITFNANITATGSSDSSVMFDIHANLTSRAASINMDSINITGGLDFSITSHNRNSNAFEIKKDLTINATNSKFSLKQTKDLFENQYTGDAINSTRNLTILGGNVTLGGENSSSNITGNITIAAEANVTLQAYADNSIKGHKKKTLTLGNVSTSGNLSLTGSKVEVKGDLAVLNGATFKGETNDSLNITGTFTNNGTADINIKRGVVNIQGDITNKGGLNITTNAQKNQKTIINGNITNKKGNLNITNNGNDTEIQIGGNISQKEGNLTISSDKVNITKQITIKAGVDEKDSSSSTASDANLTIKTKELKLVEDLNISGFNKAEITAKDGSDLTIGNTNSADGTNAKKVTFNQVKDSKISANDHNVTLNSKVETSGNTDNTGDGSGNNAGLTIAAKNVEVKNNITSNKTVNITASEKLTTKADATINATTGNVEVTAKTGDIKGEVKSTSGNVNITANGDTLNVSNVSGNAVTITADKGKLTTQESSTISGTESVTTSSQSGDIGGAISGNTVSVKATNDLITKANSKIEAKTGEANVTSATGIIGGTISGNTVNVTANTGSLTIKGGAKVDATNGAATLTAESGKLTTQAGSTITSNNGQTTLTAKDGSIAGSIDAANVTLNTTGTLTTVVGSSINANEGTLVINAQDATLNGDASGDRTEVNAVNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 671 - DNA, 4479 bp, H. influenzae
atgaacaagatatatcgtctcaaattcagcaaacgcctgaatgctttggttgctgtgtctgaattgacacggggttgtgaccattccacagaaaaaggcagtgaaaaacctgttcgtacgaaagtacgccacttggcgttaaagccactttccgctatattgctatctttgggcatggcatccattccgcaatctgttttagcgagcggtttacagggaatgagcgtcgtacacggtacagcaaccatgcaagtagacggcaataaaaccactatccgtaatagcgtcaatgctatcatcaattggaaacaatttaacatcgaccaaaatgaaatggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatccggataatgttaccattagcaatggtaacgatgatcaatctcaattaaaggacgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatggggtttttaaatattaccgctgggggttctgtagcttttgaaaaggcagggggtgataaaggccgtgctgcaagtgatgctaaaattgttgctcagggtgtaattactgcaggcagtggtcaagatttccgttttaataatgtatcactaaatggaactggtagagggttgaaattcattacagctaaaggaaataaaggtaatttctcagccaaatttgatggtgtgttaaatatttcaggtaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttaactgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtggaagtaaccgctaaaacaggtgacattaaaggtggaattgagtccaagtctggcggagtaacacttactgcaaccggagatactcttgctgtaggtaatatttcgggtaacactgttagtgttactgcaaatagcggtacattaaccaccaaagcagactctacaatcaaaggaaccgggagcgtaaccaccttaagtcaatcaggcgatatcggcggtacgatttctggtaagacagtaagtgttacagcaaccaccgacagtttaactgttaaaggtggcgcaaaaattaatgcgacagaaggaactgcaaccttaactgcatcatcgggcaaattaaccaccgaggctagctcaagcatcacttcagccaagggtcaggtagacctttcagctcgggatggcaatattggaggaagtattaatgctgctaatgtgacattaaataccacaggcactttaactaccgtgaagggttcaagcattaacgcaaacagcggcaccttggttattaacgcagaagacgctaagctagatggtacggcatcaggtgaccgcacagtagtaaatgcaactaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 672 - protein, 1492 aa, H. influenzae
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQESSNSAVFNRVTSDQISQLKGILDSNGQVFLINPNGITIGKDAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAANIRNQGKLSADSVSKDKSGNIVLSAKEGEAEIGGVISAQNQQAKGGKLMITGDKVTLKTGAVIDLSGKEGGETYLGGDERGEGKNGIQLAKKTSLEKGSTINVSGKEKGGRAIVWGDIALIDGNINAQGKDIAKTGGFVETSGHYLSIGNDAAVEAKEWLLDPDNVTISNGNDDQSQLKDDRGDSPNKILADNKHTVNNKTLSTALAKGIGVNISAKKKVNVTADINVHNGTLTLHSEQGGVEINGDITSEQNGNLTIKAGSWVDVHKNITIGMGFLNITAGGSVAFEKAGGDKGRAASDAKIVAQGVITAGSGQDFRFNNVSLNGTGRGLKFITAKGNKGNFSAKFDGVLNISGNISINHTANNQLSYFHRQGYTYWNLTQLNVDSDSSFSLTSIKDAIKVGGYDNAKDKKNTGGIGFTRDTIFNVKQGARVDISYTLPISPVKNSRIAAVNFDGNITVKGGGVVNLKFNALSNNYKTPGVNISSRFINVTEGSQLNITGSMPSTTLFNVANDLIINATNSFVSIKEIEGTDTHLDTGLKVNGNVTIKGGNVTLGSNKAKTKFDKNVTVEKGANLTLASANFGNHKGALTVAGNINTQGKLVATGDTIDVSGDFTVGNDATFNGNTNNNLNITGNFTNNGTSIIDVKKGAAKLGNITNEGSLNITTHANTNQKTIITGNITNKKGDLNIRDNKNNAEIQIGGNISQKEGNLTISSDKVNITKQITIKAGVNGENSDSGTENNANLTIKTKTLELTNNLNISGFHKAEITAKDNSDLIIGKASSDSGNAGAQKVIFDKVKDSKISAGNHNVTLNSEVETSNGNSNAAGDSNGNNAGLTISAKDVAVNNNITSHKTINISATTGNVTTKEGTTINATTGGVEVTAKTGDIKGGIESKSGGVTLTATGDTLAVGNISGNTVSVTANSGTLTTKADSTIKGTGSVTTLSQSGDIGGTISGKTVSVTATTDSLTVKGGAKINATEGTATLTASSGKLTTEASSSITSAKGQVDLSARDGNIGGSINAANVTLNTTGTLTTVKGSSINANSGTLVINAEDAKLDGTASGDRTVVNATNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 673 - DNA, 858 bp, H. influenzae
atgaaaacatctatttatcaattaaagtggggaacctttaatcttattgaaggggattttattagccaatatgctgcactttatggcgaatggtcagatgtagaagtccaattttttttggaaaacctaaattcttcaagtaatgtcattgaagttggttcgaatattggaatgcacgcagttcctattgcaaagacaataagtggggggggggggaaattattttgttttgaacctcaaagagtaatttttcagacactttgtgcgaatttgtcgcttaatcaattaacaaatgttcatgcctataatttgggggttggtgaaaatgaacagttgattgagattccctcatcaaattatgatactgcttggaattatggaagtttttcattagataaagggtttagtaccgagggtaattttataggtgtagaatctaaggaattgatacatgttatttctttagataaacacccagaagttaatcgattggaagatatagatctattaaaaattgatgctgaaggatttgagctaaatgttttaaatggtgcaaagaatctcatagagagacataagcctataatttttgtagaagctcatattcatcactctaatgagttgatatcctatttagataagattggttataagtgttattggtttatttctgaacgttatcaaaaaaataactactttaagcaggagaaatctcttggtggaatggactttaatttagcttgtttccataagagtaaacaatcaacattaccagaggaactacggacaacaccaaataatttattaactgaaataccaatagtaagtaacagatttgatctgcccccaaaaagttag

SEQ ID NO: 674 - protein, 285 aa, H. influenzae
MKTSIYQLKWGTFNLIEGDFISQYAALYGEWSDVEVQFFLENLNSSSNVIEVGSNIGMHAVPIAKTISGGGGKLFCFEPQRVIFQTLCANLSLNQLTNVHAYNLGVGENEQLIEIPSSNYDTAWNYGSFSLDKGFSTEGNFIGVESKELIHVISLDKHPEVNRLEDIDLLKIDAEGFELNVLNGAKNLIERHKPIIFVEAHIHHSNELISYLDKIGYKCYWFISERYQKNNYFKQEKSLGGMDFNLACFHKSKQSTLPEELRTTPNNLLTEIPIVSNRFDLPPKS

SEQ ID NO: 675 - DNA, 916 bp, H. influenzae
  misc_feature (818)..(818): n is a, c, g, or t
  misc_feature (849)..(849): n is a, c, g, or t
ctgttttcggatatcaatctcggttctcctgtatattagcaaggcttcgtaaccagatgcttcgccataaccataataaatatcgctaacagtaaataaacgctgcattggcacccgaccgaatggtgtatattggctattttccgtaatcatcaaacggattttatccccaatattcacgcccagtttttgcgccagttgatcaccaatgaccagtttaaactcccctctaggcaaaatttcattaaatttagtctgatcaaaagattcaaccaaaggatcatcagaaaatgattgaatacctataatttgtcctgcacttacgccttttgccgtttgataaatcacatttgttgtattgatcggcacggctttttggacaaagtgcggtaaatttttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaccctgggnggttgttctttcacatcaatagttactttgntcgtatggctccttgttttttaccatccatatcacgatagattactttagggcgagaaacggcaagc

SEQ ID NO: 676 - DNA, 3964 bp, H. influenzae
  misc_feature (201)..(238): n is a, c, g, or t
gttctgggagatgacaagtgcggtcaattttcttaaaaattgtccgacagtatggtctaacttttgagagaacatattctctctcctattaaaatactctgcacttactctcattgtactcttattattcttttattaaaacctcgttttaagcaggaaaaatgtgatttttgcgatccacgtcgcaaattttactaattnnnnnnnnnnnnnnnnnnnnnnnnnnnnnnnnnnnnnncaacgttttctgcctctgacgcctcttttaatggtctcagatgtcctttggtcaccagttctgccagcgtgaaggaataatggccgagcatattgatatgtccgtggcaaagcggggagaggcgtgcgatatcttcatcattcagtgtttcaccctgcgcccggagatgatccagggctgcctgcatataaatagtgttccataacacgacggcgttagtgaccagccccagtgtgcccagttgatcttcctgaccgtcggtatatcgttttcttatctcacctttttgaccgtgacagatggctctggcaacggcatggcgactttctccccgattaagctgggtcagaatgcgccggcggtaatcttcatcatcaatataattaagcagatacagcgttttgttgatgcgccccacttcaatgattgcctgagtcagtccggaaggacgttcacttttcagcaatgaacggaccagcactgaaacctgtactttgcccagcttcagggagccagcggtccggatcatttcgtcccactgaaggactatttttcggggatctgattgccctctggcaatatcattcagcacgccatagtcggcatcatggtccattcgccagaaaaccgaagcaccggcatcagccaggcgtggagaaaactggtatcccagcagccagaaaaggccaaagacaagttcgctggcacctgctgtatcggtcataatttcggttggattcagcccggtctcctgttccagaagaccttccagcacaaagatagagtccctcagcgtccccggtataacgatgccatgaaagccggaatactgatcggacacaaagttgtaccaggtgatccctctgttattaccaaagtatttgcggttcggtccggcattgattgttctgactggcgtaacaaagcgcattccatctgcagatgccacttctcctccaccccatatctgtgccagtggcagcgttgcctgaaaatcaaccagtctggcattagcgctggtgatagtttcagcccgcagatagttcgcttttgtccagttcagccggtgtcgggtcagtgcaggaacatttgatctgatcagtggttccagaccgatattgcaggcttcagccatcagcacggcgctgatgctgacgggcagatcatcaactctggcactggcttcactagcatggaaaaactcatcagcaaatccggtatgggcgttaatttcgagcagcaactccgttaaatccaccggagggagtagatcactgatcattttgctcagtcgtttcagactgtccggctcatcaagactggcgaggggagaaattgtcaaccggggcttcgggccagaaacatcgagttcgacagcctcattttcgcaaagacgtgcagcaacctgtctgtaacgactatcaagctgatgacccagagattttattgcttcctgcgggtctgtcgggtgccccaaagaacgataaaccttaatccggtttgcctgccagtcagcaccctgtagtaatcttgcacgaggatctccccaccggttactgccggtaacgtagacatccctccgcctcagactatcctgcagtttactgagaaagcagagcgtgtatcccctgcgggtgatatgtttttccttgttaatcaccagccgtttccatgaccgactgataatttccgttggtgcgtcgtcaaaaaactgccgccgtgagctgaactcccggctgaggtagtcacaggcattcagagtggtaaccccggcaggtgcggatgaaaatttaacggtattcagcagatggggcaggaaacgacgaacgcgcccgtactgctccaccatttcttcatgaaaattatcgtctgagggccgggcaatttcacggacaagcgtgatgatttcagccagcttttgccttgggatgtagctgaacacctcagcacgaatcgattcgtccggtgtttcttctttcagcaggtacgaacatgcgctggcgagcgccaatgcagatttatccagatccttcagcgagcggagccgttttttctgcccaatctttctggcgtcacggatgataacggccagcatggcgtccagaacgtccaatgcatcatccagcgccagcgtttcccatgcaaggacaaaggcaaccagaaccgccatccttttctgcggtgacatcctggcaatattgaacaccgaagtcataccagcataacgtgcgagatttttcaggcgcacagccgggagtgtactcaggttttcagcatgcaggccaaaatcgttcagagttttccagcgttcaattgcttcattaaacgccggaccactgatggtcacagggccctttttcagtgattccagtaaagacaggcggctgcaatcagttggccccagcagcatctccagctgtgaacgctgttcggctgacggtatcagtgccagtttgttccacaggcgcaacgtcgccttttcccttacctctgaaatcaaccgggtcagcgtagtggctccggggagaataatacgatgttgcataagccaccctgtcgccagatcgaaaagcaggccaggacgttcgttgcttatccagctccgggtatataaaagacgggtaaggcgaaatgtccagggccaggcaaattcacgatactgatagtgctgacgtatcagcgctgcatgctcacggcgggtattttccctctgaccgtattctgcaagaacggtgatatcacgaatcccgagctgtctggcggtaaaatgccggacgccggaaggaatatgattcatatcggtgaggaaggtgcccagaaaacggacacatccaatttgcagggcaatgcccagacggttgtgatcacctctgctttttccgataaattccttgtctgcttcatcaaggtgaaaatatcgtgccagctgaagctcatccggttcaccggtgaatctgccatagctttcagtctgctcagtggtcagaaagtcaacgggcatatcggcctccctgcctgacgggcatttagtaacatttttccaaccgtacgaaatgttataaattatcggacatcgtaaaactgttacattaatatgtctattaaatcgtaaatttgtaataatagacatgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttggccgcgacactgccgatatgatccaactgataaaggaatttgacgctcagggcgtggcagtccggttcattgatgacgggatcagtaccgacggtgatatggggcaaatggtggtcaccatcctgtcggctgtggcacaggctgaacgccggaggatcctagaacgcacgaatgagggccgacaggaagcaaagctgaaaggaatcaaatttggccgcaggcgtaccgtggacaggaacgtcgtgctgacgcttcatcagaagggcactggtgcaacggaaattgctcatcagctcagtattgcccgctccacggtttataaaatcttgaaggggtaccgagttgaatctatca

SEQ ID NO: 677 - DNA, 15147 bp, H. influenzae
  misc_feature (14517)..(14517): n is a, c, g, or t
  misc_feature (14576)..(14576): n is a, c, g, or t
  misc_feature (14583)..(14584): n is a, c, g, or t
  misc_feature (14594)..(14596): n is a, c, g, or t
  misc_feature (14624)..(14624): n is a, c, g, or t
  misc_feature (14642)..(14642): n is a, c, g, or t
  misc_feature (14646)..(14646): n is a, c, g, or t
  misc_feature (14665)..(14665): n is a, c, g, or t
  misc_feature (14681)..(14681): n is a, c, g, or t
  misc_feature (14708)..(14708): n is a, c, g, or t
  misc_feature (14723)..(14723): n is a, c, g, or t
  misc_feature (14725)..(14725): n is a, c, g, or t
  misc_feature (14751)..(14751): n is a, c, g, or t
  misc_feature (14763)..(14763): n is a, c, g, or t
  misc_feature (14766)..(14770): n is a, c, g, or t
  misc_feature (14772)..(14772): n is a, c, g, or t
  misc_feature (14793)..(14793): n is a, c, g, or t
  misc_feature (14796)..(14797): n is a, c, g, or t
  misc_feature (14799)..(14799): n is a, c, g, or t
  misc_feature (14824)..(14826): n is a, c, g, or t
  misc_feature (14828)..(14829): n is a, c, g, or t
  misc_feature (14832)..(14832): n is a, c, g, or t
  misc_feature (14835)..(14835): n is a, c, g, or t
  misc_feature (14838)..(14838): n is a, c, g, or t
  misc_feature (14840)..(14841): n is a, c, g, or t
  misc_feature (14846)..(14848): n is a, c, g, or t
  misc_feature (14861)..(14862): n is a, c, g, or t
  misc_feature (14864)..(14864): n is a, c, g, or t
  misc_feature (14866)..(14866): n is a, c, g, or t
  misc_feature (14868)..(14868): n is a, c, g, or t
  misc_feature (14870)..(14871): n is a, c, g, or t
  misc_feature (14877)..(14878): n is a, c, g, or t
  misc_feature (14880)..(14880): n is a, c, g, or t
  misc_feature (14886)..(14886): n is a, c, g, or t
  misc_feature (14918)..(14920): n is a, c, g, or t
  misc_feature (14922)..(14924): n is a, c, g, or t
  misc_feature (14929)..(14930): n is a, c, g, or t
  misc_feature (14932)..(14932): n is a, c, g, or t
  misc_feature (14934)..(14934): n is a, c, g, or t
  misc_feature (14938)..(14938): n is a, c, g, or t
  misc_feature (14942)..(14942): n is a, c, g, or t
  misc_feature (14947)..(14947): n is a, c, g, or t
  misc_feature (14952)..(14953): n is a, c, g, or t
  misc_feature (14964)..(14966): n is a, c, g, or t
  misc_feature (14972)..(14972): n is a, c, g, or t
  misc_feature (14974)..(14977): n is a, c, g, or t
  misc_feature (14980)..(14980): n is a, c, g, or t
  misc_feature (14983)..(14984): n is a, c, g, or t
  misc_feature (14997)..(14998): n is a, c, g, or t
  misc_feature (15008)..(15008): n is a, c, g, or t
  misc_feature (15028)..(15028): n is a, c, g, or t
  misc_feature (15030)..(15030): n is a, c, g, or t
  misc_feature (15034)..(15037): n is a, c, g, or t
  misc_feature (15049)..(15049): n is a, c, g, or t
  misc_feature (15058)..(15058): n is a, c, g, or t
  misc_feature (15062)..(15062): n is a, c, g, or t
  misc_feature (15072)..(15072): n is a, c, g, or t
  misc_feature (15096)..(15096): n is a, c, g, or t
  misc_feature (15112)..(15113): n is a, c, g, or t
  misc_feature (15116)..(15119): n is a, c, g, or t
  misc_feature (15123)..(15124): n is a, c, g, or t
  misc_feature (15127)..(15128): n is a, c, g, or t
  misc_feature (15130)..(15133): n is a, c, g, or t
  misc_feature (15140)..(15140): n is a, c, g, or t
tagacttaatgctaatttagccgcttacgttgccattaaatcaataggatagcgaattgtggttagttttgggatcaaataacgggcaatcggcatatcatcaaaaccaataattgaaaattggcttggtacgctgatattgttttcattgagaactgaaatggctcccgccgccattgaatcgttataagcaacgacagccgtaagatttttgttataactaagtaaatcaatcattgctttttcgccgccttcaaagtctggactattgagtgttatcgcctgttcaatgatgggataattgtgatcttttaatgcggcaagataaccatttcttctttcaacttcatcaaaaatggcgtgatttgaaccgatatatgcaatatgttgatgcccataacgaataagcatttccgtggctaaataagtgcctttttggttatctaaactgacacaacgatgttcataacctttaataacacggttaatgattaccattccttgcacagtatttaaataatggcttaattcatcatcagataaggctttagaatgtacaacaagagaactacaacgcttacgtaataaggtattaattgcttcccgctctttttccgcatgatgataaccaataccgataagaatcgttttttgatgcgcttctgctactttatccaccgctttcactaaaatcgcaaaaaaagcatccgtcacatcggttaccaccacgccaattgtatcggtgttctgcacggcaagggcttgagcatttgcattaggttgataagctaactgtgcaatagcttgttccaccgcaaggcgtgtattttcactaacagaaagagagtgatttaatactcgggatacggtagcgacagatacattggctaatttagcgacatctcgaatagtactcataactttttccttgttataatctataaatcttatattttgatcataaataatttacgataaattgaaaacggttactttcataagtatgaactaaatcataaaaaattttgcttattttcttattttgtgacaaagatcacggtttatttacaataatttagtataaattaatgtaatcgcttacattgataaaaaacaggagtcaaaatgaccgcactttttgaacctacagaacatccacatcgtcgctacaatccgttaatcgatcaatgggttttagtttcgccacatcgtgccaaacgcccgtggcaagggcaacaggaaaaagtcaatgaagaacaaaaaccaagttatgatccaacttgttatctttgtccgagtaataagcgtattacaggggaattaaatccagattatcgtaaaccttatgtatttaaaaatgatttttccgcgcttttagaagatacgccagcccctgaaaaatcctccgatcctcttttccaaagttctcaagctcgtggggaaagtcgagtcatttgtttctctcccgatcatagtaaaacattgccattattgaccgcacttgagattgaagaagtgattaaagtatggcaggaacaacttcgtgaacttggtgcgaaataccaatgggtgcaaatttttgaaaacaaaggggctgcaatggggtgttctaaccctcatccgcatggtcaaatttgggcaaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattgggtcgctttagtaccttattgggctatttggccatttgaaacattgcttctaccaaaaactcatgtaaaacgtttaactgaattaagtgacgaacaatcaaaagatcttgcggttattttgaaaaaattgacgaccaaatacgacaatctctttgaaacctctttcccatattcaatgggatttcatgcggcaccgtttaatggcgaagataacgaacattggcagctacatgctcatttttaccctcctcttttgcgttcagcaactgtgcgtaaatttatggtggggtatgaaatgttaggcgaaaaccaacgcgatttaacggcagaacaggcagcggagcgattacgtgctttgagtgaagttcattataaagaaagaactaaataatatagtcagttcccctctttagctttagcaaagagtggtgcagatcgagtatagatttaatataaaggatagaaatatgaccccaatccaaaatgctcaacaaattttcaatagacagcataaaaatttgccagaaattaccgtctatgcccctggtcgagtaaatattatcggcgaacatactgactacaacgacggctttgttatgccttgcgcaattaattttggtacggccgtttctggtacaaaacgagatgatcatatttggaatgtttatgctgcagatcttgatgaaactgatgaattttctctcaatgttgaaattcctaagagtgaacacaaatgggctaattatgtgcgtggggtggtaaaatttatccaagaacgttacccgcactttcaacaaggtgcaaatttagtgatttctggtaatgtgccgctttcttctggattaagttcttctgcagcgttagaagttgcggtgggtaaattctgccaacaacttggcgatttaccgctttctcacacggatattgcattgaatgggcaaaaggctgaaaaccaatttgtcggtgctaattgtggcaatatggatcagttaatttctgcgcttgggcaggaaaatcacttactgatgatcgattgtcgtagtcttgaaactattccaacaccagtgccacaagatgtcgccgtgattattgtgaattcaaacgtaccgcacgatttagtaacaggcgaatacaatactcgccgtcagcaatgtgaagaggcagtaaaattttttggcgcgaaagcattacgagatgtttcagttgagcaattccaaaaaagagaagcagaattgaccgcactttctccgttagcagcaaaacgtgctcgtcatgtcgtaacagaaaatcaacgagtacttgatgcggtagaagcattgaagaacaatgatttgacttgtttaggtaaactaatggaagcatctcacgattcaatgcgtgatgattttgaaatcaccgtgccacaaattgattatttagttgaattggctcaacttgttattggcaaaagtggcggtgcacgtatgacgggcggcggttttggtggctgtattgtcgcacttacgccgcatgataaagtcgatgcagttcgtaaaattattgcggataattacgagaaaacgactggtttaaaagaaactttttatgtgtgtaccgcatcacaaggtgtgcgagtgatttaagagaaaatgatgttagaacaaaccacttttaatgcgcctgatggtgcaccttatcagcttataaccctacaaaatgaaaatgggatgcgtgttcaatttctggattggggcgcaacttggctttcttgtaaagtgccagtaaatgacacattacgcgaggttttattgggttgtaaggtagagaattatcccactcatcaaagctatttaggcgcaagcgtagggcgttatgcaaatcgtattgcaaatgcacaatttgaattgaatggcgaacttattaaattaagtagtaatcaaggaaagcaccagcttcatggtggagagggttttgataaacgtcgttggaaaattcaagagtgcggtgagaattttgtgtgtttttcattacagtcagagcatggtgatcaaggttttcctggtaatgtggatgtgtctgtaacctatacgctaacagatgataatagcgtaaaaattgaatatgcagggatttgtgataaggatactgcattgaacctaacgaatcatgcttatttcaatttagaaaatgcagcgcaaggcagtgacgtgcgtgaacatacattacgtttaaatgctgatttttatctgcctgtagataatgaggggattcctaattctccattaaagcacgtggtgaatacaagttttgacttccgtattgctaaacccatcaagcaagattttttacaaggggatcagcaagcaacaaaaggttacgatcattcctttattgtcaataaagcttggcaaaagccttgtgtgttactaacctctccaactggcgatttaagtttggaagtaagaacctcgcaagctgcattgcaggtttatacgggtaattatcttgcaggtacaccaacgagaaatggcgaattatatgccgatttttctggcatagcactagaaacccaatgtttaccagatacgcctaatcatcctgaatggcaaaattacggcggaattcaaaaagcaagcgagcaatattatcaatggacagagtttaaatttaaataaaccattatttataataaaaatgtcattacaagatctataaattaggttcatttctagcgttaaaagcagtgacacaccaccagcctcttaatctaatttaattggtcaagcgatggcttttttatttacaaaggtttacactaacttcacatttactcaggaaatctattatgctcatttctcattctgaccttaaccaacaacttaaatctgctggaatcggctttaatgcaacagaactacacggctttttaagcggtttactttgtggtggattaaaagatcaaagttggctaccgctcttatatcaattcagcaatgataatcacgcttacccaacagcattagttcaacccgttacagaactttatgaaaaaattagtcaaaccttatcagatgttgaaggatttacctttggacttggtttaaccgaagatgaaaatgtctttgcacaagcggatagcctatctgactgggcaaaccaattcttacttggtcttggcttagcacaacctgaattagcaaaagaaaaaggtgaaattggcgaagcggtagatgatttacaagatatttgccaacttggttataatgaagatgataatgaagaagagcttgcggaagcactagaagaaatcattgaatatgttcgcaccattgcaatgttattctattctcatttcaacgaaggagaaattgagagcaaacctgtattacattaaggagatctaggatggaattgacttatatggctaaattgcctaaagaagaatttgaggaacgtcgcacacgagtattcgctcaaatgcaacctaattcagcattattgcttttttctgaaatcgaaaaacgccgtaataatgattgtacctatcctttccgtcaagatagctatttttggtatttaacaggctttaatgaaccgaatgcagcactgttattactgaaaacagaacaagtagaaaaagccattatttttcttcgtccatgcgatccgttacttgaaacgtggaatggtcgccgattaggtgttgagcgtgcaccacagcaacttaatgtaaatgaagcctattctattgaagaattcgctaccgtactgccaaaaatactgaaaaatttgaccgcactttaccatgtgccagaaattcatacttggggtgatacattggtgtcagaaagtgcggtgaattttagcgagattttagattggcgaccaatgctcagcgaaatgcgccttataaaatcgccgaatgaaatccgcttaatacaacaagcgggacaaattacggcacttgggcatattaaagcgatgcaaacaacacgcccaaatcgctttgaatatgaaattgaaagcgatattttgcatgaatttaatcgccattgcgcaagatttccttcttacaattccattgttgcaggaggaagtaacgcctgtattttgcactacacagaaaatgatcgcccattaaatgatggggatttagtactgattgacgctggctgtgaatttgccatgtatgcaggcgatatcacccgcacttttcctgtaaatggaaaatttagcccgcctcaacgtgaaatttatgagttagttttaaaagcccaaaaacgtgcgattgaattacttgtaccgggcaattccattaagcaagccaatgatgaagttattcgtattaaaacccaaggattagtggatttaggcatcttaaaaggagatgtggatacacttattgaacaacaagcttatcgccaattttatatgcatggattagggcactggctagggttagatgtgcatgatgtgggtagttatggccaagataaacaacggatactcgaaatcggtatggtaattaccgttgagcctggtatttatatttcagaagatgcagatgtgccagagcaatacaaaggcattggcgtgcgcattgaggataatttactcatgactgaatatggtaataaaatcctaaccgctgctgtccctaaagaaattgcagacattgaaaatttaatgaatttttaataaaaatgtttaaattgtgatctagtacacagttttttattgctcaaaatgttagcattggagccagttaaaaaccgaaccaatcagttaaggagtcgattatgtacaaacacgttttagtagcagtagatctttctgaagaaagtccaattttacttaaaaaagcagttgggattgctaaacgccacgacgcaaaactttctatcatccacgttgatgtgaacttctcggatctttatactggattgattgatgtgaatatgtcttcaatgcaagacaggatttccacggaaacacaaaaagccttattagatttagctgaaagtgtggattatccaatttcagaaaaattgagtggcagcggcgatttaggacaagttttaagtgatgccatcgaacaatatgatgtggatttattagtgacgggacatcatcaggatttttggagtaagttaatgtcttcaacacgtcaagtgatgaatacgattaaaattgatatgttggttgttccgcttagagatgaataattaacaagaaattgttttttgaataatctgaaataacttaaattttaaccgcacttctcaaatagcgtcgtgaagtgcggttttattttggggttttggcaaaaagcctttttataaatttcaaaaatatgcaaaaatagggcgatttagtttttattttattatgggtaacaaggattctttttaatgaaaacaacagcagaaataagacaatcattccttgattttttccatagcaaaggtcaccaagtagttgagagtagctcacttgtgccggaaaatgatccgactttgcttttcacgaacgctgggatgaaccaatttaaggatgtattccttggaatggataaacgcccttattctcgagccaccaccgcacaacgttgcgtgcgtgctggtggtaagcataacgacttagaaaatgttggttataccgcgcgtcaccatactttctttgaaatgctcggtaacttcagttttggtgattactttaaacaggatgcgattaattttgcttgggaatatttaacttctccacaatggcttggtttacctaaagaaaaactctgggtaaccgtgtatgaaactgacgacgaagcctataatatttggaataaagatgttggtgttcctgctgaacgcattattcgcattggtgacaataaaggctcaccttacgcatcagacaacttctgggcaatgggcgacacaggtccttgcggtccttgtactgaaattttctacgatcacggcgatcatatttggggcggacctccaggctcaccagaagaagatggcgaccgttatattgaaatctggaacgttgtgtttatgcagttcaaccgtttagcagatggcacaatggaaaaattacctcgtccgtctgttgatacaggtatgggtttagagcgtatttctgctgtgttgcaacatgtgaactcaaactacgagattgatattttcaaaacattaatcgcaaaaacggcggaaattgtaggcgcaacagatttaactaacaaatcactacgtgttattgctgaccatattcgttcttgtgcatatttaatcgccgatggcgttatcccatcaaatgaagggcgtggttatgtcttacgtcgtattattcgccgcgcagttcgtcacggtcatctattaggtgccaaagaatcctttttctataaactcgtgccaactctaattgaagtaatggctgaagctggaaaagatgtaaaagcaaaacaaacaaatgttgaaaaactattacgtctagaagaagaacaatttgctcgtactctagagcgtggcttgagcttattagatgaagcactttctcaagtgaaagatggcattctttcaggtgaagttgcattcaaactttatgatacttatggtttcccattggatttaacggctgatgtatgccgtgagcgtaacattactattgatgaacaagcgtttgaccgtgaaatggaagcacaacgtactcgtgctcaagcagcgagccagtttggtgtggactacaacagcgttattcgtgtagatggcgaaactaagtttgaaggctatactgaagtagaatctcaggcaaaaattaccgcacttttctatgatggtaaatcagtggaaagtatcgaagtaggtcaaagtgcggtcgttattttagaaaatacgccattttatgcagaatcaggtggtcagattggcgatagcggatatttaagcacacaaggtgtaacctttaatgtgaaagatacccaaaaatatgggcaagtatttggacacattggggaattaacgcaaggaagtttaaaagttggacaatcagtgaatgcgattgtggacgctaaacgtcgccacaacacatcactcaatcactcagcgacacacttattgcacgctgccttacgtcaaattctaggtttacacgttgtgcaaaaaggttcgcttgtttcagataaagccttacgttttgactttgcgcaaccagaagccattaccaaagagcaattgagtgaaattgaaacattagtaaaccaaaaaatccgcgctaactttccagttcaaacggatattatggatattgattccgcaaaagcgaaaggagcaatggctctctttggcgaaaaatatggcgataaggttcgtgtattaacgatgggcgatttctcaattgagctgtgtggcggtattcacgcaaaacgcacaggcgatattggtttatttaaaattattactgaaaacgcagtggctgcaggcattcgtcgtattgaagctgtaacaggtcaaaatgccattgactggttacataatcaacaacgcattctgacccaaagcgcagacttattaaaatcagacgtaaataccttagtggaaaaaatccaacaacttcaagacaaaacgaagaaagtggaaaaagaattacaaggtctaaaagaaaaagccgcaatgcaggctggttctgattttgtaaaaagtgcggtcaaaatcaacggtgtttctgttattgcacaacaattagatggtatagaaacaaaatcattacgcgtaatggtcgatgatttaaaaaatcaactcggatcaggcgtaattgcatttgcatcaatattagatgaaaaagttaatctcgtcgttggagtgacaaatgatttaaccgccaaaataaaagctggagaacttgttaatttaatggctcaacaagttggaggaaaaggcggtggccgtccagatatggcaatggcaggaggttcccaaccagaaaatgtggcacaagcaattaaagtggcacaagactggttaaacaaaaatctgtagtacaagctggttggtggaatgccaaccgttccttgattgataggatatctaataaatgcaaactaaggagataaaagatgttaatcttaactcgtaaagttggcgaaagtgtacttattggagatgatatttctatcacggttttgagtgtacgtggaaaccaagttaaactcggtgttgaagcacctaaagaagtatccgttcaccgagaagaaatttaccaacgaattaaacaaacgaaagatgaaccctatttaggttcctcttagttaaacaatggatataataatatgaaagcaattattcctgtcgccggtcttggcacacgtatgttgcccgccacgaaggcgattccgaaggaaatgctcactttggtggataaaccgttaattcaatacgtggtaaatgaatgtgtagctgctggcataaaagaaattgtgctggtaacacattcatcaaaaaatgctatcgaaaaccattttgatacatcttttgaattagaaacaatgctggaaaaacgtgtgaagcgtcagcttctagaagaagttcgttctatctgtccaaaaaatgtaaccattatgcacgttcgtcaaggtaatgcgaaaggtttaggtcacgccgtgttatgcggtcgtcctttagtaggaaatgaatcttttgccgttatgttaccagatgtattattagctgaatttagtgcagatcagaaaaaagaaaatcttgctgcaatgattcaacgctttaatgaaactggcgcaagccaaattatggtaaccccagttccgcaagaaaatgtgagtagctatggtgttgcagattgtggtggcattgagcttaatggcggcgaaagtgcaaaaattaatagtattgttgaaaaaccttctattgaagacgcaccatcaaatcttgctgtggttgggcgttatgttttttcagcagcaatttgggatttgttagaaaaaacaccaattggtgttggcgatgaaatccaattaaccgatgctattgatatgctcattgaaaaagaaaccgttgaagcatttcatatgacaggggaaacttttgattgtggcgataaaattggttatatggaagctttcgtagaatatggtattcgtcacgaaaaattaggtaaagaatttaaatcctttatcaaaaatttggcaaaaacgctataaatagcactaatacaaataaaatggacaaaatgaaagattttgtccatttttgttttattattaatatagaatattgctttatgaataaatatgcacaataatagaataattaattaaaacaaaaaggaaaaattatggcactttggggtgggcgttttacacaagccgcagataagcgttttaaagattttaatgactcattacgttttgactatcgtttggcagaacaggatattcaaggctcaattggctggtccaaggccttagtaaaagtgaatgtattaactgttgaagaacagcatcaacttgagcaagcactaaatgaattacttgttgaagtgcggtcaaatccgcaagcaattttacaagatgatgctgaagatattcatagttgggttgagagtaagctaattgataaagtaggcaaccttggtaaaaaattacatactggtcgtagccgcaacgatcaagtggcagtagatataaaactgtggtgcaaacagcgtgtggttgaattacaagaatccgtgcgtaatttgcaacgccacttagttcaaaccgcagaaaacacacaacaagcagtaatgcctggctacacccatttacaacgagctcaaccaatcacttttgcccattggtgtatggcatatgtggaaatgttcgaccgcgactattcacgtttaacagatgcgtataatcgtatgaatacttgtccacttggtagtggtgcgctggctggtacggcttatgctgtagatcgtgattcacttgcgcacgatcttagttttgctttcgcaactagaaatagcttagatagcgtctctgatcgcgatcatatcgtagaattactttctatcgcctctcttagtatggcacatctttcccgctttgctgaagatatgattatctttaacagcggagaagcaaatttcgtggaactatccgatcgtgtgacttctggttcatcattaatgccacaaaagaaaaatcctgatgcttgtgagttaattcggggcaaaacggggagagtaattggttcattaacatctatgttaatcaccttaaaaggcttgccacttgcgtataataaagatatgcaagaagacaaagagggcatttttgatgccttagatacttggcaaaactgtgtagatatggcaacgttcgtcttagatgaattgaaagtaaatgttgaacgtactcgtgaagctgcgttaaaaggatattcaaacgcaactgaattagcggattatttagtctctaaaggcgtacctttccgagattcccatcatatcgtgggcgaaacagtggtttatgcaatcgagaaaggcaaaggattagaagatctgactatccctgaattccgccaatttagtgaagtagtgggagatgacgtttacgagattctttctctccaatcttgcttagacaaacgttgtgcaaaaggtggcgtatcgccattgcgtgttgccgaagctattgcagaagccaaaacaagatttgcttaattaatattataacttagagatcacattggattttacaagcctctaagtaccacctatttataagcaaaaacacttaaataagatgataaaaacaaaaagtgcggaaaaaaccaccgcactttttatctcaattaggaataatcaatgaccaatcaacaagactatactcaagacaatgacaaactttaccgttatcttttccaacatcgtgcagttcgtggagaatgggttcgcttaaataaaacatttactgatacattaaatacccatcagtatcctaaagcagtacaggatttattgggagaaatgatggtagcgactaatttactcactgccacactaaaatttgccggcaatattaccgtacaaattcaaggcgatggcccattacgcttagcattagtaaatggtaatgatcaacaacaaatccgcgcccttgctcgagtggatggcaacatcactgaaaatatgagtctgcataatatgattggtaaaggcgtattggtcattactattgcaccaaaagaaggcgaacgctatcaaggtgtaattagcttggataaacccacgatcacggaatgcttagaagattattttgtacgctcagaacagcttcaaactcaattaattattcgtactggagaatatgaaggcaagccagtggcagcaggtatgttattacaaattatgcctgatggttctggtacaccagaagattttgagcatttaactacgctcgcagcaacagtaaaagatgaagaattatttggtctccctgcagaagagttactctatcgtttatatcacgaagaaaccgtcaatctttatccagcacaagatgtacaatttttctgtggctgctctgctgagcgttctagttctgcattactgctcatctctgatgaagaaattgacgaaatattagccgaacataaaggcagtattgatatgcaatgtgagtgttgtggtacacactacttctttaataaagaagcgattgaaaaattaaaatcaacaagagtttaaaaacaatcccgacacaatgtcgggatttttgctctatatcacaatatcactaaaaagaggtaaagttcttaaaaaaatgtttaaaaatgagatctacttaacatttttttatattgacatccattataataagccacagttaaattttaatcttacatattagaggtgacttatgacagacttaaataaagtggtaaaagaacttgaagctcttggcatttatgacgtaaaagaagttgtttacaatccaagctacgagcaattgttcgaagaagaaactaaaccaggcttagaaggctttgaaaaaggtactttaactacgactggtgcagtggcagtagatacaggtatcttcacaggtcgttctccaaaagataaatatatcgtgttagatgaaaaaaccaaagatactgtttggtggacatctgaaacagcaaaaaacgacaacaagccaatgaaccaagctacatggcaaagcttaaaagacttggtaaccaaccaactttctcgtaaacgcttatttgtagttgatggtttctgtggtgcgagcgaacacgaccgtattgcagtacgtattgtcactgaagtagcgtggcaagcacattttgtaaaaaatatgtttattcgcccaactgaagaacaactcaaaaattttgaaccagatttcgttgtaatgaacggttctaaagtaaccaatccaaactggaaagaacaaggtttaaattcagaaaactttgttgctttcacttggactgaacgcaacaaagttttctgaatttaaccttgttctttccagtttggattggttactttagaaccgttcattacaacgaaatctggttcaaatttttgaggttgtcttcagttgggcggataacatattttttacaaaatgtgcttgccacgctacttcagtgacaatacgtactgcaatacggtcgtgttcgctcgcccacaggaaccatcaaactacaataagcgttttcgagaaagttggtggggtacnagtctttttagcctggcttggaggctggtccaaaggcttgtgggggtttcagcagtttnggtgtcnncaaaagaccnnngggcttcttcttgccgcccgttttttantccttgtacgcctccggngganttctctcaaattgtcctgnggaggaacactttttntgtagacaggtgtggtttctccctttntatgtacagcactananaagaaaaaaaactcgttctactcacnaatcaaaaaaanatnnnnnancatttacatctttaagctcanccnntntggaggaaagaacacgtatgcatcnnnannaancanagntnnccacnnnttactaaaaaacnnantntnannttaaanntnctcttnatggccatcagcttttcctactcgcctccctnnncnnncctannancnacancccnccgcnacatnngtcttcttccnnncttttngnnnnttnttnntttcttaaatatnngaatataatntcctcattcaattatcccanantttnnnnctcaccatcccntaatactcngttnatgaaccttnccacaacccactcgcttgcccacntacatcacttctccannttnnnnacannatnncnnnntaatttntccttct

SEQ ID NO: 678 - DNA, 28590 bp, H. influenzae
ggagagaggacggatgagaagagacgatggggggggggggcggaaatcaataaaatgggtgaatgggcgataataggccaggtgttctagaagaggttgtgttaccaagaagaagaagagtgtagtggtaaaagggaagaaagaaagggtaaatggaggggaaagggttgataacgggcgaagggtatgaagctaagccggtgaaacagagttacgagggcggaggttgagaagaagttggtaaccaaccagatttggtcgtagacactaaatttgtatgggatggtgtctgtggtgcgagggaaacacaacagtagtggcagtacgtattgtcgactcaattagagaggcaaggcgcgttttgtagaaaatatgtttattcgccgatataaagaacaggctcgaaagttttgatccagatttcgttgtaatgaacggttctaaagtaaccaatccaaactggaaagaacaaggtttaaattcagaaaactttgttgctttcaacttgactgaacgcattcaattaatcggcggtacttggtacggcggcgaaatgaaaaaaggtatgttctcaatgatgaactacttcctacctctcaaaggtgttggtgcaatgcactgctcagctaacgttggtaaagatggtgatgtagcaatcttcttcggcttatctggcacaggtaaaacaaccctttcaacggatccaaaacgtgaattaatcggtgacgatgaacacggttgggatgatgttggtatctttaactttgaaggtggttgttatgcgaaaaccattcatctttcagaagaaaatgaaccagatatttaccacgctatccgtcgcgacgcattattagaaaacgtggttgttcgttcagatggttctgttgatttcgatgatggttcaaaaacagaaaatactcgcgtgtcttacccaatttatcacatcgataacattgtaaaaccagtttctcgtgcaggtcacgcaactaaagtgattttcttaactgcagatgcgtttggtgtattacctccagtatctaaattgacaccagaacaaactaaatactacttcttatctggtttcacagcgaaattagcagggactgaacgtggtattactgaaccaacgccaactttctcagcatgtttcggtgcagcatttttaacgcttcatccaactcaatatgcagaagtgttagtaaaacgtatgcaagcagcaggtgctgaagcttacttagtgaatactggttggaatggcacaggcaaacgtatctcaatcaaagatactcgcggaatcattgatgcaatcttagatggctcaattgaaaaagctgaaatgggcgaattgccaatcttcaacttagcaattcctaaagcattaccaggtgtagattctgcaatcttagatcctcgcgatacttacgcagataaagcacaatggcaatcaaaagctgaagacttagcaggtcgttttgtgaaaaactttgttaaatatgcaactaacgaagaaggcaaagctttaattgcagctggtcctaaagcttaattaaaaatactaaaaatattaaccgcactttgggtaactgaagtgcggtcattttttatctgttttcaagctgataaatgtattcaaaaatttaaaaaaatccagtaaaatcacggcgttctaactttcatcaattaaaaaggacaatgcaatgcttaaccaaattaaaaaagatgctcaagatcgtatggaaaaaagccttgaagcattaaaaggtcatatttcaaaaattcgtactggtcgtgctcaaccgagtttacttgatgcaattcaagttgaatattacggtgcggcgaccccacttcgccaattagcaaacgtagtggcagaagatgcgcgtactttagccgtaactgtttttgatcgttctttaatctctgcggtagaaaaagcaattttaacctcagatttaggtttaaacccatcttcagcgggtaccacaatccgtgttccgcttccgccattaacagaagaacgtcgtcgcgatttaatcaagatcgtaaaaggcgaaggtgaacaaggtaaagttgcgattcgtaatgtgcgtcgtgatgcgaatgataaaatcaaagcattattaaaagacaaagaaatcagcgaaaacgaacaacataaagcagaagaagaaatccaaaaaatcacagatatttacattaaaaaagtagatgaagtattagcggataaagaaaaagaattaatggatttctaatcatcaaaaaatacgaaaggcagacagttttgtctgcctttattttattaggtatgcgaatttagacgtaccaatgaaaatataatcaacaaagtgcggtaaagattctatgcaaaaacaaaacattgtcattcttggttcaacgggatcaatcggtaagagtaccctttctgttatcgaaaataaccctcagaaatatcatgcatttgcactcgtcggcggaaaaaatgtagaagcaatgtttgaacaatgtatcaaattccgaccgcactttgcggctcttgatgatgtaaatgcggctaaaattttacgtgaaaaattaattgcgcatcatattccaacgaaagtattagcaggacgacgagctatttgcgaactcgcagcacacccagatgccgatcagataatggcgtcgattgttggtgcagcaggattgttaccgactctttcagcggttaaagcaggtaaacgggtattactggcaaataaagaatcactggtaacctgcggacagctttttattgatgccgtaaaaaactatggctcgaagcttttaccagtagatagtgaacataatgctatctttcaatcattaccgccagaagcacaagaaaaaatcggtttttgcccactttctgaattaggtgtaagtaaaattatactcactggttctggcggaccattccgttacacgccacttgaacaattcaccaacataacaccagaacaagcagttgcgcaccctaattggtctatgggtaaaaaaatttctgtcgattcagctacaatgatgaataaaggcttagaatacattgaggctcgctggcttttcaatgcaagtgcggaagaaatggaagtcattattcatccacaatcaattattcattctatggtgcgttatgttgatggctcagtcatagctcaaatgggaaatccagatatgcgtacaccaattgcagaaactatggcatatcctcaccgcacttttgctggagtagaaccactcgatttctttaaaatcaaagaactgacttttattgaacctgattttaatcgctatccgaatttaaaactggctattgatgcctttgctgcgggtcaatatgcgacaacagcaatgaatgcagctaatgaaattgccgtacaagcatttttagatcgtcaaattagttttatggatattgcaaaaattaattcgaaaacaattgagagaatttcgccttataccattcaaaatattgatgatgtactcgaaattgatgcacaagcaagagagattgcgaaaacactaattagagaatagacctagaataactaggtctagtttattcgatttaatggaatacaaattccaaaatgcacatataggctgcaatacaaaataaaataatcgccaataattttcttgttaaaactggattcattaatccacgcaatttcattgagaagaaactcattccaaatgaacccaaggtaacgacaccaactacaagaaagtttacatatcctagttggccacttaggctgatatcatagggaaaagctctagtgagatagccgtatagattaccaataccaccaataatcatcatatagttcgtataaacggcaatttgttgcgtttttaccccctttaattgcccgacaaggggcgcaagaatagaaccgcctccaatacctgtaatacccgcaattaagcctcctccacaaaaactaatactacctttagctcgttctataggagacatattaaacacttctatttgtattctcgatctgttcaaaaatgttttaatcgctagtgcacttaaactaaccgtaaaaattaaactaattatcgctgtagaaaaataaaaacttaattcaaaaccaatttgcaccccaatcaccatagcaatagaccataaaatcatattgatataatcaattttaattttttgcttatggaaaaataataaattaatcaatgcggtacacatcacaatggtgagtgacgtagctgaaataacttgaatcggtaacgcaggaaacaatgtacgtaaaattggcaccatcaataccccaccgccaataccaaaaatagcagaaaccatattggtacaaataccgcaaatcagtaagataaaaattgtactaaacgccatcttagatcctatttaaaaattcatttaatcatacttcattttgacgtaagagcatatgcgcaacttatgatcgctatcatatacagttaaaattattctgctatgataaaaagaataaggaggatacgtagatatgaattcatttcaattaatggcaaaacctactggttcaatttgtaatttagattgtaaatattgcttttacttggaaaaacctcacttaaatcaacgggctatgactaatgaagtattagaagcctatatcaaatcctatattgaagcaacgcctcaacaacaagttactttcctatggcaaggcggcgagccaaccctagcaggtcttgatttctacaaaagagcggtcaatttttaattaatatttttgatgaatggtatgccaatgatgtcggcaaaattggtattcaatttattgaacaatggtttatggcttaccttggtttacaaccaagtttatgtatttttcgtgaaacctgcggcgatcaattggttattgaacaaaatggcgatatttatagttgcgatcattatgtttatcctgaatataaactcggaaatcttattgaaacccctctaatacagctccttgataataatactaaacaaaagaattttggtgcagcgaaatcttttctttccgaacagtgtaaaatctgtaagtttcgctttgcatgtcacggaggatgtccaaaacatcgtacaattcaaggatttggtaaaacacataatcaactttgtgaggcatattattcagcactttctcatatggatccatatttaaagtcatttgcaaaatcatttggcaaaataaaataatatttatctagttcaaaattttgttaaacacttcacattttcataatttgcttatagaagaaaaatatagaaatttgtatagtaatctaaagttattgatatattaaaagacgcctttatgtttacattgtcctattatctaccacaaaacttaaataaatgtattatttctgagagtaaaactctagaaaaaaacagcttaatttatgcacaaggcgagaagcctaaagaattttattttttaaaacaagggctagttggtctgtatcatagtctggaaaatggcaaagaaacattgactcgactttatcacgctaatgaatattttggttttcgtactatttttagtgaaacatcttatcattgcagtgcaaaagtattaatggaagccgatatagttagaatatttcctggtaatcacgcaaattttattgcaaataaccctgatttttcttgttatcttatgaaacaactttctaatgaattatatgatgcagaacaccgaataagtaatacagcttataagcgtagttacgaacgtattattgatgccattgaaaatttaactgaaagttatcccgattatccttggacctaccgagaagtagcggaattttgtggatgtgaaactgaaaccgcaattcgtattagtagagagcttaaaaaacaaggaattttagataaaaatacacgacatctacgaatatgctcttaaaatttaccactgctcgctgattgtaaataatatatctaagtaatgattaaatcagataaagatttttgtaatatataaaataaaaaagcccactatataaagtgagcttctttttagaattaatttttattcctcagttgttgcctcagcaacttctggacgatcaactaactcaatgtatgccattggtgcattatcgcctgcacggaaaccacatttcaaaatgcgagtgtaaccacctgcacgttgagcaaaacgtggacctaattcattaaataattttgcaacagtttcaacgttgcgagtacgagcgaatgctaaacgacggttagcaacgctatctacttttgctaatgtaattaacggttcaactacacggcgtaattctttagctttaggcaaagtagtcttaatgatttcatgactaactaaagcacttgctaagttacggaacatcgcttgacgatgactactattacggtttagttgacgaccactcttacgatggcgcatgatcttatccttctcagaaaaatcttaacctatgaccaaactagtcttcagcaatacttgctggcggccaattttcaaggcgcataccaagtgacaagccacgagaagcaagaacatccttaatttcagtaagagatttcttaccaagattaggggtttttaataattctacttcagtacgttgcactaaatcaccgatataatgaattgtttctgctttcaaacagttagcagaacgaactgtcagctctaaatcatctacaggacgtaataaaatcggatcaaattccggtttttcttccttaatctcaggctgacgaacatcacgtaaatcaacgaatgcatcaagttgctccgccaagattgttgctgcacgacgaattgcttcttctggctcaagtgcaccattagtttctaactcaataacgagcttatccaaatctgtacgctgctcaacacgagctgcctctacattatacgcaattcgttcaaccggactataacaagcatcaacaagcaaacgaccaattggacgttcttcttgcgtatgtgtacgagatgaagcaggaacatatcctctaccacgctgaacacgtatacgcatactaattgaagcgttttcatcagttaaatgacaaatcacatgatctggatttacaatttcaacatcaccatcatgggtaatgtccgctgcaacaacagggccaattccagatttatttaatgtcagaataacgtcatctttattctgtactttaaccgctagacctttaaggttcaaaagtacttcaagaatatcttcttgaacaccttccttactactatattcatgcaatacgccatcaatttctacttcagttacagcacaacctggcattgaagacagaaggatacgacgcaatgcattacctagagtatgaccaaaaccacgctctaacggttctaagatcactttagcatgtgttgaactaatttgttcaatatctactaaacgtggttttaaaaattctgtaacagaaccctgcattttatcctctctttggttttaagcttaactattatttagagtaaagctcaacgatcagatgttcgttaatatctgctgataaatcagaacgttcaggaacacgtttgaatacaccttccatttttgcagaatcaacttctaaccatgttggtttttctctttgctctgctaattctaatgatgctttaatacgagcttgttttttcgatttttcacgaatagcaactacatcatttacagaaacttggaaagatggaatattaacaacacgaccattcacaacaattgctttatgactcactaattgacgagcctctgcacgagttgcagcaaatcccatgcgataaacaacgttatccaatctaccttctaataacactaataaattttcaccagtgttacctttcaaacggtttgcttctttatagtagttacggaattgacgttctaaaataccatagatacgacgaactttttgtttttcacgtaactgactaccatagtcagacaaacgcggtttacgagcaccgtgctgacctggtgctgtatcaattttacattttgaatcaatcgcacgcacgcctgatttaaggaataaatcagtgccttcacgacggctgagcttgagtttaggacccaaatatcttgccattttctttctccaactatcctatacgtcttaaacacgacgttttttcggtggacgacaaccgttatgaggaatcggagtcacatcagtaatattcgtgatacggaaacccgctgcgtttaacgcacgaattgtagattcacgacctggacccggacctttaaccataacttccaagttctttaagccaaattctttaacgatttcagcacaacgctctgccgcaacttgcgctgcgaacggagttgatttacgagaaccacggaaacctgaaccacctgcagttgcccaagctagagcattaccttgacggtcagtaatagtaacgattgtattattgaaagatgcgtgaatatgtgctacgccatctacaacttgtttttttacacgtttacgtgcacgaactggtgttttagccattcttatttaccccgactattttttgatcggcttacgtggacccttacgggtacgcgcattagttttagtacgttgaccacgtactggtaaactacgacgatgacgtaaaccacgatagcatcctaagtctaaaagacgtttgatgtttagtgttacttcacgacgtaagtcaccttcaacggtaaatttaccaacttcgtcacgcagtttgtcaatctgctcttcagacaattctctgatcttaacatcttcagcaatacccgctgctgcacaaatagcttgtgaacgagttttaccaataccgtaaatggcagttaaagcgattacagcgtgtttatgatcaggaatgttaatgcctgcaatacgggccactatgcactcctatattttaattaatttgatattctgatcttgaaaagcccgttttcaggatactcaaacagaatatcaaggacataaatgagttgagcagtataactactcaactggttcttggcaagaaaaatgttaattaaccttgacgttgtttatgtttagggtcgctacacaatacgcgtacaacaccctcacgtttaacaatcttacagttacgacacattttctttacggaagcacgaactttcattgcttatccttttactttaaatgaacaattattgtccaaaacccttaaggtttgcttttttcaacgcagattcatattgagaagacattaaatgactttgaacctgaacgatgaaatccataattacaacgactacaattaaaagagatgttccaccgaagtaaaatttaacatcccaagccgatgtcataatataaggaactaaacatacaaacgttacatagagaccgccaattaatgtaagacgagtcatcactttatcaatataacgtgatgtttgttcaccgggtctaattcctggaataaatgcaccagatttttttagattatctgctgtatcacgaggattatattgcattgctgtatagaaaaaactgaagaaaataattgcaacagcataaacaagcaaataaagtggttgaccaggattcaataacattgataaattatttaaccattcaaatttatcattttgcccaaaccattgtgttaatgtagctgggaataaaataatacttgaagcaaaaattgctggcattacatttgccatattcactttcaatggtaaatgtgttgaatgaccacctaaaatttgacgaccttgctgacgcttcgcatattcaacgcgaattctacgttgtcctctttcaacaaaaacaacaaaataagttactgcaaatacaatagctgcgatcagaagaagaactaatggatgcatctgtccttgacgagcctgctcaatagtttgaagaatggccgatggtaaaccagctacaataccgccaaaaacaagaattgaaataccgttaccaatacctctttcagttatttgctcacccaaccacataaggaacattgtcccagtgactaaactaacaactgaagtgaagtaaaaactaaatccaacatttggcactaagccagacaacatatttggtaagcctgttgaaatagctactgcctgaatcgttgcaaaaacaactgtcgcataacgagtatatttagaaattttacgctgaccagcagcaccttctttctttaattctgctaaagcaggagaaaccgttgcaagcaattgaattacaatagatgccgatatatatggcatgattcctaatgctaaaatggatgcacggcttagagcaccaccagagaacatgttaaacatgtcaatgatagtgcctttttgttgttcaactaattgagctagaacagtcgcatcaataccaggaaccggaatgaatgaaccaattcgataaacgataagtgcacctaaaacgaaaagtaatcggctttttaattcacctttaccgctattagtacttcttgcttgataacctggttgtttagccatttgctaattattcctcaattgaaccgccagcagcttcaattgctgcttttgcacctttagttacacgtaaaccgcgtaccgttactgcagatttcacttctccagctaaaattactttagcgaattggatatctttagttaagatatttgctgcttttaatgtttctaaagttactacattaccttcaactttggttaattcatttaaacgaacttctgcagtcactgcagatttcattgaagtaaaaccaaattttggtaaacgacggtataacggcatttgaccaccttcgaaaccgcgacgaacaccgctaccagtacgagatttttgacctttatgaccgcggccaccagtcttgcctaaacctgaaccaataccacgaccgaggcgtttagcactatgctttgcaccttcagccggagatagagtatttaaacgcatctcttactcctccactttaaccatgtatgaaacttggttaatcataccacgtactgcaggcgtatcaattaactcaacagtgtggtgcatatggcgaagaccaagaccacgcaaggtagctttatgcttcggtaaacgagcaattgagctacgaacttgtgttactttaatagttttagccattattcattaccccaagatttcatcaacagttttaccgcgttttgcagcaaccatttctggtgatttcatatttgctaatgcatcaatagttgcacgaacaacgttaatcgggttggtagaaccatacgctttagaaagaacgttacgtacacctgcaacttccaataccgcacgcattgcaccaccagcgatgatacctgtaccttcacttgctggctgcataaatacacgtgaaccagtatgaacacctttaactggatgttgtaatgtaccttcatttaaagcgacattaatcatattgcgacgtgctttttccatcgctttttggatcgctgctggaacttcgcgagctttaccataaccaaaacctactcggccattaccatcgcccaccacagttaatgcagtgaaactcataatacgaccaccttttacagtttttgatacacggtttactgcgattagcttctcttgcagttcaccaacttgtttttcgatgtttgacatctcaatttacctcattagaactgtagaccagcttcacgtgcagcgtccgctaaagtttggacacgaccatgatatttaaaaccggaacgatcaaaagcaacagcttgaacgccttttgctaatgcgcgttctgcaacagctttaccgactgctgcagcagcatctttattaccggtgtattttacttgctcacgaattgctttctcaacagttgaagcagcggcaagcacttctgaaccgtttggtgcaataacttgtgcataaatatgacgtggagtgcggtgaataactaaacgagttacaccttgctctctcatcatatgacgtgcacgagctgcacgacggatacgagctgatttcttatccatagtgttaccttaattatttcttcttagcctctttgatacgtaccacttcatcagcgtaacgtacccctttacctttataaggctcaggacggcgataagcacgaatatctgctgcaacttgaccgatcaactgtttgtctgcacctttcaacacgatttcggtttgagatggacattctgcagtaatacctaccggcaaagtgtgctctactgggtgagaatagcctaaacttaatgcaattgcgttacctttaagttgagctctgtaacctacacccaccaatactaattttttagtgaaaccttcagtaacaccgataaccattgcattaactaatgcacgtgcagtacccgattgagcatttgcttcaacaaaaccttcacgtggagtgaacgtaaattgtccgttatcttgttttacttcaactgattcatgaattttgcgagataactcgccatttttaccttttactgttaatagctgaccgtcgagtttaacttcaacgccggcaggaatattaacaggtgcctttgcaacacgagacattttcctacctctctattaagctacataacagatgatctcaccgcctaaacctgcttgacgagcagcacggtcagtcataacacctttagatgtagaaataactgcaacacctaaaccgcccataacttttggtaattcatctttacgtttgtaaatacgaagaccaggacgacttacacgttggatgctttctacaactggtttgccttggaaatattttaaagtaatttccaattcaggtttagcaccttctaaaacttttacgctttcgatataaccttcagcagctaatacgttggcaattgccacttttagcttggaagaaggcatattgattgcaactttgttcgcagcttgaccgttacgaatacgggtcagcatatctgcgattggatcttgcatactcattgtactttttctccgattccaaaataaagtggtatattaccagctcgcttttttaaggcctgggatttcaccgcgcattgcagcttcacgaaccttaattcggcttaaaccaaacttacgtaaaacgccatgaggacgtccagtttggcggcaacggttacgttgacgagatgggctagaatcacgtggtaaagtttgtaactttaacactgcatcccaacgatcttcatcagaggcattgacatcagaaatgattttctttaattcaacacgttttgcgtagaatttttcagccaatttaacgcgttttacatcgcgtgctttcattgattgtttagccattataacctgccttatttacggaatgggaaattaaaggcagcaagtagtgcttgaccttcttcatcattcttagcagtagttgtgatagtgatatctaaaccacgtacacgatctactttatcgtaatcgatttcagggaagatgatttgttcacgcacacccatgctatagttaccacgaccatcgaatgatttcgcacttaagccgcggaagtcacgaatacgtggaacagcaattgtaatcaaacgttcaaagaactcccacatacgctcaccgcgtagtgttactttacaaccgattggatatccctgacggattttaaagccagcaacagatttacgagctttagttactaaaggtttttgaccgctgattgctgctaagtccgctactgcgttgtctagcaattttttgtcggtcaatgcttcacccacacccatattcagggtaatcttttcgattcgtgggacttgcatgacagatttgtagccgaatttattttttaattcgcttactacttgatctctgtagtaatcatgcagtttcgccatcgcattactccagtttgttagataatttcattgttagatttgaagaaacgtacttttttgccgtcttcgaatctaaaacctacacggtcagctttatttgttttaggattgaaaatcgcaacatttgaagcgtcaattgcagcttcttttttcaccaaaccaccagcctttcctaatgcaggaactggtttttcatgcttagtaatgatgttgataccttcaacaaacactttaccgtttggtaacactttagttaccttgccacgcttgcccttatctttaccagtaagaacaattacttcatcattttgacggattttagcagccattacattccccttacagtacttctggagctaaagaaatgatcttcatgaatttctcagaacgaagttcacgagtcactggtccaaaaatacgagtaccgattggttgctcagtgttattatttaaaattacacaagcgttaccatcgaaacgaataactgagccatctgggcgacgaacacccttcttggtgcgcacaacaactgcttttaatacatcacctttttttactttaccgcgtggaattgcttcttttacagtaattttgatgatgtcaccaatcgcagcataacgacggtgcgatccacctagaaccttgatacacattacgctgcgagcgcctgaattatcagcaacatccagcatagtctgttcttggatcatattagtgctccgttaagattaaaaaaacaccctttcgggacgaacccatccacactattcagatagaatggcagataggcggcggattttatcaaaagaaaaagagaaaggcaatgataatttagcttcctcttattgatctatttactaaataatccagttaaaatttaccgcacttttggaattataaaaatatcctcatcctctcaaaaatttatcgaatgaaaaataaactgcagaaaaaatgaaacgctctcttctcttaccttagataaattcatcagttttcagattttgggaaaatttccttgcctaaaagccaaagatacagatcgagctcttttaagttaaatctttctaatttataaaatctttgaaaatctatcaaaatctctttaaattttctgtaattttttaaatctttccttttaaaggctgaaaatttatctactttattaaaatagaggagatcttgctccacatagctatcataaattgggaaagcaattggattatgatgactacaatatttagttgcaaaagagtaaaaatacttctccttaccaccaattgttacttctcctaattcacgaactaattcaatatcaccagattttaaacgtttatctagatctttaatacccaaaatatgctttgcaacatgatgaatagcaaatatatttgtactataaacattgttaggaatatttatattatcaagcactggctctataaaagtatcatctaacaaatataatcctgttacatattctcctaataagattctaaaagtctctcgatcatatatatctgcttctgtatccaaatcattttcatcataaaactctgtgatgccaatctcctcttcttgataaggaagatcatgtattaatatatacttcattgtatcagataaatgacaccaccaatcccaatcttcattagaaatattcccagtagtatctgtatcattgataagttcttctgggaatttatcctctgctaattttgacgtttctttacgggtatcaacgccgttgatgaaattaattaatctatgtcccaaataacgagtattccactcatcagaatattcaaaaccaagatcttcagaaatttctcttaagtaccattattaaaaatatttttttcagtatttgtttaggtgttatgtcaataacacctaaaagaaaaagtgcggttaaaattcattgaattttaaccgcactttaaaaacaaaaaagccaatagatttacactattggcttttattttattactctttgttattaattaagcaataactgctttctcaacaacacgaactaaagtccaagatttggtttttgatagagggcgacattcgcgaatctctacggtatcaccaactttggcttcattgttctcatcgtgtacgtgtaatttagttgtacgacggataaatttaccatataaagggtgttttaccttacgttcaatagcaacaacgaaagatttttccattttgtcgctaacaactttaccttgtacgctacgaattttatcagtcattactcacccgccttttcggttaatacagtttttacacgtgcaatatcacgacgcacttgcttagcctgatgggtttgttgaagctgaccggtggctgtctgcatacgcaacttgaattgttcacctaaaaggtttactaattcagcattcagctcttcaacactttttgtacgtaaatcttgagctttcattacatcaccgtcttagttacgaaagtggtcttaactggcaatttagcagctgctaatgcaaatgcgtttcttgctacttcttcagacacaccatccatttcataaagcactttacccggttggattaaggctacccagtactcaacgttacctttacctttacccatacggacttctaatggtttttcagtaattggtttatctgggaatacacgaatccagattttaccttgacgttttactgcacgtgacattgcacgacgtgccgcttcgatttgacgagcggttaaacgacaacgaccaactgcttttaaaccgtaagtaccgaaactaacttcagtaccgctcgcgataccacggttgcggcctttgtgaactttacggaattttgtacgttttggttgcaacatttagcgtttctccttacttacgacctttaccgcgaggagcctttttaggcttgtcggcaggttgttgttctgattgcgcaacggcagccattccaccaagaatttcacctttgaagatccacactttaacgccgattacgccgtaagttgtatgagcttctgcagtgttataatcgatgtccgcacgaagagtatgtagaggtacgcgaccttcacgataccattctgaacgtgcgatttctgcaccacctaaacgaccgctaacctcaactttgatacctttagcacctaaacgcatagcactttgtaccgcacgtttcattgcacgacggaacattacacgacgttctaattgagaagcgatgctatctgcaactaatttcgcatctaattcaggttttttcacttcagcaatgttaatttgagcaggaacgccagcgattttagacactgcgttacgtaatttttcaacatcttcgccttttttaccgattacgataccaggacgagctgtgtgaatagttacacgaatacttttagctggacgctcaatagtaatacgtgaaactgaagcatttgctaattctttatttaagaatttgcgtactttgaaatcgccttcaagattgtcagcgaagtcttgtgtattcgcgaaccaagtagagctccaaggtttaacaatacctaggcgaataccatgtggatgtactttttgacccattgctattcctctacttattaacgatctgacacaaccacagtaatgtggctagtacgttttaaaatacgatctgcacgacctttagcacgtggcataacacgtttcatgctaggaccttcatcaacgaagattttagcaactttaagatcatcaatatctgcaccgtcattgtgctctgcatttgcaatagctgattctaaaactttcttcactaaagctgctgcttttttgttagtgaaagttaaaatttctaatgcttgcgcaacttttttaccacgaattaaatcggcaactaagcgagctttttgggcagaagtgcgagcgtaacgatgttttgcgatagtttccatctctttacctcttatttcttagctttcttatctgccgcgtgaccgcggtatgtacgagtcggtgcaaattcaccaagcttatgaccgatcatttcatcagatacataaacaggaacgtgctgacgaccattatggactgcgatggtcaatccgatcattgatggaatgatcattgaacgacgggaccaagttttaattggttttttatccccgctttccaccgccttctctaccttcttcaacaagtgtaggtcaaggaaaggacccttcttgagagaacgtggcatggctaatcctctttaatttaatctattatttgccacgacgacgtacgatatatttatcagtacgtttgttgtgacgagttttcttacctttagtttgaacgccccaaggagttactgggtgtttaccaaagttacgaccttcaccaccaccgtgtgggtgatctactgggttcattgcagtaccacgaactgtagggcgaatgcctctccagcggttagcaccagctttacccaatacgcgaagcatatgttctgagttaccaacttcaccgattgtagcaacacattcagctaatactttacgcatttcgccagaacgtaaacgtaaagttacatagttgccttcacgtgcgatgatttgtacataagcaccagcagaacgagcgatttgaccgcctttacctggttttaattcaacgttatgtactgttgaaccaactgggatattacgcattggtaatgagttacccactttaattggtgagtttatgccagcttggatttgatcgcctactgacaaacctttaggtgctaaaatataacggcgttcaccatctttataaagcactaaagcaatgttagcagaacggtttggatcatattctaaacgctcaacaaccgctggaatgtctaacttgttacgtttgaaatctattaaacggtagtgttgtttgtgaccgccaccaatgtgacgagtagtaatacgaccatagttgttacgaccaccagttttagatttagtatctagaagaggtgcgtaaggttaacccctgtgtaaacaggggttcccgattttaacaacgtgacggcgaccagcggaggtcggcttccattaacgatagccattctctaatctcctccgatgactgtgcactgtccacgaagtccaagttttggccttcggctaaagttacataagctttttcccagtcggtgcggcgacccaatttgtttccgcggcgtttagttttccctttaacaacctcagtacggactgaatctacttttacttcaataattgagcaaccgcagcagcaatttcagctttgttcgcatctaaagcaactttaagtacaacagtgttagatttttcagcattgttagttgctttttcagagatgtgcggtgcacgtagcacacttagcaaacgttcttgactcatgctaggatctcctcaatttgtttcacagcatcaacagtaacaatcactttatcgaaagcgattaagctaactggatcgataccttgaacatcacgtacatcaactttatataagttacgtgcggctaagaatagattttcatctaaacttgctgtgataattaacgcatcttcaacggctaaatcttttaatttttgtactaaaactttagtttttggtgcatctaattcaaatttttccaccacaaccaaacggtcttgacgaactaattcagaaagaatgcttttgatagcaccacggtacattttcttgttcactttttggctgtgatcttgtggtttagccgcgaaggttgtaccaccagaacgccagattggtgatttaatatcaccagcacgagcacgacctgtacctttttgacgccaaggttttttacccgaaccagacacttcagcacgagttttttgcgcacgagtaccttgacgcgcacctgctgcataagcaacaacaacttggtggatcaacgcttcgttaaactcacgtccgaaggtagtttcagaaacagtgagtgcgtttgcacctacaacttgtaattccatctctatctcctagacttatgctttaactgccggcttaacgataacatcgccattgatagcaccaggtacagaaccttttactaatagcaatttacgctcagcatctacacgaacaacttcaagtgattgaacagttacacgttcagcacctaaatgtcctgccatttttttacctttaaacacacgacctggtgtttggttttgaccaatagaaccaagtacacgatgtgataaagagttaccgtgtgtagcatcttgagtacggaagttccaacgtttaacaccaccttggaaacctttacctttagaagtaccagtaacatctacttttttaacatctgcgaagatgtctacattgatttcttgacctaaagtgaattcttcaccttcagtacgaaattcccataaaccgcgaccagcttcaacacctgctttcacgaaatgacctgcttcaggtttagttacacgattcgcttttttagaaccagtagtaacttgaactgcagtatagccatcgttttcaagagttttaacttgagttacgcggttggcttcaatttcgataacggtaactggtactgacacgccgtcttcattgaagatacgggtcataccaactttacgaccgactaaaccaatcattgtaataacctcttaattaacctaggctgatctgcacgtccacgccggcagccaaatctaaacgcattaatgcatcaacagttttttctgttggctctacgatatctactaaacgtttgtgagtacgaatttcgtattggtcacgtgcgtctttgtttacgtgtggagaaatcaacacggtgaaacgctctttacgagttggtaaaggaattggaccacgaacttgtgcgccagtacgtttagctgtttctacgatctccgcagtagattgatcgatcaaacggtgatcgaaagcttttaagcggatacggattctttggttctgcattagaccagagctccaataaaatttagctaataaaaaaactaacaccaatcacaattctaacttcaaatatagaaaaggaggtgcaagttacctgttatatagtctccaaatcggaaacattgttagcctgacatatcgtcatgcccgttcaataaatgattacattaaacggctctcatattgagagtccgtgtattctatagaaagacaaccctatttgcaagcttttattttaactattttgttggcctaaaagcctctaataatttatcaaaaatatattcttcaaggtgtgtgtaaaccgtttttctttgacgacatagtgtcactttccacggaacaggactttcgattttacgacacaaaaattcttttgaatgataaagctcagccataggtaacggtagaatagttaataattctttgtttgttttgaccgcacttagcagaaaatcccaacaactcgaatccaaaacaatatctggataacaattattgcgctcaaaagcttccttcaaatgatgatgaatcataaatgtttgatcaaaaattgccattttctgctgatgtaaatcagcccatgtgatttgttgtttttttgctaagacatgctttggtgaaagaaataaggctaattcagaactatgaatttcaattgaatcaataatattttttgatattcgctcgggatataacaacacggctaaatcaactttatctaaaagaagttcactctttagagcataagctccaatttctttaataataaaattaatatctggattcttaagaataagatgaggcaatacagaagagaacacggctgataaaactaagggaggaataccaattgttatcgtgcctttcttacaatcttttgatttataaagatttgttctcatatcattgtaacgcttgatcacttcttttgcatcacgataataattttcccccgcaaaggttagtccaataatttttcctgatgcccgtttaaatatctgaatattttcacgattctcaaactccgtaatcatcatacttaatgcaggttgagacacatataaattttgagacgctcggcttaaattaaaatcattatctacgattgaaacaaaatatcttagatgcctaatatccatcattttcacccccctaaggactgccatttttacaaaatatagcacaaggattgtttaaaacactatcaaaataacttatacccgcctaagaaagatgtatttcttttacgaaattttttttgctatttttaatatcaatctagttcctttattgcctatcaaggatcatcacaagaaacatatccatttgaaatataagatacttatttgttgatattctttcttttaatctcgttattaggaggtctctatgacacaaaaacatcttaagcttaataatctaaatcaacacctacatgatggtatgagcatcatgtttggtggatttatgggtatcggcactccagccaaacttgtccaacaaatcttagattctggcgtaaaggatctcacactcataggcaatgacacagcctttattgacactggcgtagggcctttaattgtaaataatcgagtcaaacgtttaattacatcccatattggtacaaatccagaaactggcaaaaaaatgattgctggtgaaatagatgtagaactcgttccacagggtaccttagctgaacggattcgtgcaggtggcgccggattaggtggtattttaacaccaacgggtgtcggcactgttgttgaagaaggaaaacaaaaaattcaaattgatggcaaagaatatttacttgaactcccactaaaagctgatattgccattatccatgctcaaaaaggtgacatgaatggcaatttagcttatgaattatctgctaggaactttaatccactagttgctttagcagccaaaactgtcattgcccaagttgataatctactagaggtcggtcagttacccccagatgaagtcatcacgccagccgcattaattgattacattgtttgttcagaataaggagaacgccatgaatgcaaaagaattaatcgctcgccgaattgcgatggaattacatgatggagatattgttaatctcggtattggtttaccaacacaggttgttaattatttacctgataatgtcaatattacacttcaatcagaaaatggctttcttggtttaactgcatttgacccagaaaatgctaattcaaacttagtaaatgctggtggtcagccttgtggaattaaaaaaggcggcgctacttttgatagtgctttttctttcgctttaattcgtggcggtcatgttgatgcctgtgtgctaggtggacttgaagttgatcaagaagcaaatctcgctaactggatggtgcctggcaaaatggtaccaggaatgggcggagcaatggacttagtgactggtgcaaaaaaagtgattattggcatggaacattgtgccaagtcaggttcctcaaaaattctaaagaaatgtacattaccgctcacagcaagtaaaaaagttgccatggtggttaccgaattggcagtatttaacttcattgaaggcagattagttctaaaagaacatgctcctcatgtggatttagaaacaattaaagccaaaacagaagccgatttcattgttgccgatgatttcaaagaaatgcaaatcagccagaaaggactttaattatgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaattctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatagaaaaggagttaaaaatggaaaatgttgttattgttagtgcagttagaacaccgatcggcagctttaatggtgcattatcttccgtaagtgcggttgatttaggcgcaattgtgatacaagaagccatcaaacgtgccaacattgaaagtgcattagttaatgaagtcatcatggggaacgtattacaagcaggactagggcaaaatccagcccgtcaagcagcattaaaagcaggaatagagaaagaaatcccttctttaacaatcaataaagtatgtggatctggtctaaaaagtgtcgcattaggtgcacagtctattatcagtggtgatgctgatattgttgttgtgggtggcatggaaaatatgagccaagcaccttatcttttagatagcaaagtacgacaaggcgtcaaaatgggtaatctcacattaagggacacaatgattgaagacggactaacttgtgctagcaatcactatcatatggggattactgccgaaaatattgcagaacaatatggtattagccgccaagcacaagatgaactcgcattacgttcacaaaccttagcatctcaagccgtgcaattaggtgtatttgataaggaaattatccctgttatggtaaaaactcgcaaaggtgacattattgtttcacgagacgagtatcctaaagcagatactacagctgaaggtttagctaaattaaaacctgctttcaaaaaagagggtactgtcaccgcaggtaacgcttctggcattaatgatggtgctgcagcacttattttagttagcgaaagcaaagctcatgcacttggattaaaagccattgcaaaaattagaagctatgccagcggtggggtagatccatctgttatgggattaggtccagttccagcaacgcaaaaagcattgaaaaaagcaggaataaatcttgatgatatcgatctgatagaagcaaatgaagcctttgcctcacagttcttaggtgttggcaaagatctcaatttggatatgaataaaaccaatattcatggtggagctatcgcacttgggcatccaatcggtgcgagtggtgcaaggattttagtaacgttattgcacaatcttatcgaaaaagataaaaaacttggacttgctacactttgtattggcggtggtcaaggtatttctatgattgtagaacgcttataactatttacttcctaaactacaacagcgaaatatttcacttctaactaaaaaagcgaatttcttttaagaaattcgcttttcttttgatatccaattattctttcctctccatcatcgcaatatgccttgtcgcggcaatccacgccccaacatagcccataattaaacagcacactaataagaatacaaactcgccaacgcctaatccattcaaactgaattggacggcaaaaatatccgttacgtatttcactgcagaagtaaaatagctgataataaaactactaaaaattgctgcaactaacccacctaacacggcataaatcatccccgtataaagataaggacgaaggataaactgatctgttgcaccaagcaatttcatcacatcaatacttgagcggctactgtacacatcagagcgaatactgttaccaataactaaaaataccgctatcgtcattaataccgtacagaaaattgccacatgggcggttaaccaagaaagtgcggttaatttttccatccaatcattatccaagcgaacttcttgtacccctttgattttatttaaattggtacgtaactcatcacgtttttctgacacattaaattcgctcgtcggttttactatcacgaccgcaggcaatggattatcatctaaaatttccaattcttcgccaaagccagaccagcttttaaattcctttaaactttcttgacgagaaacataattcagtgattctacgcctttttgctggcggattttttctaccactaaattcgcgttttcctcacttaaatttttatgaagataaatagtcaattcactgtcaggataaaattgagtggtggctaaatgcaaatttttccacattaaatagctcacagtcgggatcgtaagcgaaacggcaatcactaaaatcgtgagcagcgtgccaaatttacgttgccataaatccgcccatactgcacgcaaagtataggctgtttgaacaaaaacagatgcatccgttgatcggctcatgattattccttaataacgtaaataaccttgttcaagcacaagacaaggttttggtttttgttgaattaaattaatgtcgtgagtagcgattaacacagtcattcctagacgattaaattcttcaaacaaattaaaaatgcctaaagaaagttcatcgtctaaattacccgttggttcatctgctagtaagagctgaggtttatgcacaatcgcacgcgcgatatcaacgcgttgctgctcaccgccagaaatttgtggtggcaaatagtgtgctttattacgcaatcctacacgatctaaagatgccatcgcacgtgtatgcgcatcttttggatgcatacctgcaataatcaatggcaatgccacattttccgccactgtacgatctgttaataaacgataatcttggtgaaccatgccaatttggcgacgcaaaaatggaatttcatattttgacaagcgagtaatatcgtgtccgttaaaccaaatctgaccagcattggctttttccatccccataataagcttgagtaatgtacttttccctgcgcctgaatgcccaactaagtaagtcatacttcccactggaagatgaaaattcaagccttgtaaggctggctgcgttgcaccatgataggctttagaaacatttgagaacttaatcacaatttttccttattctttttattcttcttcatgaacgaataatgcctcaataaattctttcgcattaaactcacgtaaatcttcaattttctcgcctacaccgatatagcgaataggcaacttaaactgatcggctatggcaaaaatcacgccaccttttgccgtgccatctaatttagttagagagatccctgttaaacccacagcctcattaaataatttcgcttggctaatagcattttgtcccgtgccagcatccagcgtaagcataatttcatgtggtgcagtttcgtcatattttttcataacacgaacaatttttttcagttcgtccattaagttatttttattttgtaaacgacccgccgtatccgcaataagaatatcaatattgcgtgcagccgctgattgcatcgcatcaaaaatcacagacgcagaatcagaacccgtgctttgcgcaacaactggaatatgattgcgttctccccaaacttgaagctgctcaacagccgctgcgcggaaagtatcacctgctgcgagcatcaccgattttccttcagcctgaaatttacgtgcaagtttaccaattgtcgtcgttttacccacgccatttacgcccaccattaaaatcacataaggttttttcgtgctatcaatctctaacgggccgggctactggctcaagaatatccgccatttctacttttaattgttgatataaaagctcggcatcttgtaattctttacgacttgcatggtcagtcaaatttttgacgattttacttgttgtcggcacgcca

SEQ ID NO: 679 - DNA, 23298 bp, H. influenzae
  misc_feature (22529)..(22529): n is a, c, g, or t
  misc_feature (22531)..(22533): n is a, c, g, or t
  misc_feature (22539)..(22539): n is a, c, g, or t
  misc_feature (22542)..(22542): n is a, c, g, or t
  misc_feature (22544)..(22544): n is a, c, g, or t
acgtaaccacggattattacacagtggtgcacgttacgccgtgaacgaccaagaatctgctgaagaatgtattaaagaaaaccgcattttgcgcaaaattgcgcgtcattgcgtagatgaaacggaaggcttatttatcactttgcctgaagattcgctcgactatcaaaaaaccttccttgagagctgtgcaaaatctggaattgatgcacaagctattgatcctgatttagctaaaattatggagccttctgtaaaccctgatttagtgggcgctgttgttgtgccagatggttctattgacccattccgtttaaccgcctctaatatgatggacgccacagaaaacggcgcaaaaatgttcacttattgcgaagtaaaaaatttgattcgtgaaggtggaaaagtgattggcgtgaatgtgtacgatcacaaaaatcgcagagaacgccaattttttgcaccgcttgttgtaaatgctggtggtatttggggacaagggattgcggaatatgccgatctcaaaattaaaatgttccctgcaaaaggcgcattactcgtaatgggtcatcgcattaataaacttgtaattaaccgctgccgtaaacctgctgatgcggatattctcgtccctggcgatacaatttgtgtgatcggaacaacatctagccgcattccttatgatcaaattgataatatggaagtaacaccagaggaagtggatattcttttccgtgaaggtgaaaaactcgcacctagcttgcgtcatactcgcgtattacgtgcttatgctggggtgcgaccattagttgcaagcgatgatgatccatcaggtcgaaatgtgagtcgtggtatcgtgctacttgaccacgcagaacgtgatggcttagatggctttattactatcactggcggtaagttaatgacttatcgtttaatggctgaatgggcgactgaccttgtttgtaaaaaactcaataaaacggcacgttgtgtgactgcagagcaacctttgccaggctctactgaaagtcgtcaagagaccaatcaaaaagtcatttcattaccaagtactattcgttattctgccgtatatcgtcacggttcacgggctactcgtttgcttgaaaaagaacgtttagatcgttcaatggtttgcgaatgtgaagcggtaacagcgggggaagttcgttacgctattgatgaactggatgtaaataatctcgtcgatttacgtcgtcgctcccgagttggaatgggaacttgtcaagctgaactctgtgcgtgtcgtgccgcaggactaatgaatcgttttgaagtggcaacaccacgtcaatcaactactcaactttccgcctttatggaagaacgctggcgtggtattgaaccgattgcttggggggaagctattcgcgaagccgaatttacctcttggatgtatggtagtgtattaggtttaaatgatgtgaaaccgcttgatgaacaagcacaacaagggacggatagcaatgaattttgatgtagccattattggcggtggtttggcgggtttaacctgtggcatcgcccttcaacaatgcggcaaacgttgcgtgattatcaacaacggtcaagcggccattgattttgcatctggctctttagatttattaagccgtatgccatcaacgacatatggggaaaatcgcgcagtagaaaatttaaaagaaaatattaccgcacttcgcaatgaattacctgcccacccttatagtttattgggtgcagagaaagtgcttgctaaagcacaagattttgaacgtttagccaatgaattaaatcttgatttaattggttctacggaaaaaaatcactggcgtgtaacaggcttaggcagtttacgcggtgcgtggctttcgccaaatagcgtgccaactgtgcaaggtaatgaaccttttccgcataaacgtattgcagtgcttggtattgaaggttatcacgattttcaacctcaacttttagcggcaaatttagtgttaaacccacaatttgaacattgtgaagtaacgagtggtttcttaaatattccacaattagatgaacttcgcaaaaatgctcgtgagttccgtagtgtaaatatctctcaacttctagagcacaaacttgcgttcaatgatcttgttaaagaaatcattgaatcagcacaaggtgcagaagcggtctttttacctgcttgctttggtttagaaaaccaagaatttatgaccgcacttcgtgatgcaactaaacttgcattatttgaattaccaacactgccaccatcattacttggtatgcgccaacgtattcaattacgtcataaatttgaatcccttggtggtttaatgattaatggcgacagtgcattgaatgcaacatttgaaggaaataaagtacgttgtatcaacactcgtttgctagaaaatgaagaaatcactgcagataattttgtactagcttcaggaagtttcttcagcaaagggcttatttccgaatttgataaaatttatgaacctgtttttgaatctgatattatcggtgttgaaggtttcaaccagaaagatcgtttcacttggactgttcatcgctttgcacatccacaaccttatcaatcagcaggcgtagcaattaatgctcaatgccaagtgcaaaagtgcggtcaatttttaacgaatttatatgccgtcggtaatgtgattggtggttttaatgcccttgagcttggttgtggttcgggtgtggctgttgtaactgccttggcagtggcagatgaaatcttagcgaaataaggggaataatatggataataatattcaacgactcattgatagtgcaaaacaatcccttaattcgcctgaaagccataaatatatcgacgaaagttttgaaagctgtattaaatgtacggcttgtactgctgtttgtccggtttcacgcaacaatccgctttatcctggtccaaaacaatcagggcctgatggcgagcgtttacgcttaaaatcagcagaactttatgatgaagcacttaaatattgcaccaactgtaaacgttgtgaagtggcttgtccgtctgatgtgaaaattggcgatttaattgtacgtgcgcgtaataatcacttagcgcagtctaaaaaaccgttaatgaataaattgcgtgatgcgattttaagtaacacagatgttatgggtaaaattaatacgccattagcaccgattgtaaacaccatcacaagcctaaaagccaccaaatttatgttggaaaaaacgcttaaaatcagtaaagaacgtactttacctaaatatgcgtttggcacgttccgtagttggtatatgaaaaatgcgttacaagaccaacaaaaatttgagcgaaaagtagcatatttccacggttgttatgttaattataataatccacagcttggcaaagaatttcttaaagtgttcaatgcaatgaatattggggtaatgttattagaaaaagaaaaatgctgtggcttaccattaatggtaaacggttttcctaatcgcgctcgtaatattgcacaattcaataccgattacattggaaaaatggtagatgaaaatggaatagatgtgattagtgaggcatcaagttgctcgcttaatttacgcgacgaataccatcatattttaggtatcgacaacgccaaagtccgtccgcatatccatatggtaaccccatttttatatcagcttttcaaagaaggtaaaacattaccgttgaaaccacttaaacttcgagtggcttatcacaccgcttgtcacgtagataaagctggttgggcaccttatactttggaagtattgaaaaaaattccgggtttagaaatcattatgttaccaagccaatgttgtggtattgcggggacttacggttttaaatcagaaaactatgaaatttcacaatctattggtaaaaatctattcgataatattaacgagggtggatttgattacgttatatctgaatgtcaaacctgtaaatggcaaattgatatgtcatctaacgtaacttgtattcatccattaactttactttgtatgtcgatggatgcttaaataagaaaaatgcacgttgtaattaacgtgcatttttatgattaattttatctatgaaaaaaccgactttatattgataaagtcggtttttaattcagttcaatttaacattaacctgcaacagcaatacgtttcatatctgtcatataaccacgtaattcttgaccgattaattcaacagggtggttacgaattgcatcgtttacatcgcgtaaggtgatgttatcgatttccactgctggagtaggctcgcccaagtcacctttttgaaggttgggtataatttcttttgcaagaattggggttgctacgttagagaataagtagttaccatattctgcggtatctgaaattactacgttcatttcgtataagcgtttacgtgcgatggtgttcgcaattaatggtaattcatgaagtgattcatagtaagctgattcttcataaataccgcttgcaaccatcgcatcaaaggctaattctacaccagctttaaccattgcaatcattaatacaccgttatcaaagtattcttgttcgctaattttgccatcatattttggtgcattttcaaaggctgttttacctgttgcttcacgccatgcgaataaatctttatcgccatttgcccagtctgccatcatggttgcagagaagtgaccgctgatgatgtcatccatgtgtttgtaatataagaaaccaaggctttctttaatttgttcagcaagttcaaatgcacgtaattttgcgctgtttgataggcgatccatcattaatgtgataccaccttgttttaacgcttcggtaatggtttcccaaccgtattggattaatttacctgcgtatgcaggatctttaccgtcagccactaatttgtcataacatacgatagaacctgcttgtaacataccgcaaaggatagtttgctcacccattaagtcagattttacttctgccacgaatgaagattctaaaacacctgctttatgaccgcctgttgcagcagcccaagctttcgcgatcgccaagccttcgcctttcgggtcattttcaggatgaaccgcaattaatgttggcacaccgaaaccacgtttgtattcttcacgtacttcagtacccgggcattttggtgcaaccatcacaaccgtaatgtctttacggatttcttcgccaacttcaacaatgttgaaaccgtgtgaataaccaaatgcagagtcttttttcattaaaggcatcacatcagcaaccactttagagtgttgtttgtctggtgttaagtttacgactaaatctgcagttgggatcaattcttcataagtacccactttaaaaccattttcagttgcacgttggaatgacgcacgtttttcagcaattgcttcaggacgtaaggcatagctaatatctaagccagaatcacgcatattcaaaccttggtttaaaccttgcgcaccacagcccacgataacgatttttttgccttttaagaagtttgcttcatctgcaaattcttcgcgatccataaaacgacaacgacctaattggtctaatttttgacgtaaatttaatgtgttgaaatagttagccattttgttgtccttaattgtgtaaggttgataattgtatgatgttgtgtttgcatattttttgttgtggtttgattataggattttttgttgttgcgtaaagtgatattatgggaatgtaatgttgcgatttgtgcaattatgttgtttttttgtggattgcatcgtatttcgctcgatgagcgacctactttcttttactcgtgtaaaagaaagtaggcaaagaaaacacgccccaattaaatcgcagctctttgctttgtttcaattttcttaacggcaatttgctgaactcgctacgctcaaacaaacgcaaattgcctgaaaattgaaagtcgcaaaggcgatttatatggggctcagaatatatcagagcgttattaaaaagtgcggttagttttctggtatttttttaaatacgctaaattttacccgcactttaaattgaagaaagaacaaattagttcccttctttgccgcctgagaaattggaaacttgtaggaaattttcgtctgtttgagcgtagcgagttcagaaaatttccgttaagcaagttttcaatttctcaggaaataaggcaaagcagggcgtgttttctttttgcctacttttgctttgcatgagcaaagaaaaagtaggtcgccatcggcgaaacccgaaattaaataaaataaaagaagaaattatggaatttaccgacctacaaatattcatccacctcagtgatacaaaaaacttcgccaaaactgccacccaaaaccacatgtctccctctaccctttcccgtcaaattcaacgattggaagacgagttagggaagacactttttatccgtgataatcgccaagtcaaacttactgaatatggcgagaaatttttgcaatttgctaaaacagaatggcaaaactggcaacaatttaaacaacaactgaaagataaatccgatgaattttgcggtgaaattaaacttttttgttctgtaaccgcatcttatagccatcttcctcacgtacttaaagaatttcgccagcgttatcctaaagtggaaattcaactgactacgggtgatccagcgttagcactagaattaattcaagcgcaacaagtcgatctcgcgcttgcggggaaaccaaataatctgccttctagtgtagtgtttcataaaatagatgatattagtttgtccctaattgccccgcgagtggcttgtttggcgacacaattattgcaagaaaaacctattgattggcagcaaatgccttttatttttcccgttgaaggtcacgcacggcagcgaattgaacaatggttaagggagaaacaaattaaacacccgaaaatttatgctactgttgcaggacacgaaggaattgtgccaatggtgggattaggatttggattagcaatgttgcctgatgcagtaattgacagcagcccaatgaataaccaaatttccagacttaatcttgataaacctattgagccttttgaattaggtatttgcacccaaaaaagaaatctcgaacagcccctagtccgtgcattttgggcgatgttagaatagaataaataatggtttaaaataaggatttcttatgtttaaaggtattctcgtttcattattagcctcgtttttatttggctatatgtattatttttctacgttactaaaacctttgagtggcacagatattttcggttatcggatgatatttacttttccttttgtcctgttgtccgtcacattatttaaacaaaaagcagctttaattgaacgtttaaaacgcattcaaaaacgaccgcacttagcattgtcatatttactttgcggattattaatgggttttcaaatgtggctttttctttgggcaccgaataatggcagttcattaagtgtatcttttggttatttacttttaccaattgtaatggtggcggcaggtcgcgtgttttttaaagaacgcatttcaacattcaaatttattgccgttatcattgcaacattaggcgtaatttctaatattgtgctaaaaggcggtctttcttgggaagccattgttatctgtttaggttacaccgcatatttttctatccgaaaagcattaaaaaataccgatcttgcctccttttgtttagaaatgttaagccttatgcctgtcagtatttattttgctttacaaacagatttcgcgacagtacaacaaaccaatccgtttatttgggggctgcttgtattactaggattaatcagcggtactgcgttaattgcctatgtaatagccagtaatatgcttcctatgaatttactcggtctgcttggttatgttgaaactattatgatgctatgcgtatcatttttgatcggagaacaaattgatagcggaagctacccactttttatttgtttagttatcgcgatgattcttgttatggttgatggcgtttacaaacaacacgcaaaaggaagtttataaatgtcatttaaagaaataactccacagcaagcttgggaaatgatgcaacaaggcgcaatattagtcgatattcgagataatatgcgctttgcttattcacatcctaaaggtgcttttcatttaacaaaccaaagttttttgcaatttgaagaactagcagattttgattcgcctattattgtgagttgttatcacggcgtgagcagtcgaaatgtagcgacttttctcgtggaacaaggctataaaaatgtatttagtatgattggcggatttgatggatggtgcagagcagaattgccgattgataccacttactaacccattcatcaaaaatataagatataaaaaagtgcggtaaaaatttaccgcacttttgttgttattctaattaactgaaaattagtttttcgctgcagctgctgctttaacaattactgcaaatgcaggggcttttaatgatgcgccacccactaatgcaccatcgatgtctggctgagtaaataattcagcggcatttgcatcatttacagaaccgccgtattgaataattacttgctctgccacggcttgtgatttcgctgcgatgtgaccacggataaatgcatgaacggcttgtgcttgtgctggagttgcagatttacccgtgccaattgcccagattggttcgtatgcgatcactgcaccgttgaatgcttctacgcctaatgcattgatgactgcatcaatttgacgcgcacatacttcttctgttttgcctgcttcgttttctgcttcagattcaccaatacataatactggcactaaaccagcttcttttaatgcaccaaattttttcgccacaaattcgtcgctttctttatgataagtgcggcgttcagagtggccaataatgatatattttgcaccgaaatcttttaacatttcgctagaaatatcaccagtaaatgcacctttcacattgatatctacgttttgtgcacctaattgaatcacacttttaccgccacagctgcaaccacaaccagaaagtgctgcttcagccgtacctaaatacataacggggggggcaattgctacatcacaacctgttacatcatgtaattccgcttttaatccctcgattaattctttcgtgaatgctttgctaccgtttaatttccagttacccataactaaaggacgacgtgccatttttgtttctccatagttgataaaattaacttgcttactataccaaaatttcgcccctattctttgcagaagatcataaaattaaaaaaattctcacagaaagatgattatcttgagctaaaaagctacaattacctgtatggaaccaataaaaaataaccaattatgaaacttttcaaagctgaacaatggaatattgaagtgcttcttcctctttttgaagcctatcgccaagcctatgggcaagcagagaatccagaacgtaccttagcttttttaactaatcgtatgcgttttaatgaaagcctgttttttattgcggtggatgaaaatgaaaaggctattggctttgtgcagcttttccctcgcctttcttctttacaattgcaacgttattggcaaatcaccgatatttttgtgttggaacatgcgcaacaaacagaaatttatgcggcgttgatttctaaagcaaaagactttgtgcatttcacgcaatccaatcgtttagtggcagaattagcgcaaaatcaatattcaatgttggaatcggaagggtttaaattgaacccaaaagaacgtttatttgaattgagtttgtcatgctaacagcgttaaatcgttattgggattatttgcggattgaacgccaaatgagtcctcacacaatcactaattatcaacatcagcttgatgccaccatcaaaatcttagcgcaacaagatattcattcttggacacaagtgacgcctagcgtggtgcgctttattttagcggaaagcaaaaaacaaggcttaaaagaaaaaagcttggctttgcgtttatccgcattacgtcgatttctcagttttttagtgcaacaaggcgaattaaaagtaaatcctgccacaggcatttctgcaccgaaacaaggctggcatttaccgaaaaatatggatggcgagcaaattcaacaattgcttgccaacgatagcaaagaacctattgatattcgtgatcgtgctattttggaattaatgtatagttcaggtttgcgtttatctgaattacaaggcttagatttaaacagcattaatacccgtgtgcgggaagtacgcgttattggaaaaggtaacaaagaacgagttgtgccgtttggacgttatgcttcgcatgctattcaagaatggttaaaagtgcgggcattatttaacccaaaagatgaggcattatttgttagccagcttggaaatcgtatttctcatcgagccattcaaaaacgtttagaaacttggggtattcgtcaaggcttaaatagccatcttaatccgcacaaattacgtcattcttttgcgacgcatatgttggaagccagttctgatttacgcgccgtgcaagaattgcttgggcatagcaacctttccaccacacaaatttatactcacttaaatttccaacatctagcagaagtgtacgatcaggcgcacccaagagcgaaacgaaaaaaataaaagagcggttaaaacaaaagaaattttaaccgcacttttaattaatattagattacttcgcaggaatatcggcaagtactcttgtcaataaatcccaataggtttgtactgttgcgatttccactttttcatctggtgagtgagcatttcggattgttggcccaacagaaatcatttcaatgtttggataatgttcttttaaaagaccacattctaatcctgcgtgaatgactttcactacaggttgctcgcctagcacttcagcataatgtttgcgagtaacgtctaagatagttgagtcatttacaggttgccagcccggataaggtgcagaaaactcgacttttgcatttgctaagattgcaagtgagctgagcatttcagttacgtaatatttaccgctttcaattaatgaacgaactaaaatagtgctttttacaacattaccttctgttttcaatacgccaacgcttaatgaactttctacaacatttttaactacatcactattgcggattacgccatttggtaatacgttgagtgcgttaataaccgtttgagtgctttgtgcggtgaatacggtaggggctttttctgcggattctacaaaaagtgtgaaattaggttctgcaattgctaattcttctttaagcacaaccgcgagattttctaccgcactttctatggtttttacatcgccattaaaggctaacacagctgctgcttctcgaggaattgcattacgaattgagccaccacgaatatcagagagagcaaagtgcggttgattttgagaaagttttgctaatactcgcgctaacactttaattgcatttgcacgccctgtatggatatcgccgccagagtggccgccacgtaaacccttaagggtgatttgtgcgctgcgctcaaacgtattggtttcatattgaacgggaatttcaaagtttgcgttaatcccgcccgcacaaccaatgtaaatttcgccaatttcttcggtatctgtattgattaaaatttcagattgtaaccagctatgacgtaagccttttgcgccatccatgcctgtttcttctgtcattgttaaaagcacttcaagaggtggatgggctaaatcattgctttctaacaccgctaaagtagaggctaaaccgataccattgtcagctcctaatgtggtacctcgtgctttcacccattctccatcaatataaggttgaattggatctttggtaaaatcatgtggattgccttcattagcctgtggcaccatatctagatgggcttgtagcacaacaggcgtgtgattttccattcctttcgtcgcgggtttacgaatgagaatattccccacttcatcgcgttcaacaaaaaaatgcttttcttttgcccaatttacaataaagttagctaacgtatcttcataatgagaaggatgagggattgcacaaatttgatcgaaccatttccataacagtgaaggttgaagtgttgtaatttcagacatagttgctcctttttactgaaaatatttacgaaataatagcataaaacgccatttcgggttatccttacgcaattttttatttctcgataaatttaaactaaggtgcaattatgagcgaaaaatatgtggtaacttgggatatgtttcaaatgcatgcccgcagattatcagaacgtttacttccagcttcccaatggaaaggtattattgcggtgagtcgcggtggtttgtttccagcggctgtattggctagagaattgggtcttcgtcatattgaaaccgtttgtatcgcaagttatcacgatcataacaatcaaggtgaactacaagttcttcatgcagcccaagtgccaaatggcggcgaaggatttatcgtggtagatgatttagttgatacgggtaatacggcacgtgcgattcgtcaaatgtaccctaatgcaaaatttgtcactgtatttgcaaaacctgcaggtgcggaattagtggatgattacgtaattgatattccacaaaatacttggattgagcaaccttgggatttaggtttaacctttgttccacctctctctagaaaataatttttatacaaaaaagtgcggttaaaataaaagaatttttaaccgcactttctttcattttatcgtttttcctaatttttcacggtaaacaggttaaaattttactcacaataaatatccgtatgcgacttcttattttaatccttctttctgtattagtattgtttcaatataatttttggtttggcagtaacggttttttagattatcgtcaaaatgctgagaaaattaaggaaaatcaagcagaaaatgaaaagctatctcaacgtaatcagcgtattaatgcagaaattcaaggattaacaaaaggttttgaagcgatcgaagaacgcgcacgaatgcaacatggcttagtgaaagaaaatgaagtgttctatcatattgtaaaagagagtaaataatgactcgttcaattattgcggtcttgcccgcggctggtgttggttcacggatgcaagcggataaaccgaaacaatatttaacgctgcttggcaaaacactgcttgaacatacactcgatgtgatgctttcttatcctgctgtatctaaaattatcttggcggtaagcaaagatgatccttatatttctacactatcgctcgatcctaaaattcagttagtggaaggtggcacaacgcgagctgaatctgtcttaaatggtttaaatgcaattgcggaaaaaaatgcctgggtgcttgttcatgatgctgcccgcccttgtttacaacatgctgatattgataaattgttagctattgaagataaacaaggtgcgattttggcaatcccagtaacagatacgattaaacgagcggacaatcagcaatgtattgtaaaaacagaagatcgtagccagctttggcaagcaatgacaccgcagtttttcccagtagatatattaagagatgcgctttccacaggaattcaacaaggtgcgaatataacagatgaagcatcagcgatagaacttgctggatttagaccgcacttagtggctggacgtagcgataatttaaaagtgactcgtccagaagatttagcattagcagaattttatttaacaaggaataaattatgatcagaattggacacggctttgatgttcacgcttttggcgaagatcgaccattaattattggtggtgtagaagtgccttatcatacgggctttattgcgcactcagatggagatgtggcattacacgcattaactgatgcaatcttaggggctgcagctttaggcgatattggaaaacttttccccgataccgatatgcaatataaaaatgcggatagtcgaggtttactgcgtgaagcgtttcgccaagtacaagaaaagggatataaaataggtaatgttgatattaccatcatcgctcaagcacctaaaatgcgcccacatattgatgcaatgcgtgccaaaatagctgaagatatcctatgtgatattgagcaagttaatgtaaaagcaacgactaccgaaaaattaggctttacaggaagacaagaggggattgcttgtgaagccgttgctcttttaattcgacaataatttactattcttatattcttaaaagtgcggtgcaatttgaaaagaatttcatcgcatttttattagtgaaataataagcgattgctcgttattattaagtgaccattggtgaaaggagacgcccatttatgggtgagggagcaatggagggcttcagtccgcctttttgcttaccaaccttgttgaatatatggttcattattaattgatggaatttatacgctttaacgagaatattccattaactaaaccatttaataaaacaaatgtaaaacagtgagcttattgccaacttagattttcttattatacatttaaccaaaacgtcacaggcccatcatttgttaagctcacttgcatatccgctgcaaattgccctgttgaaacaggtaatttctctgcgcacttttggataaagtattcatataattcattagccaatgctggggacgcaccttttgaaaaactcgggcgtaaacctttttgcgtatccgctgctaatgtaaattgcgaaacgataagtaattccccctgcgcttgttgaacatttaaattcatcttgtcattttcatcactgaaaattcgataattaagcactttttcagcgagtttatccgctttttctcggttatcttctttttctacaccaagcaaaactaacaaacctttgccaattttccctattgtttcgccctttacattcacttttgcttgagacacacgctgaattagggcgatcatttcaatccctcaataaaactcggtaaccattcttcagcataactttcttgatcatccacgtttaacacgtcaatttttaaagtctcacaaatttttaccgcactttttgcttgaagtgtttgctccactttgtccgctgcatagcaaaaagtatcataatcagaactacctaatccaacgaccgcaaagcgaacatctgaaaaatccttttggctattcgctaattcatcaaataggggttttaaattgtctggcaattcgcctgcaccgtgcgttgaagtgacaatcagccaaattttctcgttttcaatgtcagataaatttggtccgtgaaaaagtgcggtggaaaaaccttgagtttctaaaacatcgtttaaatgctcggcaacatattccgccccacctaaagtgctgcctgaaagaatacaaatgtgcattttattatcctatatttattttcttctcaaagagaaaagaaaattattgaaatgattaataataaaaaggcttagaaaatctaagccttttattacgattaaacgttatcaaacttaccaagtaatgaacgaatatgctcttgccagttacgatgttcgtttttcagctgttcattttcagtttgtaagttttcgatatttctttgagattctgcgtttttctcttttaattcttcaacttctaattgaagtaattggatagtttctaccgcttgtttaattttttcttcaagctggtctaaaatttctaaagacataatgatttccttttaaatatgggtaagtttaggggtattttacccagtaaatttacctttttaaagcattgaataaaaatttattatgcaaacgattactcagtgatagaatgatgctatttttgccataatcttgaaaaataagcagaaggagaataataatgaatcgagcattagccattgaattttcacgagtaacagaagcagccgctctagcagcttacacgtggcttggtcgaggagataaaaatgcggcagacgatgcagcggtaaaagcgatgcgttatatgctgaatttgattcatatggacgctgaaatcgttataggagagggcgaaattgatgaagccccaatgctttatattggcgaaaaagtcggttctggcttaggggaattagtttctatcgcagtagatcctattgatggtacacgtatgaccgcaatggggcaatctaatgctatttctgtcttggctgcaggtggcaaaaatacctttttaaaagcacctgatatgtatatggaaaaattagtggtgggttcaaatgtaaaaggcatcattgatttaaatttaccactggaacaaaatcttcgccgcatcgcatctaagctaggaaaatccctttctgaccttaccgtaatggtattagcaaaaccacgtcacgatgccgtaattaaacaaatacataacttgggcgcgaaagtattggcaattcctgatggcgatgtggcaggttccgtattgtgttgtttacctgatgctgaagtcgatcttctttatggaattggtggtgcgccagaaggcgtggcagctgctgcagccattcgagcattaggtggcgatatgcaagctcgtttaatcccacgcaatgaagtaaaaggcgacaccgaagaaaataaaaaaattgcagctaatgagattcaacgctgtgcagcactgggcataaaagtgaatgaagtgttaaaacttgaagatctcgtgcgtgatgacaatcttgtatttactgcaacaggcattaccaatggcgatttgcttaaaggtatctcccgcaaaggcaatttagccagtactgaaaccattttaattcgaggaaaatcccgcacaattcgtaaaattcaatctattcattatttggatgacctttataaaattttgaatatttagctcaaacaaacaacatttcaattaatttaatctgctctccaaaaagctgaacaaatgacttactaaacagggagcagattttaaaatgtcatttttaaataattaaatcattttttctcaaaaaaatatcaaaaaagatattctaaaaacaaatatattcatatatgatataaaaaatattttattaaaataaaagtatcaaatatgaataaccttagtgcgcaattagaaaatcaaattgatgaattaaaaaagcttcagaaatctgtcattacctatgagcaatcgcaaagacaacagctttacgcaggaaaaattaccgatctcaaagcctttggaaaaatgctcaatgataagcgtaaatcacttggtattgagcttagtatgctagaactgcaaactggcgtgtctatttctaccttgaatcgcttatttcaagatccaagccaagttcgatttacaaccgtgtttcttgttgctaaaacattaggggtttcactatgcgcgatttagtccgctcgggcaaagtatttctctacggcgaatttattggcttacttagagaagatcatcgaggttttcattttgcttacaatcccgattatcaaggaataccgctctctctcagctttcctattgagcaaagtccttttcattctgacaccttattcccttattttgcatccctcgtcccagaaggctggctaaaacacaaatatgcacttcatcaacgaattgatgaaagcgatatgtttcgctttttacttaataacggggaaaatatgttaggcgcagtgcaaattcaggaagaaaaacaatgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagacaagtacggaaaaataggtgcagataatgagcaatatgtgagttatgaacaaattgctaagtttattttgcagcacactgaaaatcatttagctcagcaacgagaaatttttcgtcgaattatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaactataaaatccaaagggaattttcaccgcactttttctctccaacaaaaaaatcgcacctttaacagtgcgattttttcttatattaatttaggacattctgccgttttctataccaattacctgatcgcaaatagccatggtagattggcgatggctgacgagaataatcaatttctcagctttagcatcgagtaatgatttcaaaatcattgcttcgtttaagctatccaaattactggttggctcatcaagcaagataatcggtgcattatgcaagaatgctcgggcaataccgatacgttgtttttcaccgtcagagagattgccgcccaattcggtcatttttgtttgataaccttgtggcaaactcaaaataaaatcatgaattgaggctttcttcgccgcttccataatttcttctaaggttgcatcacggcgcgcaaggcgaatattttcttcaatggtttcgttgaaaatataggtttgctgagtaatgtacgccatattgtcacgcaaactgcaagtgttgatattcggtaaggtttcgccgttaattttaatgctacctgattttggatcataaaaacgcatcagcaatttcaataaggtacttttaccgctgccgcttctgccgtgaatacctaaaatttcgccttttttcacagataagctgacatccgataaaatttgttcttcgccgtaagcgaagtttaggttctctacatcaatgcgagaaacatcttttaaatctaccgcactttctacatcttttaactctggctcttccgctaataaacttaatactcgttcgccagaagccaaagtttgtaataagttgcttgaaaggttacttaaggcgataactggcccatagctcgacattaataaaataacgccgattaaaaaggcagcgaaatcaattttatctaagctaaacaaaattaagccagtaaacagcataatgatgttgaaaacagatactgccacttcagtataaacacgaactttcgcttcttggtctttaatgcgttcaaaggcggtatcaattttttggctacgttgttggatttctgctaaacgttgttgtgcatagccaaaaagctgaatttctttcataccacgcacgctgtcaaggaagaaatcattcatttcgccgactaattcacgatagcgtctgccatcttcacgagccaatttggtggtgataatcggtaaaatcacacctaccgttaaataagcggctaatgcgacaactacaaaccaacctgaaagatgggcaaagaccaacaatagaatcgcagaggtaaagaacgcaatcataattggtgcaatggtgtgtgcataaaatacttcgagcaattcaatatcattggttactaatgacactaattgccctgcttgtttatcttgcaacttcacaaaagccaaacgacgcaaagaagaaaacactttgtcacgcaataatgcgagtaatttaaaagcaatataatgcccagacatttgctctaaataacgcaatacaccacgagccaccgctaatacgataagtgcggtcaaaatgccagaaaaacttaaatgggtgtcaaagtttaagagatttactaaccccattgcaccaaacaccataataaagatggcagcaaggaaaccgagcgtccccatagtaatggtaaacgccataatgtgtgcaagtggagtcactaatttcaacaaatgccccattacaacaaaaccatttttacgcatttgccacctctctaatttgttctaaatctttttgttgttggaacatttcagcatacgcaccttgttttgccattaagctttcgtgtgtgccttgctcaatcaatttgccttggtcaagcacattaatacagtccgcattcacagcatttgccaaacggtgagaaatcatcacaatggttttttgttgtttaaattgttgaataaactgcaaaataatttcttcgctttccacatcaatattactggtcgcttcatcaaaaatataaagctcggcattgtgtaacaaagcacgcgctaaagctaaacgttgaatttgaccgcccgataaattcgcacctcggcttaatagctgcatatctaagccgccattttcgcgtacaaattgggcgagattcacttgttctaaacaagcataaatttgttcatctgtggcatcaattttcgccatcgtcatattttcacgcagcgagcctttaaacacataactgctgtggcttactaatgatactttttgatagaaagaagtgcggtcaatattgagggcgttttgtccattaaacaaaatctcaccttgttgcgcttgattaaaacccatcaacaacgaaactaaggtcgatttaccgcaaccacttttacccacaaataccgtaagctgatttggtaaaatactcaaatctaaacctgtaattgctgatttttcttcactataagaaaaatgcagatctttaatttccacttgaacgttattttttgcttcaaaatccaccgcactttgttgggtttccactggcgtatctaacaatgtgaaaatcttatctgaagccgctttgccattcatcgccacatggaagaatgaaccaagcaaacgaagcggaataaagaactcggaggaaagtagaataaataaaatcacgcctaacacgctgagttgtgcattttggaattgcaatagtgcggttaaaatcccgatagctgcgccaccataagcgagtaaatccatcagtgaaaccgagttaagctgcatagtaagcactttcatggtaattttgcggaaatgctcagcctctttatccatcgctttcgctttataaccatcatcttgatagatttttagcgtaattaaaccctgcaagttatctaaaaagctgctgcctaatcccacataaatcgaccaatattttgccaagagttttttcgcaattttattcactgcaatgatcgacatagggataagcggcacacaaatcaacaaaatcacggcagttttaaaactgaaaaaatcaagaaaacaaagagggtaagcggtgcaagcaagctataaaaaagctgcggtaaataacgcccaaagtaaatttcaagctgttctacaccttctgatgccacttgaataatgcttgaggtggattgttgattcacttggttaagcggcatagaagccaatttacgatagataaggctacgcaattcatgcttcacttttgtgctggcaaaataagacgcctgcacagattttttccctgcaaaagcacgcaatgccaatgctgcaatcaaaacgatgcccaaaatgaccgcacttaacaggctcaatttgtgaaaataagccgcctgtaaaatataagaaaacacgacggcactaataatcccgccaactaacgccacccaattccacaacaccgtgacgccaatccattttttgctgtcagccaccgtgttaattaggcgtttatctatcatcataatgattactcctaaaataaaaagaagtacgcatagaaagaattatacgtacttaatgtagggtgggctncnnnaccccnacncnccctcccccccctcccatccagcctttgtcttaagctacccccactgccgccgcgcccccagcctcgcgcgcgcgggctaccctcctcggcgccctcctctcccgcgctcgcccttctgatcattcccccgacctcccgtttcaccctttcccactcgtcctcccgcttccgctccattcccccctatcccccccccttccatgctactccgtccgtctaccgccgtcttcccccctccccgatcccgctcggcgcctcccaccccctacttcccgtcccctgcactctcccccacccaatcctctttcccctcccgcctctcccctcgtccccctctcccgcatcctcctttccccccctgttcctccccccccccctctcccccgtcctgcgtcgcccatccttacacccctcccctcgcccccgaccccccccgcatgctccccccccctctcctcccccctcgtccctcccccgccccctttcccccctcccttcccttcccctttccctcctcccgcccccccttgtcccccccatttccccccccccgcctctttttcccccgcccccttcccccgtaaccccacctcctcccctccccgctcccccgtccccgcctttctctccttcccgccccccctttttcccctctcccttatccccgttccccttccccccgtccgccccctttttcgccttccctccccttctccccccctctcttccccctctttcccgccccctcccccc

SEQ ID NO: 680 - DNA, 85814 bp, H. influenzae
  misc_feature (85747)..(85748): n is a, c, g, or t
  misc_feature (85752)..(85753): n is a, c, g, or t
ttttgatgcgcttgaatttgttacttcgatttttactgtttttctgccgacagtagcgagaatatcgccatcagctaattgtattcgcctgggatcatatctttgttcacggtagggtgtgctttagcccaccaaaataaaaatatcaatggtgggctaaagcccaccctacaaggaacaaagatatgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttggtggtaaccaaatcatttatggtttccataatcaaattgatggcaaattataaggtagggcagaatggcattaacaatttcaagagcacaatatgtagcaacttatggcccaaccgttggcgataaagtccgtttaggcgataccaatttatgggcaaccattgaacaagatttattgaccaaaggtgatgagtgtaaatttggtggcggtaaaagcgtgcgtgatggtatggctcaaagcggtacggcaactcgcgacaatccgaatgtattggattttgtgattaccaacgtgatgatcattgatgctaaattaggcattatcaaagcagatattggtattcgtgatgggcgtattgtgggcattggacaagcaggtaaccctgacaccatggataacgtcacgccaaacatgattatcggtgctagcacagaagttcataacggtgcacatttaattgcaaccgctggcggtattgatacccacattcactttatttgtccgcaacaagcacaacatgcgattgaaagtggcgttaccacgttaattggcggtgggactggccctgctgatggtacgcacgcaaccacttgtacccctggcgcatggtatatggaacgtatgtttcaagcggcagaagccttgcctgtaaacgtcggattttttggtaaaggcaactgttcaaccctagatcctctgcgtgagcaaattgaagcgggtgcattaggtttaaaaatccacgaagactggggtgcaacgcctgccgtgattgattctgccttaaaagtagcagatgaaatggatattcaagtggccattcacacagacacgctaaatgaaagtggctttttggaagacacgatgaaagcgattgatggacgtgtcattcatactttccatacggagggcgcaggtggtggtcatgcacctgacatcattaaagcagcgatgtattcaaacgtattacctgcttcaaccaacccgactcgtccgtttaccaaaaacaccattgatgaacatttggatatgttgatggtttgccatcacttagataaacgcgtgccggaagacgtagcttttgccgatagccgtatccgccctgaaaccattgcagcagaagatattttgcatgatatgggcgtcttctccattatgagttcagactctcaagcaatgggacgtattggagaagtcgttattcgtacatggcaaactgcagataagatgaaaatgcaacgtggtgagctaggtaatgaaggaaacgataacttccgtattaaacgctacattgcgaaatatactatcaacccagcaattgcacatggtattgcggagcatattggctcgttagaagtgggtaaaatcgcagatatcgtgttatggaaaccgatgttctttggggtaaaacctgaagtcgtcattaaaaaaggttttattagctacgccaaaatgggcgacccaaatgcctcaattccaacgccacaacctgtattctaccgtccaatgtacggtgcacaaggcttagcaacggcacaaacagcggtattttttgtttcacaagccgctgaaaaagccgatattcgtgaaaaattcggtttacacaaagaaaccattgctgtgaaaggctgccgcaacgtaggtaaaaaagatctggttcataatgatgtaacaccaaacattactgttgatgctgaacgttatgaagttcgagtggatggagagttaattacctgtgaaccagtggatagcgtaccattgggtcagcgatatttcctattctaaaggactgttttcatagacgaattagtgtaaaaaggcgtgtacgatacgcctcttacttgataaataagaaatcattgtagctgtagtttttctttcgaagagaagaaagtggatttatagaggaaagatgaaaataattaacccaattctccctattatagaaaatatcttgggaaatttaaccgcacttcaagcagagggcaaaattaccacacagcccattgaacgcgtggcattgcagtggtatgaaagcgaacgcaatattttgcgtaaaactacaaatacggggcgtgaagtagcatttcgcttgctaaaagaggggcaacgcttgaaacacgatgatgtagtgtttatcagcgatgaattagtgattgcgattgaaattttaccgagtgacgtgattgtgctgtcgccgaaaaccttgcctgaaatggctcgagcttgttatgaaatcggcaacaaacattcgccgctttttttagatggcgatgaagtaacattaccttacgataagccgatgtttgaatggctgcaagctgcgggatttcatccgcaaaaagcagaacgccgtttaagccaagcgttaagagcaaattctgcacaagggcatggacattctcatagccattcgcatgatcatcatggctatcatcatcacggagatggacattggcacaaacattaaaccgctctttaacggatttaggtgcgttgttgcacttggtcgatcccaccttgccgattggtggatttaaccattccaatggcttggaaaccttcgtccagcaacgtgtggtagaaagcaaagcgaccctagaagaatatgtgcaaacccagcttttacaaaactggatttacaacgacggggcgtatctttctcttgccttcgatgcaatgtgtgaggggaattttgaccgcttgtgcgaactggattggcaactttccgccaccaaagtggcacgcgaaagtcgtgaagggagtttcaaactcggcgtacgattgttgaaaatttttattcgctatgaaacacatacgttgctcacagcttaccagcaagcgattgcagaaaaacgcgtgcagggctatttcccgatagtgtttgcaatggttgctcaagccatgggtttaagcaaagccgatacgctctatgcgttctactacaacgcagcagtcggtgcgatcactaacggcgtgaagctaattcctctcagccaaatggatgggcaagatattctgtttgacttgcgtggctcgctcgtacaagcggtggaattaagctttgaccctgacgaagaatggcttggtgcggcaacgctggcgaatgatattcgggctatgcaacacgaagtgctttatacgcgactttatatgtcgtaagtgcggttattttttattgagattttacttgtaggggcaaatcacatttgcccttgaacattcgttgatatataggggcaaatgtaacttgcccctacacccatgagcaacacagttgctacgatgataaacaaaaggaacattatgcgtaactacattaaaattggcgtagcaggtcctgttggcgcaggcaaaaccgcgttaattgaaaaactcactcgtgaaatagcgtcaaaatatagcgtagcagtcattactaacgatatttacacccaagaagatgcggaatttttaacgaaaaatagtttgcttccaccagagcgaattatgggcgtggaaacgggcggttgcccgcacacagcaattcgtgaagatgcctcgatgaatttagaagccgtggacgaaatggtgactcgtttccctgatgtggaaatcgtgttcattgaatcaggtggcgataacctttcagcgacttttagccctgatttggcagacgtgacaattttcgtgattgacgtggctcaaggggaaaaaatccctcgtaaaggtgggccgggtatcactcgttcagatttacttgtgatcaacaaaactgatcttgctccattcgttggtgttgacttaagcgtcatggaacgtgatgctcgtcgtatgcgtaacggtcagccgtttattttcactaacctgatgaaaaaagaaaatctggatggcgtgatcggttggatcgaaaaatatgcgtgttgaagaatgtggaagaacctgcatctttggttcgttaatcgtaggggcaaattacatttgcccaattattggtgaaatatcggggctaatgtaattagcccctacaaaatctatgaacagcaaattatccctttccaccaaactttcctccagcggtaaaacccagcttgctgaatactttgcgacgccaccgtttaaagtgataacgttgccaagttacgatgatgcgtgggcgaatggcttgaatgcgatgcagatgtcctcctcccctggggtgctggcgggcgatctgttagagattgatatttcgttggcaaaattgaccgcactttctttaaatacgcaggcatttactcgggtgcaggcgatgaatgaaggcgacagtgcgatgcaaacaacccatattttgcttgcggaaaacagtcgtttattctatttgccgcatccgttggtgttacataaagattccgtttttaagcagcaaacccagattgaaatgggcgaacaaagcgagctgatttacggtgaaatcgtggcgattgggcgggtgttgaatgatgaacgttttgccttccgccagttttcttcccatttgaagatttatactttgaaagacgatggcaaaaaacgaccgcttgtcagtgattgtatccagtggctgccgtctaaaatgaatcttaccgctttgagtcagatggaaaattattcccatcaaggttcgctgacttatctaaatttggcgaaaaataatgcggaaatcaaacaacaggtgcaagccttgcagcaacaaagtacggaagaaaaagatctactgataggcatatcacaactcaatgaatatggtttaatggtgcgggtactcgggtgtcgtgcagagcaaattcagaaattatttgagaaaattggtaggctattgaaatctgtgtaagattgatagatagaacatttttccctaaaaaaactaatccgaaaaatgaaaatatgtcttgagagcattttttgaaaatgtgatcttcatcaagttttttcttcttgaaatttctataatgacgataaattaactaacccaaaaaggtgattaaaatgactcaatttagaaaagaagtagatttacttggcgaacgtgatgtgcctgcagaagcatactgggggattcatacattaagagcggtagaaaatttcaatatttctaacgtaaccatttctgacgtgcctgagtttgtacgtggtatggtaatggtaaaaaaagcaacggctttagccaatggcgaattaggtgcaattccaagtgatattgcaaaagcgattgtagcagcttgtgatgaaatccttaccactggaaaatgcttagatcaattcccatcagatgtatatcaaggtggtgcaggtacgtctgtcaatatgaatactaatgaagtggttgctaatcttgcccttgaaaaaattggtcataaaaaaggcgaatataacgtgattaatccgatggatcacgttaatgcaagccaatcaaccaacgatgcgtatcctactggtttccgtattgcagtgtataacagcatcttaaattgatcgataaaattcaatatttacacgacggttttgataataaagcaaaagagtttgcaaatatcttaaaaatgggtcgtacccaattgcaagatgcggtgccaatgactgttggtcaagaattcaaagctttctccgtattacttgaagaagaagtgcgtaacttaaaacgtacagcaggtttattacttgaagtaaaccttggtgcgactgcaatcggtactggtttaaatacgccacaaggctatacagaattagttgtaaaacaccttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggccctcgtgcaggtttaaaagaaattaatcttcctgaattacaagcaggttcttctattatgccagcaaaagtaaacccagttgttccagaggtggtaaaccaagtgtgctttaaagtaattggtaacgataccactgtgactttcgcatctgaagctggtcaattacaattaaacgtaatggaaccagtgattggtcaagcaatgttcgaatctatcgacatcttaaccaatgcttgtgtgaacttacgcgataaatgcgtggatggcatcactgtaaacaaagaaatttgtgaaaactacgtgtttaattcaatcggtatcgtgacttacttaaatccatttattggtcaccacaacggcgacttagtgggtaaaatctgtgcgcaaacaggtaaaggcgtacgtgaagttgtgttagaaaaaggtttattaacagaagaacaattggatgacattctttctgtagaaaacttaatgaatccaacttacaaagcgaaattaaataaataatttacgccaaatatcaagaaaatttaccgcactttaatctgtgccttaaagctgaataaataaaccagctaattgggtgcagatttttttatgattaaaatgttttaaataaccaatatttgttgccattgttaaatgttaatggcttatctaactaaaatagttgaaatttgaatgcatattaatgcggtgctttaagtaaaagtaaaagtaaaaggactaaattctgcggattatagaatttagtccttaaacaaatgtatctgatttttttaagattagatcgatttttctcttttatgtttctctctattcatctaaaaaacttctcagtgtttcagaacggctaggatgacgtaatttacgtaatgcttttgcttcaatttgacgaatacgttcgcgtgttacatcgaattgtttacccacttcttcaagcgtatggtcggtattcatatcaatgccaaaacgcatacgtaatacttttgcttcacgtggcgtcaagccttctagcacttcgtgagttgcaacttttaaactttgtgctgtggcagaatcaagaggaagttctaaggttgaatcttcaataaaatcgcctaaatgtgaatcatcgtcatcgccaataggtgtttccatcgaaatcggctcttttgcaattttcagtactttacggattttatcttctggcattcccatacgttctgccaattcttctggtgttgcttcacgtcccatttcttgtagtaactggcgagaaatacgattaagtttattgattgtttcaatcatatgcacaggaatacggattgtacgcgcttgatccgcaatagagcgagtgattgcttgacgaatccaccaagtagcatatgtagagaatttgtagccacgtcgatattcaaatttatctaccgctttcattaaaccgatattcccttcttgaattaaatctaagaattgtaaacctcgatttgtgtattttttcgcgatggaaattactaaacgcaagttagcttcaaccatttcttttttagctcgacgtgctttttgttcgcctcgtgcgactgcatcgcaaatgtcacgcatttgagtaatggtaagtttagtattttcttctgttatcgctagattgtttaaggcttcataaatacgatcttcatatttaattaaacgtttagcccaaggtttgctagattttaatgcttttgctacccattcactgttactgccattagcggtaataattttttcaaaatcatcctttggcattcctgctatatccactaatattttttgtagctgacgttcttggtagcgcacacgtttcatcatttctttcattgatagaacgagtaaatcaaattgttttggtactaaacggaattgtttaaaaatttcgccaagtagtgcaatttgatcttgggcacgttttccagagcgaccgtgtttttcaataacagcaagggttttagagtgctgttctcttaattgctgaaatttttcgcgagcaacttcaggatcaatactgttatcagagtcgcttgaatctgatgtagattctgattcattgtcttccacatctgcattactagattcttcttcatcatcttcgtcagaaaagtcttcatcaagtccgttgtgttcttctatttcggcatttggatcaacaaaacccgtaattaaatcggtcaaacggaaattacctttttctacatcatcatagttttttagtaatccatttaatgcttcaggataggctgcgatagaggtttgaacttcatcaatccctccttcaatacgttttgcaatgctaatttcatcttcacgagtaagaagatccaccgttcccatttcgcgcatatacatgcgtacgggatccgttgttcgaccgatttcagattctacatttgaaagaatttgagttgcttcttccactgcatcttcatcagggatggtatcactcaacatcatatcatcgctttctggtgcttcatctaatacagggatacctgcatcattttgcaacgtttgtagcaatttgtcgtaatattcaggatcaatagcatcttcgggcaataagtcattgatttcagcaaaagttaaatacccttgtgtacgacctagctccatcaattgctcaatttgttctgaatattgttcagccgtagattgttgatttttttccatttttatactcgttttgcttgatgtgattgagaagataagatttttttatgaacttgagattctaccattgttatagcggattcactaactgttttttctgctgttctttaccagctaaaagatgtacaagtaccgttttttcttcattagtgagaccctctgttcgttctttagcaataagcatttcaatatcgcgctcaatagcttgaatatttaagcgacggtaattttgagaaaatgcgttgattatgtcggattcgtctaataaatgatcccaagttgccagtatttcaaggggattactgtaagatgtattgcggaagtattccaaaatttgccccgtagtaatgccctctcgttggcgacaaagtgcggtcaatttttccagaatttcaaaccctgcttctgcacgtaatgcttgcacgccgctttcagacatacgttttactaactcaggattttgcagaagcaatgaaatgaccattcgcattggtgtcttcttgatcttattatgagtgactttttgttgtgtattggcttgttctaattgtttgggaataagattttccagctgagtttgatcaaaaatcccaagtttttgagcaagcatattgcgtagcgataagcgaagcatttctcctggaatttggtgaattaacggcgcagctagcgcaactaattttccgcgcccttctttagtggaaaaatcaacctgaggacttaaatgtgcaaacataaactcgcttaaagattgcgcactttcgatgtattcttcaaatttttctttgccgtattgacgaatgtaagtatcaggatcttctccatctggcaagaaaataaatttgagttgtctgccatcttctaagtaaggcaacgcattttctagtgctcgccaagcagcatcacgtcctgcacggtcaccatcgtaacaacaaacaacctgttcggtcgaacgaaaaataagttgaatttgttctgatgtcgtggacgtacctaaagaagcgaccgcataatccacgccaaattgtgctaatgccaccacgtccatataaccttcaacaacaagtaattgtttgggttcatcgttggtttgtaaggcttcatacaaaccataaagctccttacctttatgataagtaatggtttctggcgaattcagatatttcggtttttcatctgttaatacacgcccaccaaaagccactgtgcgaccacgtttatcacgaatcggaaacatgatgcgatttcggaatttatcgtaaatattgccacgatcatttcgagaaagcatgcctaattcaatgagtttttgttgttcttcacgattaacaccaaatttacgcagtacagtatccattgcattcggcacaaacccaatttggaaacgctcaataatttcaggtgaaagcccacgttgttgtaaatattcttgtgcttgagtatttaatggtaattggttttgataaaacgtggcaatctcttgcattaattcatagagatttcgtttggtttggtaattagcttgaggttttccgctgtgattagcgcgtttttcgtaaggtatttcaagccctgccattgctgcaagttcttcaatcgcctctataaattcaagtttgtcataatccattaaaaaggaaatcgcattaccatgtgcaccacaaccaaagcaatgataaaactgtttcttttggctaactgtgaaggatggtgttttttcgtgatggaaagggcagcaggcttgataatcgcggccagctttttttagttttacgcgcgtgttaatcacatcgacaatatcggactttgtcagcaaatcatcaataaaggggcgtggaatagaacctttcattgtcgagcctccgtgatcgtggtgtgaaagtgcggtcgtttttggcgtagatttttattgtgcttaaagtaacaaaaccgtgagtccaaaggattcacggtttgtcttaactcgagtcagaaaatactataaattagtataaacgggtattgcgcgcgttttcgcgagcgttgcgttttgcgtgacgttttgcaagtgttgcattttcacgtttacgaattgtagttggtttttcgtaaaattcgcgagcgcgtacttcagctaagattcccgctttttcgcaagagcgtttgaaacgacgtaaagctacgtcaaatgattcgttttcacgtactttaattacaggcataagccaatcacctcaatgagtttaatttaattgcaatttaaaattttatttttgccaaagcacctgtgtgtaaatgacaaatttaataaaggacgcaattctaatctatttttagggaaaaagtaaaggatagaatgccaattaaccttaatatttgtggtttcaactggttaaaaccgcttaaacagggtaaaatcgcgcaacattttaggtaataaattaagaaaatcaatgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgtgatcatattcggaaaacagcgcctcttattaaagcggcattagaggaagccaatttaaccgcaagcgatattgatggtattgcttatactagtggccctgggcttgtcggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccaggcggcgcggcactttctcgtttagcggaaaaaggcacgccaaatcgctttatatttccacgtccaatgacagatcgtgcaggccttgattttagtttttctggtttaaaaacatttgccgcaaatacagttaatcaagcaattaaaaacgagggcgaactgacagaacaaactaaatcggatattgcttatgctttccaagatgcggtggtggatactcttgccattaaatgtaagcgcgcattaaaagaaactggctataaacgtttagtgattgcgggaggagtgagtgcaaataaaaaactccgagaaacgcttgcgcacttaatgcaaaatttaggtggcgaagtgttttatcctcaacctcaattttgtacagataatggcgcaatgattgcttacacaggttttttacgtttaaaacaaggtcagcatagcgatctggctattgatgttaaacctcgttgggcaatgacggaattaccggcaatttaggagaaaaaatggcgaaactctacttctattactccacaatgaacgctggaaaatcaacgacgttgctacaatcttcctataactatcgtgagcgtgatatgagcacattagtttatacggctgcgattgatgatcgttttggcgtgggaaaagtcacatcgcgtattggcatttcgcaagatgcctttttatttcgctcggaaaccaatttgtttgatgaaatcaatgagcacttaaaaaaagaaaaagtgcattgcgtgttggtggatgaagctcaatttcttagcaaacaacaagtttaccagttgagtgatgttgttgataaactcaaaatccctgtgctttgttatggcttgcgtacagatttccaagcggaactttttgaaggaagtaaatatttactggcttgggcggatcaactcgaagaattaaaaacaatttgttattgtggccgcaaggctaattttgttttgcgtttaaatgatcagggcgaggtcattaaagaaggtgcacaaattcaaattgggggcaatgattcttatctttctgtttgccgtttacactataaagaaaagtgcggtcaaatttaaattagtttttaaacacaacattataaggacaattttatgctaaaaaacaaaacttttgggagtgcgctgattattgcaggcacaaccattggagcaggtatgcttgctatgccgcttacatcagcgggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgccacgttgagtttgttagttttactttatgcactttcagccgcttatattactggtggtggatctttactttcaggcttgccaacggcttttggaatggacgcaatctcacttaaaacggcgattattatctttactgttgtattaggttctttcgtggttgtaggaacgaaaggcgtggatggtttaactcgcgtgttatttattggtaagttagtcgcttttgcttttgtactgtttatgatgcttcccaaagtggcaacagataatttaatggcattgcctttggattatgcttttgtggtttctgcggcaccaatattttttacttctttcggtttccacgttataatggcgagtgtgaatagctacttaggtggaagtgttgataaatttcgtcgtgccattttgattggtactgcgattccattagctgcttaccttgtatggcagttagcaactcatggtgtattaagtcaaagtgaatttgtgcatattttacaagctgacccaacgctaaatggcttagtgaatgcaacacgtgaaattacaggttctcattttatgggagaggttgtacgtgtgttctcatcacttgctttaattacttcattcttaggcgtaatgcttggtgtatttgaaggcttaggtgatttattcaaacgctatcatttgccaaataatcgctttgtattaactgtagccgcatttttaccgccacttgtatttgcattgttttatcctgaaggatttattacagcattaagttacgcaggtttgttgtgtgcgttctattgcttaattttaccaattagcttggcatggcgtacacgtattgaaaatccaacattgccatatcgtgtttctggcggtaatttcgctttggtgtttgcgttattaattggcgtcgtgattatgctcattccatttttaattcaatggggatatttaccagtggtggcggggtaatatttgatttttccctagagaaaacacttttcttcctctgtttgcaggggagctgccgaaggttgaggggagatatagaaagcccccttccgtccttcgggcatcttcccccacaagtaagggaagttattttctacaatttatccgaatgatgaatcattacaaagcgttcccaaagctgttcttcggtttcttgatgttcaggatcgggcttaatacagttagtgattgggcaaactttttggcaggttggggtgtcgtaatggccgacacattccgtgcaaagtataggatcgatcacataaatctcatcgccaatggaaatggcttcgtttgggcattcaggcaagcacatatcgcagttggtacatttgctagtgatgaataatgccattgtgatccttaatagaaagttgaaagcggcgaattatagccgacaaaaacttgattgacaaaaactaaacaaaatttatgaaaaaacttacttccattctttctcttattgttctcgttatattagcaatttggcaatattttaccgatacaaccaaaactaaacatcaatcatcctcgcccgtaattgagcagacgaagcaaacaaaagtatctgagcctaaatttgaacctaaattcgagcctcaatttgagacaaagcggacggatattgaaaaaagtgcggtaaaaaatccagatgtttttgcaaactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaataaccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaataagaatttctttgatctaaatcgttacaacctagcacgaagtaggtataatacgaaaagttttcaattttaattttaacttaacaagaggatagattatgtcagtaatcaaaatgaccgatttagatttagcgggtaaacgtgtatttatccgtgcagatcttaatgtgccagtaaaagatggcaaagtgacctcagatgcgcgtattcgtgcgaccattcctactttaaaattagccttagaaaaaggtgcaaaagtgatggttacctctcacttaggtcgtccaactgaaggagaattcacaccagaagattctttacaaccagttgttgattacttaaaaaacgcaggctttaatgtgcgtttagaacaagattatttaaatggtgtggatgttaaagatggcgaaatcgttgttttagaaaacgtacgcataaacaaaggcgaaaagaaaaatgatccagaattaggtaaaaaatatgccgcactttgcgatgtatttgtaatggatgcctttggtacagcgcaccgcgcgcaagcatcaacttacggcgttgcagaatttgcaccgatcgcttgtgcaggcccattattagccgctgaattagatgcattaggtaaagcattaaaagaacctgctcgtccaatggtcgcgatcgtaggcggttctaaagtttcaactaaattagaagtattaaattctctttcaaaaatcgctgaccaaattattgtgggcggtggcattgcaaatactttcatcgcggcagctggtcacaatgtaggtaaatctttatatgaagctgatttaatgccagttgcgaaagaattagccgcaaatacagatattccagttccagttgatgtgcgtgtaggtttagagttctctgaaacggcagcagcaacagaaaaagcggtaaatgaagtgaaagatgatgaatctatttttgatattggcgataaatcagcagaacaattggctgaaattatcaaaaatgcaaaaaccgttttgtggaatggcccagttggtgtgtttgagttccctcacttccgtaaagggactgaaatcatttctcacgccattgcaaacagcgatgcattctctattgctggcggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaaccgcacttttcctctataacatattgatggtggcatcaaaaatgccatcatcaatacaaattcttcaaattgtgggcttatcccgctaaacataaaaaggaaacacaagtatggctaaattattagatatcgtgaaacccggtgttgtaacaggcgaagatgtgcaaaaagtttttgcttatgctaaagagcataactttgctattcctgccgtaaactgtgtgggttcagactccgttaatgccgtgttagaaactgctgcacgtgtaaaagcaccagtgattatccaattttcaaatggtggcgcagcgttctatgcaggtaaaggtatcaaaccaacgagtggtactcgtccagatgttttaggggcgattgctggagcgaaacaggttcatactttagcgaaagaatacggtgtgcctgttattcttcatactgatcacgcagcgaaaaaattattaccttggatcgacggtttattagatgcaggcgaaaaacattttgccgaaacgggtcgtccacttttctcttcacatatgatcgatttatctgaagagtcaatggaagaaaatatggcaatctgccgtgaatatcttgctcgtatggataaaatggggatgacccttgaaatcgaaattggcattactggtggcgaagaagacggcgtagataactctgatgttgatgaatcacgtttatatacacaaccgtctgatgtgctttatgtttacgatcaattgcatccagtaagccctaactttaccgttgctgctgcattcggtaacgtacatggtgtttacaaaccaggtaatgtaaaattaaaaccatctattttaggtgcatcacaagagttcgtttctaaagaacgcaatcttcctgcaaaaccaattaacttcgtcttccacggtggttcaggttctagccgcgaagaaatccgcgaagcaattggctacggtgcaatcaaaatgaacattgatactgatacgcaatgggcgtcttggaatggtattttgaatttctataaagcaaatgaagcttatcttcaaggtcaattaggtaaccctgaaggcccagatgcaccaaacaaaaaatactacgacccacgtgtttggttacgtaaaatggaagaatcaatgtctaaacgcttagagcaatctttcgaagacttaaattgtgttgatgttttataatccacaaaaataacataaaatacggccgcactttcaagtgcggtttttttattttagcggagaaattatggaaaagatcttagttattcgtaacgataaattaggcgattttatgcaagcatggcctgcttttgcaatgttgaaagcctcaaatccagagctaaaattaaccgcacttgtgccgagttacactgcgcctttagcggaaatttgtccatttattgatgatgttattattgatagcaaaaaaaatgacaaaacggatttcaaacgtcttgtgcaggaaatcaaagcgcagcagtttgatggcatgattagtttcttttccaatacccataatggaaaactcgcttggaaaagtggaattaaatatcgccttgcacctgcgactaaatgggttcaaattctttataatcaccgtctaacacaacgtcgttctcgttcagaaaaatcagaagcggaatacaatcaagatttagtccgcacttttttgcaaaagcataatatgccagttgttgaacctaaaccgccttatttaatctttgagaaaagtgcggtggaaaaccagcgcgtttttttacaagagagtttagggctttccgcaaataaaaaatggatctttgtgcatagtggttctggtggttcagctacgaatctttctttagcgcaatatgcggatttaattaaaggcttattggctgagtttgattgcaatattgtgctgacagcagggcctggcgaaagagaaaaagcctatgaattagcaaatcttgtgaatgatttacgcgtagccatttacgataagaataaaggtttagtggattttgctcattctttagcttgtgcggatttatttattgcaggatctactgggccattgcatttgagcagtgcgtttaatattccgactatcggattttatccaaatagtcgttcttctcagccgagacgctggaaaccgattaatgatgtcgataagcatcttgcattttgcccacccgcgggaaaagagactcaaatgaatttagagttaatttcaatagacaatgcgttagctgaaatatcacttttcatacggaatatgtggcaaacgagcaataatatttaagaagaattgaacaacgctgcctatgctggtggcgaaaaggacagtacccaagccaacgacaccaccaagtaaaaaaccaagtaaacaaaccgagatttcaaggcttgagcgtaccacgttgatgcttaaatgaaaacgttggcaaataccaaccattaatccgtctcgagggcctgcacctaagtgacaagtgagatataacgcagttccaaaaccatagagtaatataccgatcagacagaagatcattcgtgaaaaaagtgcggttggcggcgtcagtatttttgttgtgatccctagaaatagagcaataacgataatatttaataatgtcccaagcccaaggcgtaatttgagaggtttccataccaacattactgcgcaactaattaaaaaagatgaccagccaatatcaaaatttgtctgtattgctataccttgtgaaagtacagtccaaggtgtcgatcctaaacctgataatacaataagcccatctccaatacctaaaatagaaagagcaaaaagtaagattgaaatggttttatattgcgcggtccataatgatgtggcagcccaagatgtgcgaggtataacgcgtacttttttcttcatatttattaccttttatattccgttttatcataaaaggaaagatgcaaaaacagaaataattttgtcagttcatttatatcaaaaacatatttattttgagtaaccgtttgcataatgtttattttctaaaactgtgatcttcctcacgttttcaaaattgtctattttgttaccattgcgtacaatacgaaaccattttcaaaggggacgttatgttagcttcacttcaagatattctcgatacggttaaagccaataatctgacttatcatcaaaaattaatgacattaggcaatattgccgagcgtttatttgatcctcgcgatttacttggctataccgatgaagaatggggctttttacagaatcagatgatttgtgatttatgtgaaggctacgcgatttatcgtcctcgttatatcctgcctgattacaatgtgtatatccaaaagggctgcgaatttttagagttgccgcctccaaaagatcttgatgaggcacttgatggattattgattctttactcccgcgtgccatccattacgacttatcctgtttatgttgggcgtcttgatgtgttgctcgaaccgttcattactgatgaagaaaaagattacataaaaattaaacgtttcttaaatcatattgataaaactgtgcctgactcattctgtcatgccaatattgggccttatgatacgaaagcaggtcgcttgattttacgcgccgtgattgagcttgaagcgccaacaccgaatatgactattcgttatgacaaatcgaaaacaagccgtgattttgctgaacttgcagcaaaagcctgtttgttggtttctaaaccatcttttgccaacgatgcttactatatttccgatctaggcgaagaatacggcgtagcaagttgctataacgcactgcctgaatgtggcggcgcctacaccttaacgcgtttacgtctagggacaattgctcgcacctgtaaaagtgcggatgaaatgctgaatgaattattaccgcgtgtggcgaaatgtgctctttcaaccatggataaacgccacaaatttgtagtggaagaaagtaatttctttaacagttcattcctcgaaaaagagggatttatcaaacgcactaattttacggggatgttcgcaattgtgggcttggcagatgcagcaaaccacttattgcaatgtgaaggcttaaatgaaacctttggtaagagcgttcgtggcgatgaaattgccactgcgattatggataaattgaaagaaattactgatgcgcacgaaggagtttatgccgaacgtactggcaatcgttatttattacacgcacaagtgggcgcaagtaaccacgaagaagacaagcgtaacgcaccggctcaccgtattcgtgtaggcgaagaaccaacgttacttgcacatttgaaacaatctgcaccgttccataaatatttcccatctggtacaggggatttattcgcctttgatcaaacctatgtagatcactgcgatgcagtggtggatattattgatggcgcattttccttaggctatcgctacattaccacctatttgaaaaatacagatttaattcgagttacaggttatctagtgaagaaaagcgaagttgaaaaataccgtaaaggcgaagttgcattacgcgatacaacttggtatggctcgggtacggatgaatgtgccaatgtgtttgatcgccaattacgcaatgaaaaagatgtgatcgctgaaaaataattagaaaaatgaccgcactttctgagatttttgtgccgttgcatcggattattcctttttcaaatgtagagggacaaggcaatcgttcgagtatttttctgcaaggttgcaagctaaattgcttgtattgccataatccggaaaccatacctcgttatacggaaagtgcgaaattggtcagtttgcagtatttgtatgaacaggttatggaggcagttccatttattcgcggtgtaacggtttctggtggagaacccactattcatcacaaaaaacttgtgccactctttaaggctttacgttcgcaaggattgacttgttatttggatagtagtggcttttttgagtttgatcgtgtttgttcgttaattgatgtcactgacaaatttttatttgatctcaaaggcgagggcattggcttgcaaacactttgttttgatcggaaaaatcaagcaggtattgtatcacagcaagtgatactagagcgtttgcatataaaaaacgataaactggagcggaatttgcaaaatttagctgccttattgccattaaataaagtggaagaagtgcggttggtttttttaaagcatttttttgatgctgaacatttggtgggcaaagttgctcaactactacgaaattatcctgatgtggcattaaaaattatctgcgtgcatagcaaaggcgtacgtgatgaagctgggttatcagcgtatatcccaagtgtggaagaaactaatgcgctatctgcttatgcgcgtcaatgtggaattaacaagattttgactattttatagacgtttacaaaaagtgcggtgaaaattcgccgacttttcataagaaaacaagtagaataagccgaattttattaacttaactaatctaggggaatcaaatgagtgtgttaagcagcattttgggaatggtcgtattaatcgctattgccgtgttactttctaataatcgtaaagcgattagtattcgaaccgtagtaggggcgttagcaatccaagtaggatttgccgcccttattttatatgtgccagcaggtaaacaagcgttgggtgccgctgcggatatggtatccaatgttattgcctatggtaatgacgggattaatttcgttttcggcggattggcagatccaagtaaaccatccggtttcatttttgcagtgaaagtattaccgattatcgtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcgttggtttaattgcattaattaatggtattttaagtggcgtaggcggatggttcggctatggcgacttaaccttacaatctatctttggtttaatttttaaaccattagcatacttaatcggtgtaactgatggtgctgaagcaggtattgcaggacaaatgatcgggatgaaattagcggttaatgaatttgtgggttatcttgaatttgcaaaatatttacaaccagattctgcaattgtattaactgaaaaaaccaaagcgattattactttcgcactttgtggttttgctaacttcagctcaattgcaatcttaattggtggtttaggtggtatggcaccaagccgtcgtagtgatgttgctcgtttaggtatcaaagccgttatcgctggtactctcgctaacttaatgagtgcaactattgctggtttatttatcggcttaggtgctgcagcactttaatttatcttaatcaattaaaaagtgcggtaaaaaatgaccgcactttattcatttttattcattattaaaaataaggaaaaattatgactccacatattaacgcgcctgaaggtgcatttgctgatgttgttttaatgcctggcgatccacttcgtgcaaaatatattgcagaaacttttttacaagatgttgttgaagtaacgaatgttcgtaatatgcttggttttactggaacttataaaggtcgtaaaatttctattatggggcacggtatggggattccatcttgctctatttacgcgaaagaattaatcactgaatatggcgtgaaaaaaattatccgtgtaggttcttgtggcactgttcgtatggacgtgaaagtgcgcgatgtgattatcggtttaggtgcatgtactgattcaaaagtaaaccgtattcgtttcaaagataacgactttgcagctattgctgactttgatatggcacaagccgctgttcaagctgcaaaagcaaaaggtaaagtcgttcgtgtaggtaatttattctcggcggatttattctatacacccgatgtggaaatgttcgatgtaatggaaaaatacggcattttaggtgtggaaatggaagctgctggaatttatggtgtggctgcagaatatggtgcaaaagcattaacgatttgtaccgtgtctgaccatattcgtactcacgaacaaaccacggcagaagaacgtcaattaacattcaatgatatgattgaaattgcgttagattcagtattaattggtgatgcactataatatcttctatcggatttaagaagtgcttgaaaaacaaccgcactttttatataatccgcgcccattatgagccgtttgtggctcatatttttgtgtggtgcaatgaatcttgcactaaaaattatcggggagctatttaatagcgttattacccaattagaggaaaactaaaatggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaacaaagataaagtgggtaaagtaactttagatcaagttcgtcaaatcgctgaaactaaagcagcagatatgactggtgcgactatcgaaacgaaaatgaaatcaatcgctggtactgctcgttcaatgggcttagtggtggaggaataatacgatggctaaattgactaaaaaaatgaaagcaatcaaagctggcgtagattctactaaagcatacgaaattaacgaagcgattgcggtattaaaacaattcgcaacggctaaattcgttgaaagtgttgatgttgcagtaaacttaggtatcgatcctcgtaaatctgaccaaaacgttcgtggtgcaactgtattaccacacggtactggtcgtgaagtacgtgtagctgtgttcactcaaggtgctaacgcagatgcagctaaagaagctggtgctgatttagtaggtatggaagatttagcagagcaaatcaaaaaaggcgaaatgaactttgatgttgttatcgcttctcctgatgcaatgcgtgttgttggtcaattaggtcaagtattaggcccacgtggtttaatgccaaaccctaaagttggtactgtaacaccaaacgttgctgaagcagttaaaaatgctaaatctggtcagatccgttatcgtaatgataaaaacggtatcatccacaccactatcggtaaagcaaacttctctgaagttcaattaaaagaaaatcttcaagcattattggctgctttaaataaagcaaaaccaactactgctaaaggtattttcatcaagaaagtaagcatctctaccactatgggtgcaggtgttgctgttgatcaagcttctttataatttaaagaattgatagattttaaaccgcactttttgaaagtgcggtttttttgtttcataaaatttctatataagttttaaacttgacgagaaagctgcattcatttaaaatttaccgccttaaaattagcaaagatttagattgatttttaatcaatcttgaccttttattgcttaatttaaccgtgtttttgatagaaagcacatccacacaatgacaaattcaccgttatttgtcgttgttttgctcaagttgtcgttctatgtaatttgagttgtcaccccactatagaagtaaggttcagagtgcggtcattttaacggtcattcacgtcacagttagtttgtggctaggtcactgaacagttagcagaggaaaaccaatgggttactcctattctgaaaaaaaacgaattcgtaaagatttcggtaaacgtccgcaagttttaaatgttccttatttattaaccattcagttggattcttttgataaatttattcaaaaagatcctgaaggtcagcaaggtttagaagcggcattccgttctgtatttcctattgtaagcaataatggctatacagaattacaatatgtagattatcgtttagaagagccagagtttgatgtacgtgagtgccaaattcgtggctcaacttatgcagcaggcttacgtgtaaaattacgtttagtgagctacgataaagaatcttcttcacgcgcagttaaagatattaaagaaaatgaagtttatatgggggaaatcccattaatgactgataacggtacttttgtaattaatggtaccgagcgtgttatcgtttcacaattacaccgtagtccaggtgtattctttgattctgacaaaggtaaaacccattcttcaggtaaagtgctttataacgcacgcattattccttaccgtggttcttggttagattttgaattcgatccaaaagataacttatttgcgcgcattgaccgtcgccgtaaattaccggcaacaatcattcttcgtgcattaggctacaccactgaagaaatcttaaacttattctttgataaaattacctttgaaatcgctggcgataaattgttaatgactttagtgccagaacgtttacgtggtgaaacggcttcttttgatattgaagcaaatggcaaagtgtatgttgaacgtggtcgtcgcatcactgctcgtcacattaaagcattagaaaaagataatatctcacaagtggttgtgccttctgaatatattttaggtaaagttgcgtcgaaagattatgttgatttagagtctggcgaaattatttgtcctgcaaatggcgaaatttcgttagaaaccctcgcaaaattagcacaagctggttacaccacgatcgaaactttatttactaatgatttagattacggtccatatatttctgaaacgctacgtgtcgatccaacttatgacaaaactagtgcgctttacgaaatttatcgtatgatgcgtccgggcgagccaccaacaccagaatcttcagaagcgttattcaataatttattcttctctgcagaacgttatgatttatctacagtaggtcgtatgaagttcaaccgttctttagcttttccagaaggggaaggtgcgggtattttaagcaatgaagatattattgcggtaatgcgtaaattgatcgacatccgtaatggtcgtggcgaagtagacgatattgaccatttgggtaaccgtcgtatccgtagcgtgggcgaaatggctgaaaaccaattccgtatcggtttagtgcgtgttgaaagagcggtcaaagaacgtctatctttaggcgatttagatgcgatcacgccacaagacttaattaacccgaaaccgatttctgcggcagtaaaagaattctttggttcttcacagctttcgcaatttatggatcaaaacaacccattgtcagaagtgacacacaaacgtcgtatttctgcattaggtccaggcggtttaacgcgtgagcgtgcaggctttgaagtgcgtgacgtacataatactcactatggtcgtttatgtccgattgaaacccctgaaggtccaaacatcggtttgatcaactcactttctgcttttgcacgtactaatgattatggtttcttagaaacaccatatcgtaaagtggttgatggtcaagttactgaagaaattgaatacttatctgtaattgatgaagcaaactacatcattgcacaggcaaactcaaacttagacgaaaataaccgttttactgatgctttcgttactgctcgtggtgaacgtggtgaatctggtttatataaacctgaagatattcactatatggatgtttcgacacaacaagtggtatctgttgcggctgcattaattccattccttgagcatgacgatgcgaaccgtgcgttgatgggtgcgaacatgcaacgtcaagcagttccaacattacgtgcggataaaccattagttggtacaggtatggaaaaaccaatcgcacttgactcaggtgttgcggttgttgcaaaacgtggtggtaccgttcagtacgttgatgcgtctcgtattgtgattaaagtaaatgaagatgaaaccattgcaggtgaagctggtattgatatttataatttaattaaatacacccgctctaaccaaaatacttgtattaaccaaattccttgtgtgaatttaggcgatccaattaatcgtggcgaagtattagcagatggtccttcaactgatttaggggaacttgcattaggtcaaaatattcgcgtggcgttcatgccttggaacggctataacttcgaagactcaatgttagtttctgaacgtgttgttcaacaagaccgtttcactacgatccatattcaagaattatcttgtgttgcgcgtgatactaagttaggtgcagaagaaattactgcggatattccaaacgtaggtgaatcagcgttaagcaaacttgatgaatctggtatcgtttatgtcggtgctgaggttaaaggtggcgacatcttagtaggtaaagtaacccctaaaggcgaaactcaattaaccccagaagaaaaattgttacgtgcaatctttggggaaaaagcttccgatgtgaaagattcttcattacgcgtgccaaatggtacatcaggtacggttattgatgttcaagtcttcactcgtgatggcgtagaaaaagataaacgtgcattagaaatcgaagaaatgcaacttcgtgaagcgaaaaaagatttaactgaagagttagagattttagaagctggtttatttgctcgtgtgcgtaatcttcttatttctagtggtgcggatgcagcacaattagataaagtagatcgcactaaatggttagaacaaaccattgcagatgaagaaaaacaaaaccaattagaacagcttgctgagcaatacgaagaacttcgtaaagagtttgaacataaacttgaagtgaaacgtaagaaaatcattaaaggcgatgatcttgcaccgggcgtattaaaagttgtgaaagtttaccttgcagtgaaacgtcaaatccagccgggggataaaatggcgggtcgtcacggtaacaaaggtgttatctcgaaaattaacccagttgaagatatgccatacgatgaaaatggtcagccagttgaaatcgtattaaacccactgggcgtaccgtctcgtatgaacatcggtcagatccttgaaactcacttaggtttagctgcaaaaggtattggtgatcaaatcaatgcaatgcttaaacaaaaacaagaagtggaaaaattacgtagctatatccaaaaagcatacgatttattaggtaatggttcacaaaaagtggatttaagcacttttactgatgaagaagtattgcgtttagcgggaaatttacgtaagggcttaccagttgcaacgccagtgttcgatggtgcagacgaagcggaaatcaaagagctattaaaacttggtggattaccaacttcaggtcaaataaccctttacgatggtcgtactggcgagaaatttgaacgtccagtaaccgtgggttatatgtacatgctaaaattgaaccacttagttgatgataaaatgcacgctcgttcaacaggttcttatagccttgttacacaacagccactgggtggtaaagcacaatttggtggtcagcgtttcggtgagatggaggtatgggcacttgaagcatatggtgcagcctacaccttacaagaaatgctaactgtgaaatccgatgatgtgaatggtcgtacgaagatgtataaaaatatcgtaagtggcaaccaacatatggagccaggcacaccggaatctttcaacgtaattatgaaagaaatccgctcacttggtttaaatatcgagttagacgaagagtaatttcattcttgccttcccctgcttgtgggggaaggtgcccgaagggcggaagggggaaattcccccctcagcctgcggcagctccccccgtaaacagggggagcgaagagaaaaaatgacgaaacaataaatcgccgaagtgcggtcaaaattctccgaaatttttaaccgcactttaaacctttaactccgacaggagaacatttgtgaaagacttagttaagtttttaaaagcacaatcaaaaaccagtgaagattttgatgtgattaaaattgggttagcttccccagatatgatccgttcttggtcatttggtgaagtgaagaaacctgaaaccattaactaccgtacgttcaaacctgaacgtgatggtcttttctgtgcgcgtatcttcgggcctgtaaaagattacgaatgtttatgtggtaaatataaacgtttaaaacaccgtggtgtgatttgtgaaaaatgtggtgttgaagtcactcaaactaaagttcgtcgtgaacgtatgggtcatattgaacttgcatcgccagttgcacatatttggttcttaaaatcattgccgtctcgtatcggtttacttttagatatgccattgcgcgatatcgaacgtgtactttattttgaaatgtacatcgtgaccgaaccaggtatgacggacttagagcgcggtcaattattaacagaagaacaataccttgacgctgaagatcgctggcaagatgaatttgaagcgaaaatgggtgccgaagcgattcaagatctcttaaaaggtatggatcttgaagctgaatgtgaaaaattacgtgaagaattacaagaaactaactctgaaactaaacgtaaaaaaatcactaaacgcttaaaattattagaagcatttgttcaatctggtaataaaccagaatggatggtgatgacggtattgccagttcttccaccagatttacgcccattagtaccacttgatggcggtcgttttgcgacttcagatctgaacgatttatatcgtcgtgtaatcaaccgtaacaatcgtttaaaacgtttattagatttaattgcgccagatattattgtgcgcaacgaaaaacgtatgttacaagaatctgttgatgccttattagataatggtcgtcgcggtcgtgcaattacgggttctaaccgtcgtccattaaaatcattagcggatatgatcaaaggtaaacaaggtcgtttccgtcaaaatttattaggtaaacgtgttgattactctggtcgttctgtaatcactgttggcccatacttgcacttacaccaatgtggtttaccgaagaaaatggcattggaattattccgtccgtttatctatgcgaaattagaaagccgtggttatgctacgacaatcaaagcggctaagaaaatggttgagcgtgaagaggcgatcgtttgggatattcttgcagaagttattcgtgaacacccaattctattgaaccgtgcgccaacacttcaccgtttgggtatccaagcgtttgaaccgatcttaatcgaaggtaaagcgattcaattacacccactcgtttgtgcggcgtttaacgcagacttcgatggtgaccaaatggcggtacatgttccattaacccttgaagcgcaattagaagctcgtgcgttgatgatgtccaccaataacgtgctttctccagcaaacggtgatcctattatcgttccatcacaagacgtggtattaggtctttactatatgacccgcgaaaaagtgaacggtaaaggcgaaggtatgttattgcaagatcctcgcgaagctgaaaaagcatatcgtacaggcgaagcagaattacattctcgtgtgaaagtacgtattactgaatatgtgaaaaatgaagcgggcgaatttgatgcgaaaaccacgctgactgatacaactatcggtcgtgcaatcttatggatgatcgcgccgaaaggcatgccttattcattgttcaaccaaacattaggtaaaaaagccatttctaaactgattaacgaagcatatcgtcgtttaggtttaaaagaagcggtaatgtttgctgaccaaattatgtataccggttttgcgtatgcggcacgttctggttcatcagttggtattgatgatatggaaattccagcgaagaaatacgaaattatttctgcagcggaagaagaagtagctgagatccaagaacaattccaatcaggtcttgtgacggcaggcgaacgctataataaagtaatcgatatttgggctgccgcgaatgagcgcgtagcgaaagcgatgatggaaaacttatctcaagaagaagtcatcaatcgtgaaggtaatcctgaaaaacaagcgtcctttaacagtatctttatgatggctgattctggtgcgcgtggttctgcagcgcagattcgtcagttagcaggtatgcgtggtttgatggctcgtccagatggctcgatcattgaaaccccaattacagcaaacttccgtgaaggtttgaacgtattacagtactttatttcaacccacggtgctcgtaaaggtttggcggataccgcattaaaaacagcgaactcaggttacttaactcgtcgtttagttgatgtggcacaagacttagtgattgtagaagatgactgtggtacgcacgaaggcttagtcatgaccccattaattgaaggtggagatgaaaaagtgccacttcgtgaattagtattaggtcgtgttgctgcagaagatattttaaaaccgggtgcagaagaagtattaattccgcgtaacaccttattagatgaaaaactctgtgatgtgttggatgcaaactctgtagatagcgtaaaagtacgttctgttgtaacttgtgatactgactttggcgtgtgtgcgaaatgttatggtcgtgatcttgcgcgtggtcatttaatcaaccaaggcgaagcggtgggggttattgccgctcaatctatcggtgagccgggtacacagctaacaatgcgtacgttccatattggtggtgcggcatctgcggcagcgaaagaatctagtgtgcaagttaaaaacactggtacagtgcatttaatgaatgcaaaattcgtgactaacgatgaaagcaaactagtattaacttctcgtaacacggaattaactattactgatgcatttggtcgtactaaagaacattataaagtgccttatggtgcggtattaagcaaaggtgacggtcaagaagtcactgcaggcgaaactatcgcaaattgggatccacatacaatgccagttgtctctgaagtatctggttttgtgaaatttgtagacattattgatggtttaactgtgacgcgtcaaacagatgaattaacaggtttatcatcaatcgtggttcaagatgtgggtgaacgtgcaactgcgggtaaagatttacgtccaactattaaattagttgatgcaaatggcaacgatattttcttacctgaaactgatgttcttgcacaatacttcttacctggtaaagcaattgtaagtttagacgatggcgcagcagtgaaagtaggggaaccattagcacgtattccacaagaatctgtgggtactaaagatattactggtggtctaccgcgcgttgcagatttatttgaagcacgtaaaccaaaagaaccagctatcttggctgaaatttctggtatcgtgtctttcggtaaagaaaccaaaggtaaacgccgtttattaattactcctgcggaaggcgaaacttacgaagaaatgattccaaaatggcgtcagctcaacgtatttgaaggcgaaatggtacaacgtggcgatgtaatttctgatggtgctgaaacaccacacgacattttacgtttacgtggcgtgcgtgcagtaactgaatacatcgtgaacgaagtgcaagatgtttaccgcttacaaggggtaaaaatcaacgataaacatatcgaagttatcgttcgtcaaatgttacgtaaagcggtaattactaaagcttacgactcagaattccttgagggagaacaagtcgaagtggctcgcgtgaaaattgttaatcgccaacgtgaagcagaaggtaaaccaccagttgaatttgaacgtgaattattgggtatcaccaaagcgtctcttgcgactgaatccttcatctctgccgcatcgttccaagaaactactcgtgttcttaccgaagcagcagtggcaggtaaacgtgatgaattacgtggcttgaaagagaacgtaatagtaggtcgattaattcctgcgggtacaggttttgcgtatcatcaaaatcgtcacaaacatcgtttagttgatgatgtcgtagcgaaattatctgaagaagatgaagctgctatcgctgatgaatttgttatgactgcagatgatgcaagtgcgaacttagctgaaatgcttaacatggcagatgatgcggaataattaattccctgtatgagaaaacccgaatgaaagttcgggttttttatttttatgaaaatgggtagaggttttatgccagaacaacaagtatgtttcttcatagaaattcacaaaaatttgagacttttagaaaagtctgttgttgatagttatgttacactttgctcatatttttcaaaataaggatcatactatgaatataacaaagccttttcctcttccaacaggatatttcggtattcctcttggtttagcagccttatctttagcttggtttcatttagaaaacttatttcctgctgcgcgaatggtaagtgatgttcttggcattgtagcaagtgtggtctggattttatttattttaatgtatgcgtataaacttcgttattactttgaggaagttcgtgcagagtatcatagcccagttcgtttttcctttattgcattgattcctattacaactatgttggtaggcgatattctttatcgttggaatcctttaattgctgaagttttaatttggattggaacgattggtcaattacttttctcaacattacgtgtcagtgaattatggcaaggtggtgtatttgagcaaaaatctactcatcctccgttttatttgcctgcggtagctgctaattttaccagcgcaagttcattagcattacttggctaccatgatttagcctacttattctttggcgcaggaatgattgcttggattatttttgaacctgtattattacaacatttacgtatttcatctcttgagccacaatttagagccacaatagggattgttttagcacctgcgtttgtgtgtgtatctgcttatttatcgatcaatcactgcgaggtggatacgttagctaaaatcctttggggatatggatttttgcaattatttttcttattgcgattattcccttggattgtggaaaaaggacttaacattggcttatggacattctcattcggattagcgtctatggcaaacagtgctaccgctttctatcatggcaatgttttacaaggcgtgtctatttttgcctttgttttctcaaatgtaatgattggcttattggttttaatgacaatatataaattaactaaagggcagtttttcctaaaataaggcatttaaattaactaaggcagggattccctgccttatttacatattacatctatttgtctttttctatttcaatcacttctacacaatttaccgtacccgctttaattcgccatttcacattaaattcgtacaaacttgttccataaatacgatcactcggtttaccttgttgataggctgggcgaggatcttgctctagcacttggcgaataaaacgacttaagtgcggtcgtttttcttctcgtttttttaccgcacttttggcttgctcggtaaattcaacagtcagttttactggtggtttttcttgagcaaagctcgattgtgcatttggctcactatccgcataggcaatatagggtttgatatcgaaaatgggcgtgccatccactaaatccaccgcacctaaatggagaaaaatgttaccgttgatgcattctacttgacgtaattcgactttggataaaccaagaggatttgggcggtgcgttgcgcgtgaagcaaacactccaattcgttgattaccgcctaaccgaggagggcgtacggtgggttgccatttcccttgttggatttggtcgaattgaaaaattaaccaaagatgactgaattgttctaatcctctcacggcttcaggcgaattataaggcggtaagagttctacaatgcctactccgtcttcaactaacttaggttggcgtggtacggagaatttttctttataaggcgtgtggataatggcgataggcgataaggttaaatcattcataaattgggtgtcttagtgtagaatacgcggcttattgtaatcaaaagtgcggtcaaaaaaaatgataaatgaaaaattgaaaatgtggtgggaaacggctcgaccgaaaactttgcccttagcgttggcatcgattttcacgggttcggcattaggttattgggcgaatccacaaggttttaatgggcttgtaatggtgctttgtttactcacgacaattttattgcaggtgctttctaattttgccaatgattatggggatcatcaaaaaggttcagatactgaagaacgtattgggccattacgtggcattcaaaaaggcgcaatttcagcaaaagaactgaaatggggattaattctaatggtgatggcaagttttctttcaggaagtttcttgattggaatcgcttatgaaaatctctcagatttattcgctttcgctgggcttggaattttagctattgttgctgccattacttacactgttggggcaaaaccttatggctatatgggattaggcgatatttctgtattagtattttttggtttgcttggcgttggcggcacttattatttgcaaactcacagtattgctagccacattattttgcctgctattggttctggcttattggcaagtgcggtattaaatatcaataatttacgtgatattgaacaggatgcgaaagctagcaaaaataccctagccgttcgtttaggtgcatataaagggcgtgtttatcattgtattttattaagtgtggcggctctatgttatttggcatttgcggtggcaacggccacggccacttcttggacaaattatttatttgtattagcaatgccattgttagctaaacacgcgatctttgtttatcgtagtcagcagccaagtgaattgcgtccaatgttggctcaaatgtctatgatttcgttattaatcaatatcttgtttagtttaggcttgcttatcggctaaatcggcatatactaaagcaaacaaaatttcaacaatcgataggggaaagttatgtttattgatacttcagaactttgcgatctttatgcagaacaagtggatgtcgtggagccaattttttcaagctttggtggcgtaagtcatttttacggtaaagtcactacagtaaaatgctttgaaagtaatggattaattgctgaagtattagaagaaaacggcgaaggtcgagtgcttgtcattgatggcggtggtgcggtacgccgtggtttgattgatgcagaattggctcaacttgccgttgataatggttgggaaggcattattgtatatggtgcagtacgccaaattcagcaattagaaaacctcgatattggtattcatgcccttgcgccaattccagtcagtgcagatgaaagcagtgctggcgagagtgatattccagtgaattttggtggcgtaacctttttcccagaagattatatttacgcagatctgacaggaattatactttcgcaagagcctctagatttagaagattaatttctacttgattaacatcttagtattttatttaagctttcctattctaaacggcgtatcatactaaaaaattaaattgtaactatatgatatataaaaccccgttcaatttgaacggggttaaaagtgcggtaaatttttaatgtgttttatggcttgtgctatacaaaattttgtccgtataagctaaagcaattgccgacactaaaaagcccaagtgcaacaataattgccacatcatcgttttttctggcatattgcttgcattcacaaaagtttgcaacatatggatagatgaaatgccgataatagacatagaaagtttaactttcaacacggtggcatttacgtggctcatccattcaggttgatcggggtgattacgtgtacgcaatttagatacaaagatttcatagccaccgatagtcaccatcacaagtaagttggcgatcatcacgacatcaatcaaattcaacacgcctaacataattgtgttggaatccatatcatttacattaatcactaactcccataatcctttgataaatttataagagtagattgcaagggtgacaatcaagcccaaataaatcggcacttgcaaccagcgactagcaaaaattattttcgcgataatattcgattgttcgttatatttcgcataaggatcaacaggtttgttttctttcataagattttattcctaaattaaacagtgggttaaataaacaaaaaaaccgcaagaaaatagcagtttttttgaaaatagcaataaggaaattgagttattctaattttatttgaaactgtaaatagactctcttaacacacaagtcggttctaacaccaaagtgaggtaattttcattaggatttttaattcgttgcaatagtgtttcaacagcgagtttgccaagttcagctttcggttggcaaatggtggagagaggaggcgagagataacgagccaattcaatgtcatcatagcccataattgaaagatcttgcggaatacgtaagccttgttgctgaatagcttggtatgcaccgacagcaatggtgtcactacaacaaaaaactgctgttggacgtgaagattgagtaagtaaagattgtatgccaagtacaccgccttcaaagtcaaaatgactttcgacaatccaatgaggatttaacgcaatttttgcttccgacagcgcatttttataaccttgcaaacgattttgtgcgacagattttttgagatttcccgtaataatgccaattttacgatgtcctgcatcaattaatgcttttgtcgccaaatagccaccaagtgctgaattttcgagtattttatctgcatttaactcagtaaaccaccagtccatcacaaccagtggcagcgaaatggctaactctatatcagcctgaaaacggctatcaccacacatcaaaagcaaaccatccacttgtttgtgcattagagtttgcagattttgttgtaggcgtttggcatctccacccgttgtagcaataataagattatattgatttttctgacaatattgctccacgccagccatcacttccgcaaagaagggattatttgttgcggtgacaagtagcccgatagttttggtttcgcgcaccttaaggcttcgtgcaacagctgaaggggtgtaattcagttcagcgacaatacgcatcactttctcacgaatttcatcgctaacaaaacgcgatccattaatgacatgtgaaactgtagaagtcgaaacttgcgccagtcgtgcaatatctttcattgtcgccataaaaacaccctaaaaattcaccgcactttaagcgtgttcaagaaattccaaagtttcttgacgcgttggaatagaggattgagccccttttttcgtcacactaatcgcagcggcagcttgaccaaaacgaatggcttcatcaaaggatttttcttccaataaagccgtaacaaaaccgccattaaatgtatcaccagctgcggtagtatctattgcttgcacacaaaagcccttaatgatgcggcttttaccttttcgactgacaaacacacctttcgcgccaagggtaatcattacggtttcaatgcctttatcgtgaaaaacactcgcagctttcaccgcactttgctcgtcggctaccgctacccccgtcaggatttcagcttctgtttcatttggtgtaataatatcaatcaaactcaataattcgtccgataaaatctgcgctggagcaggatttagcacaaccttaacaccatttttcttagcgatttgagcagccagctccacaccagaaagtggggtttctaattgcattaacaagcaatccgattgtgcaatttgcgcctcactttgacgaacgaccatctcacccaaatgtgcatttgcaccgctagccaacacaatactgttctcactagacttggcgacttgaataaatgccattcctgtcatttcctgtgaaacggtattaatatgggttgtatcaattccttcttgctcaaacgcatttttcattgttttgcctatgctatctgatccaatgcaactaatgaacgctacctttgcacctaaacgagcggctgccactgcttgattggcacctttgccaccataggcaatttgataattttgacctgttagcgtttcaccgggtttagcaaagtaaggcacagaaataacgtgatcagcattgatactaccgagaaccgtgagggtttttttcattattttatcctgtattgttatattttttctttctacacaatgggacaaatataatttgccccataatgtgatataacgagcttatttagtagatagattattcacttattactttcaaatctactggaattttcgcttcaactttttcgccctttaagattttatcagcggtaacaacacctaatgaaccaataagctcgggttgttgtgcgatagttgctgccattttgccactttttaccgctttaacaccatcatcggtaccatcaaaacctacgataaggacttttttatttgcggctttcaccgcacgtaatgcacctaatgccatttcatcattttgcgcaaaaattgcttgaacatcacctttagatgccaacaaattttccgttacattcaaaccttttgttcgatcaaaatctgctggctgactggcaagcacattgaatttatgagcatcaatagcttgtttgaaaccctcacctcgttcgcgtgccgcagatgttcctgcaataccttcaagttgaatcaccttggcattatcgcctaatttctgtgcgataaaatcacctgccattttaccacctgcgatattgtcagatgcaatatggctcactacgtttcctttagctgcgccacgatctaatgtaattactggaatatgcttacggtttgcaatcgccactgcgttgccaactgcttcagaatcagttggattgatcaataatatttttgcaccacgcacagttaaatcttcgacattagctaattctttagcagggtcattttgtgaatcaagcaccactaacttataacctaattcatccgcttttttctgtgcgccatcttttaacgttacaaaaaatgggttatctaatgtagatactgccaaagcgattgtgtcttgtgcagaagcagagccagaaacagccaaacctaataatacagcagaagtaagtgcggttagttttttcatagtttctccttaaagtgagttacagtttttttgtaccaagatagttatcggctaaaacagcaaccaaaataaccaacgcttttgctatcatttgatagtaagatgaaatatctaataaatttaatgcattgtttaaaaatccgatgattaatgcaccgatgagagttcccattacacgacctttcccccccatcaaactggttccaccgactaccacggcggcaattgcatctaattcataagatacgccagcagtgggttgagcggaagataaacgtgaagttacaattaaacccgccagcgcagaaagaaatccactcaccgcaaaaacaaatactttgattttattgacgttaataccagaaagttgggtcgctgcctcatttccacctaaagcataaatatagcgaccgattggtgtgtgttttaaaatataccaagcaaccgcaaacacgatactcataatccaaattggtactgggatacctaaaacatagcctgtaccaatgctagcaaatagatcagcattatccgaaaaacctgtcgtaataggacgaccatctgtataaaccattgttataccacgcagtaaggtcatggtaaccaaggtagcaataaaagcctgaactttcccttttgccacaattacaccacttatgccaccaagaagtgttccaatcaataaaaccacaggaatgactaaaaaaataggcaattcgatactcaccattgaagcggcgattgcacctgtcaatgccaatacagatccaacagaaagatctatacctgcaattaaaataacgaaagtcatacccactgcaataatcgcattaaccgaagtttggcgtaaaatattcaaaatattatctacgctaaaaaaatcaggattaatcattgatacaatcgcgataagaataatcaacgcaataaaagaacgctgttcaatcaaaaatcttcctatttgaaaattagatgtttcatttttcatcatacttacctactcttatttaccaatagctgctgctaataatttttcttgagttgcgtctttgcgagaaaattctgcactaattttaccttcacgcattaccaacactctatcgctcataccaagcacttctggcatatcagatgagatcattaaaatactcaagccctctttcttaaattcgttaatcaactgataaatttctttcttcgcgccaacatctacgccacgagttggttcatctaaaatcaacacatttgggcgagtcattaatccacgagcaattgccactttttgttgatttccaccagatagcaaacctacttgttgatcacgattaggtgttttaatgttaaacatcagaataaagtcatctactgtcattttttccgcttgatgacgaatactgcctttttgtgaaaaatgatcgagcgatgtgagcgacatattttcttttactgacattcctaaaaccaagccatcacctttacgatcttcagaaatatatacaataccattatccaaaccatcttgcggactgagattctcaatctcttgattttttaaccgcacttttcccgccgtttttggcaaagcaccgtaaagtagcttgccgagttccgttctacccgcacccattaagcccgagacaccaacaatttcaccggcatgcaatttgaaggaaacatcatcaataccgcttccgctcacatttttcacatccaatacacattcgcctttttcttgtgataaatgcggatattgttcatcaagacgacgaccaaccatcatttcaattaaatcatcttctgtaatttctgccacaatgcgttcaccgataaattgaccatcgcgtaaaaccgtcacatcatcacaaatttggaaaatttcttttaaacgatgagagatataaacaatgccacgattttctgctttgagttcacgaatcacattgaatagggcttcggtctccgtatctgtgagcgcatcggttggttcatccataatgataactttggattcaaaacttaaggctttggctatctccaccatttgttgctcaccaatagaaagttcagcgcaaagctgtttactgctgtgagttacccccaaacgcgcaagtagcttgtctgcttcttggtgcattttctgccagttaatcgctccccacgaggttttaaattcacgaccaaggaaaatgttttctgcaatcgtgagattaccgaccaaattcagttcttggtgaataatactaatgccagcttcctgtgaggctttaggtccattgaaattaactgatcgattaagatactcaattgtgcctgcatctttagaataaataccagtaagcaccttcatcaaagtcgatttacccgccccattttcccccatcaatgccattacgcgtccagcgtaaacagataaacaggcattattcaaggctttcacacctggaaatgacttatcaacaccactaattttgagtaaagtttccataatttcaccctgattaaaatggcacgccagaatataaaatcacattggcataaggtgaacattcgccagtacgaacaatagctttactttcgagggtgaattttttaaaagtttcgtgcgatacaaattccacttgtatttgattaccctgatggctttcaagttgttgaagttgtgttaaaagtgcggtcaatatttctggatttttttctttaatttcttctgcaataacaacgcgttcaacatacatttcattcgttactacattcaacgtttgtagaaaacttggtacacccgcagttaatgcgagatcgatacgttccacacttaacggaattggaagtcccgcatcgcaaatcgtcaaactttctgtgtgaccaacagaagcgatacaacgagaaagttgtgcatttaataacattgtttttttcatatatttcctctttccacctttatcgaaacgtttcgataagataaatataaagaacaaaaatagaaaaacaactaagaaatttcaaatttgggatattgatcacaaaatttctagataggataaaaaattctccgaccaaatttacattcaatcggagaataaattattgaagattttcttgatttaagacattcaatctagccaaatccagctgattattcaataagtccacatcgggcattgttttattggcttttgcggaaagggttttaaatcgttctactttgccaactaaaccttgttggccaacaagtgcggtgacggtgctgttgtattggttgctgacagtggaaagcgtattgccgagtttacttaaacgttctgccaccaagcaaatttggttatagatttcgcccgctttttcagcaatttctttggcttcagcattaccacgttcgatacgccagaggtttgccacggtgcgtaaaatcggcattagcgtagtgtgagaaaccataattacattgcgttcataaccgtaattaaataaggcaggatcagcttttaaagcctcaatatacgcaggttccaccgcaataaacataagaacaaaattcggactacgcatgccaatcagattgctgtaatcttttttatgcagatcgttaatatgggtttttaatgcggaaatatgctctttgagtaaacgctctcgttcaaaatcatcctcagaattcaccgcactttcgtaagccacgagcgacattttgctgtcgataattaagtgtttttcatcaggtaaattcaacacaaaatcagggtaattacgcccgccttgttcatctttaaaatgagcttgagcacggtaatgtacattttcttcaagtcctgccagttgcaatgctcgttctaattgcacttcgccccagttgcctaacgttttcttttcgcctttcagcgcagaagttaaattactcgcctcttgcgacatattcagaccaatttccagcacttttttaatttccgcttccaatccagcattgcctttcacggattcggagtgaatttcattgacccgtttttggaaaccttcaatttgctcacggaaaggcttgagcaaggtttccaatgccgtttgatttgattgactaaatgatcgacttttttcatccaaaatacgatttgctaggttttgaaattccacactcaactgcagcttagattgttcaaagttctgttgttgtgcggaaaaatatttttctttctctgttaaggttgtttgtaaccccgttaattcttgagaaagtgcggtcaatttttcagtcaaattttgtcgttcttgtgtgagatgatgtatttgttcatcacgttcagttaaacgatattgcagtccttgattttcagtctgtactttaattgtttgttgttcaaactggtttttaatgctactcagttcatcaaatttactggcaagctgattataatcttgagtcgttttcgataattcttgatgaagatgtgtatatttttgctggcgtagaataagtaataaaatcaatataataacaacagctaacaagctgaaaagtaacaaattttctgacatatttctctcttaatggaaaacacaaattgtagcaaaaaatattattttaattctgctttaaagtgcggtaaattttttaactgatttagaatttatatccatacaaaatttaattattttagtcaattttgatggcaatgctttagaaaaacattgttgtattttaacggtatttatctaaaaacttgtaataccgcacaccaatctttgtcgcaagatctttgataattcgaccaccataaacagaagggactttcagtccttcaaaaatagataaacgttcatcgtcacccaaaatcgcctccgctacaattcgccccgcaagaccagtcaaagcaacaccgtgaccagaataaccatgagcaaaataaatatgcggagaaatacgaccaaaatgtggcgttgagtttaaggtcatatcaatcgggccagcccagccataatcgatttttacattttcaagttgcgggaatacacacaacatatttttccgcataatcgcgaccatatctttttctgagctagaatcactaccaaaaagcaagcgattgtcagcacttaaacgataatagtctaataataaattgttatcacacaccgacatgccattattaatgacagaatcagcaaccgcttggcttaacggctctgtggcgataataaaactttccacaggtaatattttacgattaatgccgtgatgaatagatttcgggagcgcatcaatataagcattggtggctaaaataacgtcttgagaaataaccgcacttttagctgttttaacctcaatgcaaccatttttctcaaccatatccacgacaggagattgttcaaaaatctgaacacccagatcgacacaagctttcgctaaacctaagcaataattaagtggatgcaaatgccctgaattactatcaaatagcccccccacataaatatcactgcctaagtgctgttttaatttagttttatcccaaagttgcatattctgatagccaaaatttttatgactttctttttccatttcaattaagtcatccattcggcgttcatttaatgctaatgtggcatagccttttttccagtcgcattgaatgctatatttttcaatacgttcatcaataatatcaatggtctctaatgacatattccaaagtttatgtgctttatcttcgccaacttgtttaacgtattcatcaatgccttcttcaaagccattaattgcctgcccaccactgcgaccagaagcaccaaagcctactcttgcaccctctaagacaatgactttttttcctttctccgccagttctaatgctgcagataaaccaaaaaatccagccccgatcacacatacatcagcatgttcaatttgagtgagcggcgggaattgaaaatcttggttacgagagtcgaaataataagagcgaacgtgttcttgataggcaaaattaagcataaaaaatcccttaggaaaaaactggcaaaatcttaccccgaaagggaaatatgtcaaaccttttagaaaaaatgctatactgcgcgcacgcaaaatttgcgtgttttatgatgaacgataaccctcggaggtcaataaattgaaaaaattctttgctcactcactcaaaaatcttttcctttccaccaccgcactttttgcggcttccgcttttgccaataacaaactttacgtctataactggacagactatgtgccttctgatttagtcgcacagttctctaaagaaactggcatcgaggtaatttattctacctttgaaagtaacgaagaaatgtatgcgaaacttaaacttactcagaatactggttctagctatgatttggtgtttccatcaagttactacataaataaaatgattaaggaaaagatgcttcaaccgattgatcaaagtaaattgaccaatattcatcaaatccctaaacatttattaaataaagaattcgacccagaaaataaatattcattaccttacgtttacggcttaactggtattgaagttaatgcggatgagattgatcctaaaaccatcactagctgggcggatttatggaaacctgaatttaaaggcaaagttctcatgaccagtgatgcgcgtgaagtgttccacgtagcattattactggatggtaaatcgccaaataccaccaatgaagaagacatcaaaacagcttatgagcgtttagaaaaactgttaccaaatgtagcgacttttaactctgattctcctgaagtcccttacgtacaaggcgaagttgcaattggtatgatttggaatggttcagcttatttagcgcagaaagaaaatcaatctcttcaatttgtgtatccaaaagaaggcgcaattttctggatggataattatgctattccgaattccgctcaaaacgtggaaggggcgtataagttcatcgactttttacttcgccctgaaaatgcaaaaattgttatcgaacgcatgggcttttctatgccaaataatggggcgaaaacattgctaagcgcggaagttgctaatgatccaaaattatttccaccagcggaagaagtagaaaaaggaattatgcaaggcgatgtaggagaagctgttgatatttatgaaaaatattggagtaaattaaaaactaattagtttctcaatttagaaaacaaaaaagtgcggtaaaaatttaccgcacttttatatgtaaaatttttatctttaaagaataaaacggctcaaatcttcattttcaaccacttcgccaagtgcatccgcaacataagccgcatcaatattgaccgtttgaccattcatatcgcttgcgctgaaagaaattttatccatcaaacgttccattaccgtatgtaaacgacgtgcaccgatattttccgttttttcattcactcggaatgcagcctcagcaattttcttaaccgcctctgttgtaaattcaatattcaccccttctgttgccatcaaggctttatattgttcggttaaagaggcgtgaggttctgttaaaatgcgctcgaaatccgccgcacttaatgcggtaagttcaacacgaatcggcaaacgcccttgtagttcagggattaaatctgaaggacgagcaacttggaatgcaccagatgcaataaataagatatgatcagttttaaccattccgtgcttggtgctaactgtcgagccttccactaacggaagtaaatcacgttgcacaccttcacgcgatacatcagcaccactgtattcacctttcttacaaattttgtcgatttcatcgataaagacgataccattttgttccacagcatcaatggctttttgtttaagttcttcagggttaattaatttcgctgcttcatcatcaatcaacgttttcaacgcatctttaattttcattttgcgttttttcgttttgtctgaacccaaattttggaacaatgattgcagttgatttgtcatttcttccatgcctggaggagccataatttcaacccccatagacacgccagcagacacatcaatttcgatttctttatcatctaattgaccttcacgtaattttttacggaacgcttggcgagtactgctgtgactatcatggttttcaacttcgccccactgattttttgctggaggaagtaaagcatccaaaatacgctcttcagccgcgtcttcagctcttgctctgttcttcgcaatttcttgttggcgaacaagtttcatcgcactatccgttaaatcacgaataatggaatccacctctttccccacgtaacccacttcggtaaatttcgttgcttccactttgataaatggcgcattagctaattttgctaaacggcgcgcaatttcagttttacccacaccagttgggccaatcatcaggatattttttggggttacttcgtgacgcagaggttcttgaagctgcatacgacgccaacggttacgcaacgcaatcgccacagcacgttttgcatcggcttgaccaataatatgttgatctaattcagaaactatttcgcgaggagtcatttcagacatagctttttccttaattcggtaattcttcaatagtgaaattggtatttgtgaacacgcaaacatcacccgcaattttcaaagatttttcaacaatttcacgagcagaaagttcggtgttttccaccaacgcacgtgctgcagacaacgcatagttaccacccgatccgattgctaaaatttgatcttcttcgggctgaaccacatcgccaatacccgtgatgattaaactttctttttcatccgccacaattaacatcgcttctaacttacgaagtgcacgatctgtacgccaatctttcgctaattccaccgcactttttagcaaatgcccttgatgcatttcaagtttacgttcaaataattcaaaaagtgtaaatgcatctgccgttccacccgcaaaaccagcaagtaccttaccattatataaacggcgtactttacgagcattacctttcattacggtattgcctaaagaaacttgtccatcaccgcctacgacgacttgcccattgcgacgtacgcttacaatcgttgtcattgttctgtcctttataaagtgaaaagttgttcgttatatggcgacaaattgattaaattcaagagggaaatttatattgtagatttattcttcactcataaataaaaaatgtgaagttgatcatattttgagatggcaaacgattgccaattattgaatataagctaaaaaaatgtatgatctgagcggtttttaaatcaacgtttgtgaggaaaggcaatgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcaaactctacttatcaaccaatgccaactttaggcggctatggcgaagaagtgttaatcaattcaagctattaattgaccgcaagttgggatttatcttcccccaaaaagttagattgatttagttcaaggactgagttctgtcattcacagggctcagcccttttagtttccctgaatgtgatcatggttgtaataatgaatatactcatgagttgttttttcagttgtttgaacgtctcaaatcgtttgtcgtaataacattcagtttttaatcgtccaaagaagttttccatcgcattgttatctaaataatttcctttccttgacatattctgctgaatgctattctctcgtaaaatcgcctgataaccgaccatttgatacagccaaccttggtcggaatgtaaaattgggttttgcgtcttcaagtcttttttgttggttgagttcttgcaacttttttagaattgcgttctccgcacgtagtaaattttccaattctagttcttcccctcatgttttcggtttaggtggcatcttagggtatttcggtttcatgattggacgacttttaggtttgaggattaagccgtttataccttgtttttcaaaggcttgcagccattgattaacaacgcctgaattggtaatgccaaaatgtaaatatgcggcttctgcagaaaattgcccatttttaaccgcttgtattatgttaagtttaaattcaggtaagtaattttgcttcttactaagtacggataatctattgatttaactatgattaattggttaatccaacgttttagtgttatttaggcaagttgaaaatacctgcgggtaagtgaacgatttttaccattttgaagatcaaattcgatgacttgttgtttgaaaagagtgttgtatttggtcataaaaaatctacaccttagttggttatttagtcaatttttggggtgtagatcataaaatgcgttttttactactaacttttttaggttaatcaagcgtcttcctattttaataaggaattatcgagtgacaaatcttcatttttatttacacctataccgcgtgcgataacatttttggcaatttcgtgtgcatcttctaaggaatgttccgtatagcttccgcattgatagatatttaattcgggaatagaagcttgatcttgtacacctaaaacatcttgcattgaagctaaccaagcctcagacacttcctgttcatttggtgtgccaatcaaagacatataaaatcccgtgcgacatcccatcggagaaatatcaataatttctatgctatcgccatttaaatgatcgcgcataaatccagcaaataaatgttcaagtgtatgaatgccttttggggaaagaatttctttgtttggaatacaaaaacgtaaatcaaaaacagtaatattatcgccttttggcgtgcacatcgtttttgcaatgcgtactgcaggtgcgttcatttttgtgtgatccactttaaaactatcaagtaatggcataaattttccttataaatcagttggttaagaaataattgaataaatatttattttttacaaattttaatgaactttatagtaaggttcattgtcttatagaacaagcaacttgcagttgttttaataaaattggttccttaggttatttgccccacatttattgtggggttttttcttgctcattttataataagaatggtgtactcaaaaacaataacgcaacataacgaaccatttttcccagaaagataaagagactactcgttacaaaatttaatcttaaccaaccagctatggcacaaaataaatcgccaactacaggcagccagctcaaaagtaaaacaatcgccccataacgccgtagctgatttattgcccataaagtgcggtaatttttgggatcgaattttggcatccatcgtccaattccgtaagtggttaaacttcctaagctatttccagcggttgcaatcaatattagagctaatatatctgcgttaaataaagaacctaacattaatttaggtacagcaagcgcaacaaatataacttctgaattacctggtaatactgttgcactcaaaaacgcgctgataaacataaagcataagctattagcctgccaaaaatcagcactaaaaaatgaaaaaatatccattatcttggcgaaataatttctcgtgtgcgaacatcaaacacatccattcccgcacttaatcctgcttgcacgcctaaatccgcatcttcaaatacgatacaacgacttggatttgcttgaattaactccgcacagcgtaaaaaagtttctggatgtggtttatgttcttttacatcatctgcactgacaatggcattaaagtaaggtgcgatagccagtttatccatcaacatatcaataattttacggtgtgagccagaacctaaagcaatcggctttttctgatggaaggatttaacaatttcaaaggttggcaataactttgattgggtcggaataagttgataagacaactcacgttttgcagccagcacatcctcaattcgatctagtggcatattcgccgctttcatcatttcccccgcgatagttcgaaccgtcgccccgccgaagttatacataatttgaaaatcaaattcatagccaaatttctttcccaccattgtccaagcctgcgcatgcacgggcattgtatcaattaaagttccatccatatcaaaaatcaatccttcatatggattgaagatctcgtaatctaacatttttacatccttacaaatttttttaccattttgctacaaaactgtgatctatgcactgttttatttcagtaaagtgcggtaaattagcgaacaaattttgaactaacaaaaacaaatgcggttatttaagcaactagaacgttggaaaactcgcaggcaaataaatcaatctattattgatgtggtatttcgtttacgagatcgattagctcattactggcaagctgatgtgaatacgcctcaagtggattttatgctgctacacattgcttgcagcttaggtcggatagaacgaggaggttgtgtttcttcgctttattcagaaatgctcgaagaaatgcaaagtgcggtcatttttccacaagttttagctattcatcaagatttactcaagttaatgccattttccattcctgaagcagaacaaacttattttttagcgaacattcattctttggttcttgaacagaagcaattaaagcctttgaaatgaattatgcggaggtgcattcaatttatggtgtaaaactggacattgattcggtaaataattcatcaaattactaaaaacattaaggaaatttaccgcacttttaagtaaaatagcgtaatttttcaaagagataataaatatgaaagccaaattagtcagtttacttgcgcaagcaaatataaaaataagtgatcaacaaattcagcagttgattaatctggtcaatttactcaataaatggaataaagcttataatttgacgtcagttcgtgatccgcaagaaatgttagttaaacatattttagatagtcttgttgtaagtccttatttacaaggtgatcgttttattgatgtcggtacagggcctggtttgcctggtttacctttggcaattattaatccttccaaacaatttgtcctccttgatagcttaggtaagcgtattagttttattcgaaatgctatacgtgagcttagactaactaatgtaacccccgttttaagtcgagtagaagaatatcaacctgaagataaatttgatggtgtattaagccgtgcttttgcttcactaaaagatatgacagattggtgccatcatttaccaaaagaaaatggatatttttatgcattaaaagggatttatcaggaagatgaaattaatgaattgaataaaaaatatactattcaaaaagtgattgaattatctgttcctgaacttataggcgaacgacatttaatcgttttacgttaaaaagtaacaaatagataaattattttctaaaagtgtgatttatataacactttttatgtgtttttaagttgaatctaaagccagcaaaggtataatcggcgggctaaaattattttgtaaaagtgatgtcgcgcattttatctcacgctaaaaaaaactacagaaaagctattattattgagagtcttttgcttgtagttttttatttgcttatttatggatggcaacgccaaagtgcggtagattttagctacggttttttaagtgcctttttgcctttttgtacatttatatttatcattttttacagaaaacaaaatttttcaacaaaactgaccgcactttatcgtgctgaagcaataaagtttattttaacgatggtttttatcattattgccatcaaatggttattcgttatcaattttattgcgttttttgttggttttttattggcattagtgctgaataatattattccacttattctcaataaaatttaactttgggttattcttcttcagaacaaaggatcgattatgtctggacaaacaacatcggaatacattagccaccatttatcctttctcaaaacaggggatggattttggaatgttcatatagatacgttgttcttttctattcttgctgcggttattttcctatttgttttttctcgagtagggaaaaaagcaacaactggcgttccaggaaaaatgcaatgcttagttgaaattgttgtggaatgggttaatggaatcgtgaaagaaaattttcatggtccacgtaacgtagttgcgccacttgcattaacaattttctgttgggtattcatcatgaatgctatcgacttaattcctgttgatttcttacctcaatttgcaggtttgttcggtattcattatcttcgtgcagtgccgacagcagatattagcgcaactttgggtatgtccatttgtgttttctttttaattcttttttatacaataaaatctaaaggattcaaaggtttagttaaagaatatacgcttcatccattcaatcattgggcgtttattcctgttaattttattcttgaaacggtgactttattggctaaaccaatttcacttgctttccgtttgttcggtaacatgtatgcaggggagttgatctttattcttatcgctgtaatgtattccgctaatatggccattgcagcattagggattccgttacatcttgcttgggctattttccatattttggttattaccttgcaggctttcatctttatgatgttgacggttgtttatttaagtattgcttataacaaagcagatcattaatcgttttttattaaccagctctagggctaaaacttaacttctattggagaaaattatggaaactgtaattacagcgacaatcatcggtgcatcaattcttcttgcatttgctgcattaggtactgcaattggctttgctattctaggtggtaaattcttagaatcatcagctcgccaaccagaattagcatctagcttacaaactaaaatgtttatcgtagctggtcttttagatgcgattgcaatgattgctgttggtatttcattacttttcattttcgcaaacccattcatcggtttattaaactaatcaccttatttgcttatcaacgtaaaacaagcatagtaaggaggacgttgtgaatttaaatgcaacattgattggtcaacttatagcattcgcactttttgtgtggttttgcatgaagtttgtttggccaccaattattaatgcgattgaaacacgtcaaagccaaattgcgaacgctttagcgtcagctgaagcagctaaaaaagagcaagcagatacgaaaaatcttgttgaacaagaactttcagctgcaaaattacaagctcaagacattttagatgctgcgaataaacgtcgcaatgaagtattagacgaagtgaaggcagaagccgaagaactaaaagcaaaaattattgcacaaggttatgctgaagtagaagcagaacgtaaacgtgttcaagaagaattacgtcttaaagtagcttcattggcagtagctggtgctgagaaaattgtgggtcgttctattgatgaagcggcaaacaatgacattattgataaattagttgcagagttataagaggcttagcttatgtcagaattaactacaatagctcgcccttatgcaaaagctgcattcgactttgccattgaacaaagtgcggtcgaaaaatggactgaaatgttaggttttgctgctgccgtagctgaagatgaaacggtaaaagcttacttaagtagttctctttctgcacagaaattagctgatacagtaatttctatttgtggcgaacaattggatcaatatgggcaaaatcttattcggttaatggctgaaaataagcgtttgagtgctattcctgcggtgtttgaagaatttaaacatcacgtagaggaacaccaagctattgcagaagttgaagtaacatctgcgcaaccattgaatgcaacacaaatcgaaaaaattgcagctgcaatggaaaaaagattagctcgcaaagtgaaattaaattgcaacgtggataacgcacttattgctggtgtgattgttcgtactgaagactttgtgattgacggaagtagccgtgggcaacttactcgtctcgcaaacgagttgcaattataagaggaatacaagatgcaactaaattcaactgaaattagtgaattgattaaaaaacgcatcgctcaattcgacgtggtcagtgaagcgcgtaatacagggacaattgtttctgtaagcgatggtattattcgcatccacggtttaagcgatgtgatgcaaggtgaaatgatcgccttaccaggtaatcgttatgcgatggcacttaaccttgaacgcgattctgttggtgctgtagttatgggaccttacgcagatttagcggaaggtatggaagttcaatgtacaggtcgtattcttgaagtaccagttggtagtggtttattaggtcgtgtagttaatacgcttggtcagccaatcgatggtaaaggcgaaattgaaaatgatgatttctcaccagtagaagtgattgcgccaggtgttatcgatcgtcgttctgttgatcaacctgttcaaactggttataaagctgtcgattccatggtaccgattggtcgtggtcagcgtgagttaatcatcggtgaccgtcaaacgggtaaaactgcgttagcaattgacgctattattaatcaacgtaattcaggtattaaatgtatctatgttgcgattggtcaaaaagcctctactattgcaaacgtcgtgcgtaaattagaagaacatggtgcgcttgcaaatactatcgtggtagctgcatctgcatctgaatcagcagcgttacaatatttagccccttatgctggttgtgcgatgggggaatatttccgtgatcgcggcgaagatgcgttaattgtttatgatgatttatcaaaacaagccgtagcttatcgtcaaatttcattattattacgtcgtccaccaggtcgtgaagcctatccaggtgatgtgttctatttacattctcgtttactagaacgtgcttctcgtgtaaatgaagattatgtagaaaaattcactaaaggcgaagtaaaagggaaaacaggttctttaaccgcacttccgattattgaaacccaagctggtgacgtatctgcgtttgttccaaccaacgtaatttctattaccgatggtcagattttcttagaatctaacttgtttaactcaggtattcgtcctgcggtaaacccaggtatttcggtatctcgtgttggtggttcagcgcaaactaaagttattaagaaattagcgggtggtattcgtactgcactagctcaatatcgtgaattagcagcgtttgcacagtttgcatcagatctagatgatgcgactcgtaagcaactttctcacggtgaaaaagtaactgaattattaaaacaaaaacaattcgcgccattatctgttgcagaacaagcggttatattgtttgctgttgaatttggttatttggatgacgtggaattatcaaaaattgcaagttttgagaccgcacttttagattattctaaccgtaatcacgctgaatttatgcaagagcttaataaaaccggtaactataatgatgaaatcaaagatacgttaaaaagtattttagatggttttaaagcgaatagtgcttggtagtaacggagagataagatggcaggtgcaaaagagataaaaaccaaaattgccagtgtacaaagtacacaaaaaatcactaaggcaatggaaatggtggcaacctcgaaaatgcgtaaaacgcaggatcgtatggctgcatctcgtccgtattctgaaactatccgtaacgttattagtcatgtgtctaaggcaagtatcggttataaacatccgttcttagttgagtgcgaagtgaagaaaatcggtatcttggttatttcaacagatcgtgggatgtgtggtgggttaaatgttaatttattcaaaaccacacttaaccaaataaaaaattggaaagaacaaaatatttctacagatttgggcttaataggttcaaaagggattagttttttccgttcctttggatttaatatcaaaggtcagctttctggtttaggcgatacgcccgctctagaagagttaattggtgtggcaaatacaatgtttgatgcttatcgtaatggtgaaattgatgcagtttatattgcatacaataaatttgttaatacgatgtcgcaaaaacctgttgtgcaacagttagttcctttaccagaatctaaagacgatcatttaaatgaaagacaacagacttgggattatctttatgagccagaaccaaaggcacttttagatagccttttagttcgttatttagagtcccaaatttatcaagcggttgtagataatttagcttcagaacaagcggctcgaatggtagcaatgaaagcagcaacggataatgcaggtaatttaattaatgatctgcggttggtgtacaacaaagctcgtcaagcaagtatcacaaatgaattgaatgaaatcgtagccggtgcggcggcgatttaagaaaagaggaacggtaatgtcagcaggaaaaattgtacaaatcatcggtgcggtgattgatgttgaatttccacaagatgcggtgccaaaagtttacgatgcattaaaagttgaatcaggtttaacacttgaggtgcaacaacaattaggtggcggagtagttcgttgtattgcattgggtacatctgatggtttaaaacgtggcttaaaagtagaaaacacaaataacccaattcaagtaccagtaggcacaaaaacacttggtcgtattatgaatgtgttgggcgaaccaattgacgaacaaggagcaattggtgaagaagagcgttgggctatccaccgttcggcaccgagctatgaagaacaatcaaacagtacggaattattagaaactggtatcaaagtgatcgacttaatttgtccattcgcaaaaggtggtaaagttggtttattcggcggtgcaggtgtaggtaaaaccgtaaatatgatggagttgattcgtaatattgcgattgagcattcaggttactctgtatttgcgggtgtaggcgaacgtactcgtgaaggtaatgacttctatcatgaaatgaaagattctaacgtattagataaagtatctttggtttatggtcaaatgaacgagccaccaggtaaccgtttacgtgttgcattgactggtttaactatggctgaaaaattccgtgatgaaggtcgagatgtattattctttgtggataatatctatcgttatacccttgctggtacggaagtatctgcgttattaggtcgtatgccatccgcggtaggttaccaaccgacattggcagaagaaatgggtgtgttacaagaacgtatcacttcaaccaaaacaggttctatcacttctgtgcaagcggtgtacgtaccagcggatgacttaactgacccatctccagcaacaactttcgcacatttagactcaactgttgtattaagtcgtcaaatcgcatctttaggtatttaccctgcagttgatccattagattcaacttcacgtcagttagacccgcttgttgttggtcaagaacattatgatgttgctcgtggtgtacaaggtattttacaacgttataaagaattgaaagatattatcgcaattcttggtatggatgaattatctgaagaagataaactagtggtagcacgtgcacgtaaaattgaacgtttcttatcacaaccattctttgttgcagaagtcttcacaggttcaccaggtaaatacgtgacattaaaagacaccatccgtggcttcaaaggtatcttagatggcgaatatgaccatattcctgaacaagcgttctatatggttggttcaatcgatgaagtgttagaaaaagccaaaaatatgtaatcacttcaagtcatttgaaggagaacaaaatggcgacatttaatttaacaatagtaagcgcagagcagaaaatctttgaaggtgaagtaaaacaaattcaggtaactggtgtggaaggggagcttggtattttgcccggacatacgccattgctaacagcaattaagcctgggattgttaaatttactcttaaagatgggaatgaagaagttatctatgtttctggtggttttttagaagttcaaccaaatattgtgacagtattagcagatattgctattcgaggtagtgaattagatgcagatcgtattcacgaagcaaaacgtaaagcagaagaaaatatagtatctcgcggatctgatgcagatcacgacttacttgttgcaaaactttctaaagagttagcaaaacttcgagcttatgaactcactgaaaaactattgaaaacaagacgataattgaaagtataatatagatgaagtgaacttcatttagtttaagggctaagttctataattttagaacttagcctttttgttgtatgagattaatgataagttttgtctgaaatttttatctaaattaattaggataatatttactcttttttagataaaaagtgcggtaaatttttagtttgtttttaacctacaacaaagggtaaataacccgcacgaatcgcaaatggaatggatgtaatgatcacgcctaataccaatacgataattaaagtcagatttcctccccacactttgtatggcaaattagcgtgggcacgacgagctttccaaacaaggctaactggcaatactacggcgtagaatgcaaacatttgacctgcgtagcctagtgctaaaataaaaccttctgggtaaaataatgcaaaaacaagtggtggaataaaagtcagtaaaccaagtgaaattctgcctgctgtaacgttaaatgaacgttttagtaaatcttcaatacattctaacaatcctaatcccacacctaagaaagaagtgataagtgctaatgtagaaaataattttaccgcacttgcgatcacattgcttccagtgatggcgaaggttgcttttactaagccatttaaagtcgcatcttcttttaagatttgtaaaaattcattttgtgtaagcaagccgtgcgtggatagttgccatagaatataagcacaaagtgttatggcagagccgaccaaaatagagaagcgcaatgcttttacattgccatctaagtatttatttaaacttggaatggaaccgtggaaaccaaacgccgtgaaaaatacagggcttgcagagataattaaagccttatcaattggcgtcgccattaagttatcaaatttgatttctggcaacattaagcttaacaccacggcaaaggcagcaagcataacgaaaaataacacgcgattaattttatctacgctatgtgtgccgatgacaataaatgaaccgaaaatcacggtaaataataagacgctaactttatcgccaaaactttctggtaataaatcttttagtagtgaaccgccaccgctgatataagcggcaattaatgcgtataagaaaataattagcacggctgtggcaataatgcgtcctgttttaccaaaatattgttctgcaagtgtgccgatacctgcatcactttccgcagtttgatagagttcaacgaataaaagtgcgctaaaagttaataatgcccaaagccccaataacaagactaaagtaaagccgaagccaatgccagcggaagtgagtggcatagccaacattcccgcgccaatcatcgtaccagcaacaagaagtgtgctgcctacagttttgttcatttttgtttccttatgatgtaataaaaaatttacgataattgtattgtataatttacagtctgtaaataaaatttataaattgtgaattttttactatcttccttgctatattgttgcttaagaagaaggaataaaatgatatttcctaaattttgttgtttatcaatacatttaattaccatagtttcactgtattttacgatgatattgaattgcccaaacaaatcttctaattgctcacttaatattgcctgacaattttcttatttatttcctccttctggatgtaatccaatcccttgatggcgttcttgtagttttgcgataatttcgtaccactgaagatcttgattgtgtaataatacggttaagtgatagaccaaatctgtagcttcagaaatgacttccgctttatcttgtgcgaccgcagccaaggcagtttccacaccttcttcccccactttttgggcgatttttttggtaccttttgcgtgtaatgttgcagtataagaattagaaggatctgcatttttcttttcttttaaatgttgttctaattttataaaccacgcccaatttgcaaattgttgcttcttgttctctgattgtggagaggtaaattgatggaagcagctgtattcacctgtgtggcaagttgccccaatgggatcaactaaaatgagcaaagtgtcgttatcgcaatctaagctcatttcttccacatttaaaaaattgcccgagatttctccttttgtccataatcgttgtttggtacgagagaagaaagttactttacgttctttgatggtttttgtaagggcttcttcattcatatagccaagcattagtacctcacgagtacttatattttgaataataacaggaagaagaccattaactttttgccagtctattttagtaatattcattattcactccgaatctcgatggctgattgcacaaggtaggattttaactcgccaatttcaataatctgtttatggaatacgctggcagctaatgccccatctacttttgcttcaataaaagcatcacgaaaatgtaccattttacccgcaccgccagatgcaattagaggtactctacatactcctcgcaccagcttgagctgggctaaatcgtacccgtttcgtaaaccatcttgattcatcatatttagcacgatttctcctgcaccgcattgttgtacttcttttacccaatctaacaactgccaatgagtttgtcgggtacgtgtttcatcgcctgtatattggtttacccaatacttacctgtttcctgttcaaaccaactatcaatacctactacaatcgcttgtacgccaaaacgatctgctaagcgagaaatgagcgttggatcagcgagagcaggggaattaatcgaaattttatccgccccaaatgcaaacaatttttccgcatcttcaatggttttaatcccacctgctacgcaaaacggaatatcaattacctgagcgattcgttctacccaacttttatccacggtacgaccgtctgatgaagccgtaatatcataaaataccaattcatcagctccttcttgcgcatagcgttgagcaagtggcacaatatcgccaataatttcgtggttacggaattgtaccccttttaccacctgtccatcacgtacatccaaacaaggaattatccgttttgccaacatttgattgcctccgaaagcgtaaattttccttctaataaagcgcgacctacaattacacctgacacacctgtgccttttagagcctcaatatcagccagtgaaccaatccctccagaagattgaaactgaataggtggatatttctcacaaatttcttgataaagtccaatatttgaacctgtcaaggtgccatcgcgtgaaatatcggtacataaaacttgttgtaagccaacggtttggaaatcttcgatcaacgtttctaatagtacaccactttcttcctgccaaccgctaatcgcaacgattttctgaccgcttgcattaatattcacgtctaatgctagaacaaatttttccgcaccatatttgatgaaccagtttttcaccattgaacgatgagttacggcggttgaaccaatcaccacgcgattcgcacccacagccaataaatctgccacatcttgctctgtacgaatgcctcctcccacttgtactttacattgtgttgcttcaacgatttttccaataagtgcggtttgtcttgactggggatttttcgctcccgttaaatcgactagatgtagttgttttgctccttgacgtacataattatcaaattgcttaattggattgtcagaataggtagtttgcttggcataatcgccttggtgtaaccgcacaacttgaccattgataagatcaagagcagggataataatagattgtttcattgtgtttgatcctgtatgactatatgatctagtgattaaaacggtactttttccacaaaattttttagcaacaacgcaccatttttacccgaacgttcgggatgaaattgtacaccgtaaaaattctctttcgctatcgcagcagaaaaattcacaccataattgcttattgccaccgaatgttcattcgggctaactgcataactatgcacaaaatagaagtgactattttgcacaataccatcaaataacggacagttttttacaaattgcacgcgattccatcccatttgaggtaacggtaaacccgtatcgggaattcgattagtttttccgcttattaggtttaaggtcggcacattaccctcttcggaaaattcggtcattaactgcatacccaaacaaattcctagcactggttgagttagattttgaatggtttcgatcaattgacgttcttgtaaattatacattgctgcatttgcagtgcctacgccaggtaaaatcagcttatcggcagatttgattttattgagatcaaaagtgatctcggtattgtaacctaatcggtcaaaggcgaattttacagaagaaaggttggcacaacctgtgtctataatcgtgatgtttgtcatttttttatccttttacaatcggtcgaattttgcaaaaatacgacaaaaattaaccgctctttcaactataaaactccttttgaacttggcatttcatttccttcaatccgaatcgcctgtcttaatgttctcccaaaggctttaaataagctctctattttatgatgatcgttattacccgtgacatttaaatgaatcgtggcaagcattgaaaatgccaaagattgaaagaaatgttcagtgagttccgtactaaaatcgcccactttatcgcgtttaaagcaggcattgaatttgatccaaggtctgcccgataaatctaaagcacattctgctttacattcgtccattggaagcacaaagccgaaacgggcaataccacgtttgtcaccaatggcttgtttcagtgcttgtccaagggcgagagcggtgtcctccaccgtgtgatgttcgtcaatccataaatcgcctttacactgcacgttcattctaaacccaccgtgtgtggcgatttgatcgagcatatggtcaaaaaaaccaacgccagttttgatttcatttacaccagcttcatctagccaaatctgcactttaatatcggtctctttagtttgacgaattacttctgcaaaacgtggcggacgtttgccacagtttgtgaccgtttcccccaacaatttttctgcaatcagatcccaattcattttctgtggatcgtattgaatagctcgaatacctagattttctgctaattgcacatcggtctctcggtcaccaatgacaaaagagcggtcaatatcgaataaatttttacgaatatagtgatcaagcaacttaatttttggtttgcgacatagacaattttcttcgggcttatgcgggcaaatgagtacttcatcaaaggtaatgccctgagattcaaataatgccatcattacattgtggggcttatcaaaatttgtttgcggaaaagcatccgtaccaagcccatcttgattagaaactatcacaaaacggtatttcgctttcagtctgaggagtgcgggaatcactttcggttctaattttagtttctctaaactgtcaatttggaaatcagtttttggttcatcaattaatgtgccgtctcggtcgataaaaagagtaggttgcatatttttctccgtgtatgttatatgaatggtatgaggtttatcatttgctttatacaaacagtataaaactaaataatctcgaatcgctctgtgacttaaataggaggtggttcattttacctccttaattgcttcaacaactttctcacactcattccttgttcccacagtaatgcgaatacaattttgtaaatgcaatgtcttattctggtctcttaaaataattccttgttcccacaatgccttaaacacagcttgcccgttttgacatttgatcaacagataattagcttcactttcatacactttttccacttgatgtaaaactaaaagagctttagcaagccattgacgattggaaagaagttcttgtgtgagagcttgaacagtggcgatgttcgcaggtcttaacgcttgttccgcaagatcagcactcggcacagggataggatatggagcgattaccttacttaagatgtcaattagctcagggtttgctaacacaaaaccacaacgcaatccagctaaagcaaaggctttagagagcgtgcggataattgctaagtgcgggtaatttttaagcaaattaataacgcttgcttcaggacagaactcaatataggcttcgtccaccaccacaatcgctttgcctgccgtgatttgcaaaagatcgagtatatctgattgcttgagcaaattacctgtcggattatttgggctgcatacaaagactacttttacatcattaagatgatttttgatttctggcaaattaagctgaaaatcgtcagttaaaggcacgctcttacttagcacacctgccgtttcagcactcactgcatacattccgtaagtcggaggacagaataaaatggcatcttgtttgggttcgcaaaaagtgtggattatcaattcaatgccttcatcaccgccacgagtaacgagtacattttcagttgaaacgcccgcataattcgcataagcctgtaccactctttgaggctgaggttcggggtagcggtttaaatccttacccgaaagctgaaattcaggcgaggttggatattcatttgcattcagccaaatcgtaccattgccgccgagttttcgagcggattgatatggcgttaaggcttgtatattttgtcgggataaagttgtgattgtcattattgttttcttccattgtaaaatgtgcgaattgtaatcattcatacatatttcgtattgttgtatgaaaatttgactgcttacgtgtcgtgcttagatctacaattaatatcttagatattgagtttcgccaatcttacacttactgccattttatgtgctgccaattgctcagcttctgccatcacttccaccgtttcagcaaggtttttaaaaccttttggtgtgagttcttgtactgtcattcgcttactaaaatcagctaatcctagactagaataagttttggtgtaaccataagtaggcaaaacgtggtttgtgccactggcataatcgcccatactttcaggcgaatatgcacctaagaaaattgagcctgcgttatctaaatatggtaataatttacgggcgttttttgtttgcacaattaaatgttcaggggcatattcattgctaatttctaccgcttgttcaaggctttctgctataaaaatacggctgtggtttaacgcttttcgagcggtttcagcacgaggtaatagagcaagttggcgttcaatcgcaagtgcggtctcttttgccagagtttcacaggtcgccaccaaaatcacttggctatctgccccatgttccgcttgagagagtaaatcgcttgccacaaattcaggatctgccgattcatctgcaattactaacacttctgaaggtcccgctggcatatcaatcgccgtactattttgtgctacctgacgttttgcttctgtcacaaatgcgtttccaggtccgaaaattttatctactttcgccacactttccgtgccttgagccatcgcaaaaactgcttgagcaccacctatagcgtagatagtttccacaccgcaaagatgagcagtgtagagaatttcatctgagatcggtggcggtgaacaaagcacgatttttttacaacctgcaattttagcaggaatagctaacatcaatacggtggaaaacagcggtgctgaaccacccggaatataaagccctacacaagaaattggacgagtcacaacttggcaacgcacgccttcttggatctctaggtcaatttcctgattttgctgtgctttgtgaaaggcttcaatgttcgttttggcttgctcaatcgcattgcgaagttttacagaaatccgactgcttgccgcttgaatttcatctgccgaaacaatgagtttatctaacttcacgccatcaaatttttcacagagttcaaataacgcccgatcgccattgtatgccacattttcacgaatggcattaactgcctgctgaatgttttccccattttgttggactggacgcataatgactttgcgtttttcagtttctgataaatgattccaaataattgtttgcattgtttattttcctttgtatccgtaaaatggatgataacccaccattttgagatattgattatttaaatggcgagtcaaagctcgcactacatttactccatcatcttctcaattggtaacactaaaattgaactagctcctgcctcttttaactgttccattgtttcccaaaataaattttcttggctcactacgtgcattgctacccgagttgtatcactggctaatggtaaaatggtcggattttcaacgccaggtaaaagcgcagtgattttttcaagtttttctttcggagcgtggagcataatatatttactttctgctgcctgctgtacaccttgaatacgagtgagtagtttatccacaagagcttgtttagttgattcaagcggttcagcacgctgaattaaacaagctttagaacgataaatcacgtccacttcttttaagccatttgcttcaagcgttgcccctgatgatactaaatcgcaaatcgcataagcaatacccgcactaggtgcgacttctactgaaccatttaataaacaacttttaaacgacaccccattctcattcatataacgtttgagcaaatgcgggtaagaagttgcaatacgcctattagcaagatctttcacattctcataatgacaatcgcgatcaaccgcaagtgatagacgacaatcaccaaaatcaagttggcgaagttttttgtatgtaactgtttcatttgctgcacggcgaccaagctcttcctcttctaacacattttcgccaataatcccaagatccactacgccatcaaaaatcaatccaggaatatcatcatcacgtacgcgaagaatttcaatcggcaaattttccgcataagcgattaaacgttgttcattccaattaattttcacgccacattgtttaagtaatatggcacaatcctggcttaaacgcccttttttttgcaaagcaatacgaaggcggtttggttgcattgttgtgtttgtcataatgtttttcctattttaaagttgagataaaagaaaacccctcgaaaattgccttccgagggggtatttattgcttttacactgatttttattacactcggaagatattttattatcttccaaacatacaatcacgcctgaaagataatcaggtgtggtgatgatggtaagtgcagataaaattcatattgtatatgctcgctcaaatgttattagattttatattgccttaaaaatacactttaaaattaaaaaaagcaatttttttgaaaaaaattgtgtttttagtacatttttactatcgttaaaatttatcaaaaatgtttacttaagaggtataattttctagatttttattgtgttaattttcttttccctttctgtgttcatctcgttacaatacttagcgaatcaactaagacaaagctaagacaaaataggagagcttatgatttacagtatgaccgcttttgcacgccttgaagtgaaaaaagattggggcgatgcggtatgggaaattcgttccgtcaatcaacgttatttagaaaactttttccgtttacccgagcaatttcgcggattagaaaacacgttgcgtgagaaacttcgtcaaagtcttactcgcgggaaaattgaatgttctttgcgtattgaaacaaaaaaacaaacaaatgctgaattgaatttaaataaagaacttgcgaatcaagtcattcaatctttgcaatggattaaaactcaagctggagaaggtgaaattaatttgacagacgtgttgcgttatccgggggtggtggaagcgcaagagcaagatttagatgcgattagtcaagatttattgacagcctttgatgatttactgaccgattttattgcaatgcgtggtcgtgaaggggaaaaactgaacgatattattcaacaacgcttagatgccattgcagtagaagcggataaagtgcgatcacaaatgccagcagttttacaatggcagcgtgaacggttattgcaacgttttgaagatgctcaacttaatcttgatccacagcgtgtggaacaagaaatgattttactcgctcaacgtgttgatgtggcggaagaactcgatcgtttacaaatgcacgtgaaagaaaccacgaatattttgaaaaaaggcggtgcagttggtcgtaaattagattttatgatgcaagaattgaatcgtgaatccaatacccttgcgtctaaatccattaatgcggatatcacggcttctgcggtggaattaaaagtgcttatcgaacaaatgcgtgagcaaattcagaatttagaataggaaagcagaatgtctcaatttatttctcttactcaatatcaactgattgaagtacagggtgcggatgtagaaaaatatttgcaagggcaattaacttctgatgttgtgcgattagcgagtggcgcaacgacgcttacagctcactgcgacccaaaaggtaaaatgaatgcaatttaccgtttgtttaaagtaagtagtgaacaagtctttttgctcgttaagaaagatattttgccaagcgctctggatgctttgaaaaaatatgcggtattttccaaagttagttttgatttacgtgattggcaaatcatcggcgtaataggtgaaaaatgtggaaaaattacaccgcacttttcattggaaattgatggacagcgttcaattttattaaatgaaactgaattacccgtgaattttaatggcgatgaaaaaatttgggaagtagccgatattcaagcaggattgccaaatttaagtccgcaaacacaaaatgaatttatcccacaagcactaaatttacaggccgttgagcaagcaatttcttttaccaaaggctgttatattgggcaagaaaccgtggcacgtgcgaaatatcgtggggcaaacaaacgtgcaatgtttatttttaaagcgcaaactcagcaggaagtggaaattggcagtgaaatcgaaatgcagcttgaagccaattggcgtaagactggcacgattacaagtgcggtcaatttagacggtattttatggttgcaagttgtgatgaataatgacatggattcagagcaacaatttagattgccgagtaatgaaatactgttagagcgagtgcagttaccttattcgattactgaataagaaagcaaaaaagatcaggcattaccctgatcttttttctatttagtaaagtactctagcacgaattgtgccatcaatttccttcaattttgtcagtaatggtgatgcatcattcgtttctacatcaacgacaacgtaaccaattttcgggtcagtttgtaaatattgtgcggcaatattgaggttggcttcgacgaaaatttggttcagtttgttcaatataccagggcgattttcatgaatatgcaataagcgttttgttccctcgtgctctggtaaagagacttctgggaagtttaccgaagaaagggttgagccattatctgaatatttaacaaatttgcctgccacttcaaaaccgatattttcttgtgcttccgctgttgagccgccaatatgtggcgttaaaatcacattatcaaattcgcgtaatggcgagacaaattcttcattaattgaagcaggttcaacggggaatacatcaattgcggcaccctgaagtttcccgtcttttaaggcttgagcgagagcatcaatatctaccacagtgccacgcgcagcattgatcaaaattgccccttgttttaattgtgcgatacgcgttgcgttcattaagtttttggtggagggcagttctggcacatgtaatgaaaccacatcgcaagaactgagtaattcttcaaggctacgaacctgttttgcattaccgagcggaagtttattttcaatatcatagaaatacacatccatgcctaatgattcggcaataatacttaattgtgaaccaatgtggccgtaaccaataatgcctaattttttaccccgcacttcataagagccagtcgcggatttattccaaacaccacgatgtacttcggcattagcctgtggcacattacgcataagtaataaaatctcgcctaatacaagttctgcgacggaacgagtgtttgagaatggcgcattaaatacaggaataccacgtgcttttgctgcatttaaatccacttggttggtgccaatacagaaacagcctactgcgattaatttgggtgcggcttcaatcatttctgcggttaaatgggtgcgagaacgtaatccgataaaatgtgcatctttaatggcttcttttaattcatcaccatccagtgcttttttatagtaatcaatattgctatagcctgccgcgtggagcgtatcaagtgcgctttgatgcacaccttcaaacaatacaaatttaatttttgatttgtcgagtgaaactttgtttgtcatatttgcttccttatgatttttattatgaattagtcaataattttggcaccttcaggcgtgccgacgattacaacatctgcgccacgcaatgcgaatatcccattagtgacgacacctgcaacattgtttaattctttttccatttcaactggatttaaaatactgaagttgtgtacatctaaaatcacattgccattatctgtaaccacgccttcacgatactcaggtgcgccaccaagtgcgactaattttctgcccacttgtgaacgagccattggaataacttcaactggcaatgggaaagtcgaacctaacacatctacttgtttactagaatctacaatacaaataaattttttcgctaatgccgcaacgattttttcacgagtaagtgccgcaccgccgcctttaatcatcattttttgtggattgatttcatctgcaccatccacataaatatctaagctagagacatcatttgcattaaatacttcgatcccttgtttacgtaataattcttctgatgcttttgaagccgcaactacgccttgaattttatttttgattgtacccaaagcttcaataaagcagttcactgtggagccactgcccacgccaacaattgtgtcagctgttacatattctaatgcagcttgtgcggcgagttttttcatttctaattgattcatttcttttccttatttcaataagtaaacgattgcgttactttattacgagcctatctaataaacaagtataattttttagcgggcgtttttctcaagcaatgttctttcacgactagactatttcacgattaggctattcttcagttaaaaataattccaatagttcattgagaaataacttgccgtgctcagtgatttgccaagaatcagcgttttccacaatatagttttgttgaatggcaaaatcaatttgatttttcaccgcactttgcgacaagcctgtgtaatcttcaaattcttgtttgggaaccgcttctaacaaacgaaagcgattcataaaaaactcaaaagggcggtcaatttctggcacgtttttttcttcgtaaagatattcgccacgcaaataacctttcgggtgcttggttttagaaaagcgagtaatctcgccagtcggaaacgtcaatttcccgtgtgcgccacagccaatggctaaataatccccaaatcgccaataattcaaattatgtttacattgaaaacccgcttttgcgtaagcagacgtttcatattgctggtagcctgccatcgttaaaagttggtgaccttgctcaaaaatgtcccaaagtgcgtcatcatctggtaatttaggtgggcgataagcaaacatcgtatttggttcaatagtcagctgataccaagaaatatggggaggagatagctcaattgcttgacgaagatcatctaaggcttcttccaacgtttggttaggcaaaccgtgcattaaatctaaattgaaactttttagcccagaaactttcgctaaattgaccgcactttttgcctctgctgcattatgaatccgcccaagacgttgtaatttatcatcattgaaactttgaattcccatagaaattcgcataatgcctgcggatacataacctttaaaacgttcagcttctaccgtgccaggattagcttctaatgtgatttcaatattatcttcaaaatcaatctgtttttttatttcttttaagagatacgcaatgctttctgccgagaacaaacttggtgtaccgccaccaataaaaattgaatggagttttcgttgttgaatagaatctttaaagcgttgcaaatcagcctgcaaatcttgcagaagatgataaatatagtcttgttctggtatatcgcctttttgtgcgtgcgaattaaaatcacaataagggcatttttgaacgcaccaaggaatgtgtatataaagggaaagtgggggaagttttagcattgtgttattaacaagttttcaatttggaaaagtataaattaaccttgtgtaaagatgaaattatcatctctaaaatcaataaaagggcttgttttcacaagccctaaaacattcaattaattgaccgctctttctgatttactcgtcactttacggcgtggtgctttaggtttagccttcactttaacaaactcaatgccctctggtggattttccaatgcaaaaccaagcacttcatcaatggtttctaccgcatgaattgcaagattttgttttacgttttctggaattttttcaagatctttaacgttctcttttggaattaatacggttttaattccgccacgatgtgccgcaagaagtttttcttttaatccaccgattggtaatactttaccacgtaaactgatttctcctgtcattgccacatcagcacgcacaggattacctgttaaacaagaaattaatgcagtacacattgcaatacctgcacttgggccatcttttggtgttgcaccatctggcacgtgaatgtgaatgtcacgtttttcgtggaattcagcattgatacccagtttatccgcacgagcacgcacaacggtcattgccgcttgaatggattctttcatcacatcgcctaatgaaccagtgaaagaaagttttcctttgcccacaacagaggcagtttcaatagtgagtaaatcgccgcccacttctgtccaagctaaaccagttacttcgccaatacggttttgcgtgtcagctttaccaaattcaaaacgttttacgccaagataatcgtgcagattatctgaatttaccgtgatagatttaagttttggatttactaataaatttttcacggctttacggcagatttttgaaatttcacgttctaatccacgtacgcccgcttcacgtgtgtaatagcggataatatctaaaattgcactttcttttacggtaagttcgcctttcttcaaaccattacgttcaatttgttttgctaataaatggcgcattgcgatattaagtttttcatcttctgtataaccagaaagacgaataacttccatacgatccaataatgggcctggaatattcatagagtttgatgttgccacaaacatcacatcagaaagatcataatccacttctaaatagtgatcgttaaacgtggtgttttgctcgggatctaatacttcaagcaacgctgatgcaggatcacctcgcatatcggatgccattttgtcgatttcatcaagcaagaataatggattttttacgcccacttttgccatcttttgaattaatttacctggcaatgcaccaatataggttttacggtgaccacggatttctgcttcatcacgcacgccgcctaatgccatacgtacatatttacgaccagtagcattggcaatagactgaccaagagaagttttacctacacctggagggccaactaaacaaagaatcgggcctttcactttgtttaaacgcgcttgtactgctaaatattcaagaatgcgttcttttacgcgatctaaaccatagtgatcggtatctaaaacttgctgtgctttaacaatgtcttttttcactttagaacgttgatgccaaggcacttggatcatccattcaatataactgcgtattaccgttgcttcagaagacatggcagacatcattttaagtttttgtaattcattttctactttgtcacgcacatcagctggcatgcctgccgcttccaccttttgatgcagttgttcaacttcatcaatggtatcttcattttcgccaccatccatttctttacgaatggctttaatttgctcgttcaaataatagttacgctggcttttctccatttgtttttttacacgaccgcgaatccgtttttccacttggagaatatcagcctctgattccatcataccaagcaaatattctaaacgttcttgcacattagcgagttctaacgcattttgtttatggcgaatgcttacagggagatgggcagccattgtgtcagctaagcgatcaacatcatcaatacgttgaagggcattgagaatatctgtaggcacttttttgttgagggtaagataattttcaaactcagaaagtaccgcactttttgccaccactaactcttgttcatcgccataagtggtttcgataggggtaatttgggcggaaaagcacttttcgccgtcttcaagactgttaattttcgcgcgattttgaccttcaactagcacttttactgtgccatcaggtaattttaataactgaataatgttagcaatggtacccacatcaaataaatcttcaggggtaggttcttccaaatcagcttctctttgggataccaaaagaatctgtttgtcatcgttcatcgcttcttcaagggcattaattgattttacgcgccctacaaaaagtggcatcaccatataaggaaaaacgacaacatcgcgtaatggcaatacgggcattgtacgttgggtattcttcgccataattggtctctcttataatttcgttccgataatttgggtaaatattggggtagggaaaaaggaattcaaggaaaagattataacaaaatctgagttataaagtgggttttaaacaaaaaagaattttggcaaatgaagtgataatggctaaaataacgaaaaattttattaaatttcacaaaatattgagttatgtccacgaaaaatcattttattttccccacttacgttcaaatgtatccttattctaaggatcgcccttttcttaaacaagtgcgggaaaaattacgctattatggctataaatggttatatcaaaagcaatgtcatcaattagtggatttccttaatacagaaacgcaatggcagtctttatttacacaagattattatcgtactaatacaattctgacgaccttttgcgataaacgtttttctgcttcagaacgtttaacggcgattacggagaatttacgtttggcagaagaaaaaatgggacgttcgctttgccaacaattattagatcaacaacatatcgtgctaacccaattaactgaggatttgcgtttatcgttgagtattaatcatatcgatccctttgaaggatatttttctattaatattcgcaatcaaaataacgaacgagtatatgatgcgtctttcacttttttaagcccgaataaattgcttatcgcctcaattcaaggcccctcaagcgacaatgcacaagaacttgtgaaacaggctacgaaagcattacacggtatgcgaccaatgtttatgttggttaatgcgttcaaaatgcttgctgaaaaatggcaatgtgagttagtgggcattccgcacaaagcacaaggaaaataccgtctttctgctcgcagtaagattttgtttaattacgatgaattttggcaagaaaaccaaggagaatatcgccataactattggcaattacctttgcatattgaacgcaaacaattagaagatatcgcaagtaaaaaacgttctatgtatcgtaaacgttatgaaatgctagaccaaatggcactggatattcagcaactttaacgaagaaagtgcggtaaaaaatgagagaaatttttaccgcacttctcaattagttttcttgttttttcacttcatcccataacaaatctaattcaataagtggcacattattcacttgcttaccttgttgttgaaccgcttgctctactgctcgaaaacgacgttcaaattttaaatttgctttccgcaatgcatcttcaggatcacattttaagtggcgagcaagattgacggttgcgaacaataaatcgccgatttcctcttccactttattttgttcaatcgaagtgcggttaatttcagcttgaacttcttctaattcttcccgcactttgtcaaatacgggtgaaatttcttcccaatcaaaccctacttttgaacaacgtttttgtaattttgccgctcgcgtaagagaaggcaaagcacgaggcacattatctaaaatagaggtttcttcacttttaccttgtttttctttggctttcatttcgttccaacgggaaagggcttctgtttcgtcccccgcttttgcatcaccaaacacgtgaggatgacggcgtacaattttttcagcgatatcttgtaacacatcgtcaaaagtaaagtatttatcttccgttgcaagctggctgaagaaaacgacttgcaacaataaatcccctaattcttcacgtaaatttggtatgtcttttttctcaatggcttcgattacttcgtaagtttcttccgttaaacaaggaatcatggattcataattttgttttaaatcccaagggcatccgccatttggattgcgaagttgggcgatgagttgaataaaatcttgaatagagtagtgcataattttatttcctttgatggaatgttttggatagtataacgaacaagaaacatggtgcaaatgccgtcgctttttaggcgtattttctttatactttgtgcattgaaatactattgataaagctgggaaaaatggaaaaaattattattgatcatgatcgttttcttcgcacaatttcgcgtatttctcacgaaattattgaaaaacatcaaaccttagatgatcttgttattgttggaattaaacgccgtggcgcggaaattgcagaattattacaacgtcgagttgaagagttaagtggtataaatttaccttcaatggaactggatattaccttttatcgagatgatttaactttggttgatcaggaagataaaatgccagtttatagtggttcatcacaatatttgaatattcaagataaaaccgtcattttggttgatgatgtgttgtttactggtcgaaccattcgagcggcaatggatgcgcttactgattttggtcgtgctgcaaaaattgaattagtgatttttgttgatcgtggccatcgtgaattacccattcgtgctgattacgtaggtaaaaatgtgccaacaagccgtgatgaacttgtacaagttcgtactgaaaaacaagatggctgttacgaagttgctattctagggaaataaatcttatctattgtgaaccttcaatagaattgttactctaaccaacgttatggactcttttttgatgagatgaaaatgaaaaaatttattctaaaatcttttttattggctactttaggttgtgttgcttttacttctatggcacaagcggaggaacgtgttgtcgcgacagtagatggtattcctattttagaaagccaagttcgtgccaatatgggtaaaaaaggcgatcgccaaagtgcacttgataaaattattgatgatcttttagtgcaaaaagcgattcaagaatctggtgtgaaaattgatcctcgtgaaatcgatcgtgttgtggaagacactgcagctagaaatggcttaacttatggtcaatttttggatgcgttagattatcaaggcatttcattaaatacattccgtcagcaaattgccaatcaaatggtgatgggggctgtacgtaacaaagctattcaagaaagtattgatgtaacgcgtgaagaagtggttgcacttggtcaaaaaatgttggatgaggcaaaatcacaaggcactgcacaaaaagttacaggtaaagaatacgaagtgcgtcacattttgttaaaacttaatccattgttaaatgatgctcaagcaaaaaaacaattagctaaaattcgttctgatattattgcaggtaaaacaacttttgctgatgcggctttaaaatattctaaagattatttatcgggtgcgaatggcggtagtttaggttatgcgttcccagaaacttatgcaccacagtttgcgcaaaccgtcatgaaaagtaaacaaggtgtgatttctgcaccatttaaaactgagtttggttggcatattttggaagtaactggcgtacgtgatggcgatcttacagcagaagcctacacacaaaaagcatatgaacgtttagtaaatactcaattacaagatgcgacgaacgattgggttaaagcattgcgtaaaagagcgaatattcagtattttaataaataacaaagtatcaaaaataaaggggcttaattgccccttttgttgttttttattttctctttcttatagcttatgaagaaatttttaattgcgattttacttttaatttttattttagcgggcgtggcgagttttgcttattacaaaatgactgaatttgtaaaaacaccagtaaatgtgcaggcagatcaacttttaactattgaacgtggcacaacaggtttaaaattagccgcactttttgagcaagaaaagttaattgatgatgggaaattattgccttatttgcttaagttgaaacctgagctaaataaaataaaagcagggacttattctcttgagaatgttaaaactgtgcaagatttactggatttgctcaattccggtaaagaagtgcagttcaatgtaaaatggattgaaggaaaaacctttaaagattggcgaaaagatcttgaaaatgcaccgcacttggtgcaaaccttgaaagataagagtaacgaagaaattttcacattacttgacttgcctgatattggtcaaaatcttgaactaaaaaatgtggaaggttggctttatcctgatacttataattatacgcctaaatccacagacttagagctacttaagcgatcggctgagcgaatgaaaaaggcgttaaataaggcttggaacgagcgcgacgaggatttacctttggcgaacccttatgaaatgttgattttggcttctatcgtggaaaaagaaacgggtattgctaatgagagggcaaaagtagcctctgtatttatcaaccgcttaaaagcaaaaatgaaattacaaacggatccaacggtaatttatggtatgggtgagaattacagcggtaatattcgtaaaaaagatttagaaaccccaacgccttataatacttatgtgattgatggattgccgccaacgcctattgctatgccaagtgaaagttcgttacaggctgttgcaaaacctgaaaaaacagatttctattattttgtggcagatggttctggtgggcataaatttacccgaaatttgaatgaacataacaaagcggtgcaagaatatttacgctggtatcgcagccagaaaaatgccaaataaaagtgcggaagaaaatatgaaaggaaagtttattgtcattgagggcttagaaggtgcggggaaaagctccgctcatcagtctgttgtgcaagtcttgcatgaacttggtattcaagatgtcgtgtttacacgcgaaccgggtggaacgccactggctgagaaattacgtcatctcatcaaacatgaaaccgaagaacccgtgacagataaagcagagttattaatgctttatgcggctcgtattcagttggtggataacataattaaacctgcgttaatgcaagggaaatgggtggtgggcgatcgtcacgatatgtcatctcaggcgtatcaaggtggcggacgtcaattagatccgcattttatgcttactttgaaagaaaccgtattaggtgattttgagccagatctcacaatttatttggatatagatccaattgtcggtttagcgcgagctcgtggacgtggtgaattagatcgtattgagcaaatggatttagattttttccatcgcactcgagcacgctatttagcgttagtaaaagagaatccaaaagcagtcgtaattaatgctgagcagagtattgaacttgttcaagctgatatcgaaagagcggtaaaaaattggtggaaatcaaacgaaaaatgaccgcacttttaaaataaaaaatcggcagaaaatttcctgccgatttttttgttacaacttaacttaaaacgtccactgtaaattcagcgcaccttgtttagcgtgatgatgtttgcctgtttggcgattgaatgtagcttgtaaggttaagctcgtaggtcttttttgtcgccccctttccccgcatgttgtgtccgcgctccgctcactctctttcctttctccccccttttttgtttttggttctgtgtcgtctcccgccctgtggtctcgtcttcgcattcctctgttttgtttcccgccgcttgggtgctcttgttcaccgttctctttgtctctttttgctccccccatccttcttttctccttcccttgttttttttctcccccccccctttttccccccttttttttttttcctcgccccgcccactctccttcgttttctcttctatcgccctcatttttcccgcccgcccgcccttgcgcgcgaccaaatcttcnnttcnnttccccccctttcttttcccccccctccccttcccgcttttttttttttttgtcccctgcg

SEQ ID NO: 681 - DNA, 106645 bp, H. influenzae
cctgcagaacaatcttataggaccccttcatagtttttatgggaattaaaatgaccgattttagattaaacaaacatccctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaaaatagtgatacaaaaacaccaccaaaaattgctgaaacggtaaaaacggctaaaacgctggaaagagaacaagcaaacaatattaaagacatcgttaaatacgagacgggcgttactgttgttgaagctgggcgttttgggcaaagcggttttgccattcgtggtgtagatgaaaaccgtgtagcgattaatattgatggattacgtcaagctgaaaccctatcttctcaaggctttaaagagctttttgagggttatggtaacttcaataatacgcgtaatggtgcagaaattgaaactttaaaagaagtaaatattacaaaaggggcaaattcaatcaaaagtggtagtggttccttaggtggatctgtaatttataaaacaaaagatgcgagagattatctccttaacaaggattactatgtaagctacaaaaagggatacgctacagaaaataatcaatcattcaatacccttactcttgcaggacgttataaaaagtttgatgccttagtggttacaacaagcagaaatggacacgaacttgaaaactatgattacaaaaatgcaaatagccttactcaaggtaaaaaaagagaaaaagcagacccatacaaaattgaacaagatagtacattattaaaattatcttttaaccctacagaaaatcatcgttttacccttgcagcagatttatatgaacatcgttctcgtgggcaagatttatcctatacactaaaatatcaaaaaacagatcctaatttactcgaggttgattctagacacaccaatgataaaacaaagagacgtaatatttcctttagctatgaaaatttctctcaaacgccattttgggatacattaaaaatcacttattcagatcaacgtattaaaactcgcgcacgtacagatgactattgtgatgcaggtgtaagatattgtgagggaactgcaaatcctgcgggactaaaattaacagatgggaaaataacacgtcgagatggttcagaacttcaatttgaaaaaaaagataaaaatattgataacaacatctatgacttcgataaatttattgatactgatgatcgagtaatagaaggtaaactaggcctaaggagatcctctggaacttggtatgattgttcaatatttgattgtaaagataaaacaaaaatgaaaatttttgaaactgaacatccttatggctatggcactactggaacgtggaaaaaagactttgaacttgaaataaaaaaattaaatgacaaaaatttcgctagagtaaaggatgcgaataataaaacatactctattcttccctcatctccaggttatttagaacgcctctggcaagagcgagatttagacaccaacacccaacaattaaatttagatttaaccaaagacttcaaaacttggcgtgttgaacataatctacaatatggtagctcatataatacaacgatgaagcgaatggttaatcgtgctggtaatgatgcttctgatgtgcaatggtgggcagagcctacacttggttacagtttgttgtatgataaacctcacacttgtaaaaccgcttatggggggtggaaagctaacctttgccctcgagttgatcctaaattttcattcttattacccattaaaacaaaagaaaaatcagtctatctctttgataatgttgttataactgattatttatcttttgatttgggttatcgttatgacaatatccattatcaaccaaaatataaacacggcgttacaccgaaattacctgatgatattgtgaaaggattgtttattccattaccaagtggtaaaaataataatgatgatcctgaagttaagaaaaacgtacaacaaaatattgactatatcgctaaacaaaacaaaaaatataaagcacattcttacagttttgtttcaacgattgatccaacgagttttcttcgtttacaactaaaatattcaaaaggttttagagcaccaacttcagatgaaatgtatttcacctttaaacaccctgatttcactattttgccaaatactaatctaaaaccagagatagcaaaaacaaaagaaattgcttttacattacataatgatgattggggttttatctccacaagtctatttaaaaccaactataaaaactttatcgacctaatatttaaaggagaaaaagattttaaattagttagcggaggtagcacattaccattttctctttatcaaaatattaatagagatagtgcggtagtaaaaggaatagaaattaattcaaaagtattccttggtaaaatggcaaaatttatggatggatttaacctaagctataaatatacctatcaaaaaggaagaatggatggcaatattcctatgaatgcaattcagcctaaaacgatggtgtatggcttaggctatgaccacccaagccaaaaatttggatttaatttctacactacccacgtagcaagtaaaaatccagaagatacttatgatatttatgcgaaagataaaaaccaaaccaacactagcataaaatggcgcagtaaatcttatactattctagatttaattggatatgtgcaaccaattaaaaatttaaccataagagccggcgtatataatcttacaaaccgtaaatacatcacttgggattctgcgcgttcaattcgttcatttggtacaagtaatgttatagatcaaaagacaggtcaaggcattaaccgcttctacgcaccaggtagaaattataagatgtcagttcaatttgagttttaaacctgtctaaaatcaaaagtgcggtaaatttttaccgcactttttcttaagaaaggatctaccttttactctctctttcaaagctaatgttcaaacatcggcatttgtgcaaaatctccttgaaaatcaacctctttttgctatttttgcgatctcgatcgaaagattgaaatgactatctcgccaaatttttagtttctatttatgcttacacatcaaaaatcaataacttattagttattgaaataaataagtaaataggataaattatgtacgagattctcttttacagagaccaaaatgacattgagccagtgaaagaatatctgctatcgctggctcaaaatgaaagcaaagatagtcgaattaaactgaataaaattcgagattatgtaatccaaacaacccaacaacgcttaagtgaattaaaagagagattgaaaaatgaataaaatcagcccattaggttcaaattggaatgagtttgaacagcaaattttcaatgaagaagaaatccgcgaaagtaatttacgtgtagccttaattaaagaattgattacttctcgccagcaacttgggatttcccaaaaacaacttgaaaccttaagcggtgtgaagcaacctatgattgcacgcattgaaaaaggacaaacgaatcctcaacttgaaacgttgttaaaattgctcgctcctttagggaaaaccctgtcgattgtgcctctaagggtaaaaaatgcctaagatatacccattattttcatattgacttgttatattttcattaagttttctcaataaatagtttttattgcaccttattatacctggcttttttgactagaaaatcgataaaatcggaatagactgttccgagaaaagaaaaaatattgcaaaatagcctcaaattaagacctattgtagaaaaatgattgtatttagtaatctgtccttaaaacgagggcaaacggagcttctcgaaaatgcttctgctaccattaatcctaagcaaaaagtcggcttggtggggaaaaatggttgtggaaaatcttcgctttttgccttattaaaaaaagaattaacgccagagggcggcgaggtaaattatccagcaaattggcgggtatcttgggtgaatcaagaaacgcctgcattggatatttctgcaattgattatgtaattcaaggggatcgtgaatattgccgtttgcaacaagagcttgaacaagcaaatgaatgcaatgacggtaacgccattgcacgtattcacgggcaattagaaaccttggatgcgtggacaattcaatctcgtgccgcttcgttattgaatggtttaggatttagtcaagaagaaacaacccagccagtgaaagccttttcgggcggttggcggatccgtttgaatttggcacaagctctgctttgtccatcagatttattattactggatgagccaaccaaccatttggatttggatgcggttatttggttagagcgttggctagtacaatatcaaggcaccttggtattaatttctcacgatcgtgattttctcgatccgattgtgacaaaaatcctccatatcgaaaatcagaagctcaacgaatacacgggcgattattcttcctttgaagtgcaacgagccactaaattggcacaacaaacagcgatgtatcgtcagcaacaacaaaagatttcccatttacaaaaatatattgatcgctttaaagccaaagccactaaagccaaacaggcacaaagccgtatgaaagcactagaaagaatggagctgattgcaccagcttatgtggataatccttttacttttaaatttcgtccaccgcaatccttgccgaatcccttagtgatgattgaacaggcaagtgcaggttatggcagcggagaaagtgcggtagaaattttaagtaaaattaaactgaatttagtgccaggttcgcgcattggtttactcgggaaaaatggtgcaggaaaatcaaccttgattaaacttttagcgggagaactgaccgcactttcaggcacagtgcagttggcaaaaggcgtgcagcttggctattttgctcagcatcaattagatactttacgcgcagacgaatctgctctgtggcatatgcaaaaactcgcaccagaacaaacggagcaacaagttcgagattatttaggcagttttgcgtttcacggcgataaagtaaatcaagcagtgaaatctttttctggaggagaaaaagctcgtttggtgttggctttgattgtttggcaacgcccgaatttattactacttgatgaaccgactaaccatttggatttggatatgcgtcaagcattaacggaagcattggtagattacgaaggttctttggtggtggtgtcgcacgatcgtcatttattacgcaataccgtggaagaattttatttagttcacgataaaaaagtggaagaatttaaaggcgatttagaagactatcaaaaatggctgaatgaacaaaatagcacatctgaaaataaagtttcggaaaaagtgggcgataatgaaaattcggttcaaaatcgtaaggaacaaaaacgccgtgaagcagagttacgccaacaaactgcaccattacgtaaaaaaatcacgcaattagaagaaaaaatgaataaattttcttctgagcttgcgaacatagaaaatcaactggcagatactgaattatataatgcggaaaataaagaaaaattgaccgcacttttggctcaacaagtggatgtgaagaaagcattagatgatgtagaaacggaatggatgactgcacaggaagaattggaagaaatgcttcaagcgtaaggatagattatgaatcaaagcctttttcatcatagcaaacaacaggaatattgccctcaatgtggtgcgcttttgcaaattaaacaaggcaaaaaagggctgtttttaggttgctctgcttatcctgaatgtgattatttgcgtcctttgcaacgatcggagcataaagtattaaaaacatttgatgaaatttgcccgaagtgcggtaatttattgcagttgaaacaaggcagttttgggatgtttattggttgtagccattatcctgaatgcgattttgtggtgcgggaagaatctgaatctgaggaaaaaattacttgtcctgaatgtaaaacggggcatttgatttctcgtcgtggtcgccaaggaaagattttttacggctgtgataatttccctaaatgtaaattttctttgcctgccaagccttattccgtgccttgcccaacgtgccattttcctctttctttgttaaaaagcgaaaatggggaaaaacaaattttccagtgtgcaaataaaacttgccgtcatatttttgagcaataaaagtaaaagaatgaaatgaatagagaacaaatcgccgaagcccttcgacaaaatcaagtggttgcttatcccactgaagctgtgtttggtttgggctgtaatccgcaaagtgaaagtgcggtaaaaaaattactcgatttaaagcaacgtccagtggaaaaagggctgattttagtcgctcctagcttggattttttccgtccttttgtcgattttgagcagattaacgatgaacagctttctcatctgcaaggtaaatatgaacgtccaacgacttggattgtgccagctaaatccaccacctcgcattttctcacaggaaaatttgatagcattgcaatacgtttgtgcgatcacccatctgtgaaagccttatgtgaactcacgggttttgcattaacttcgactagcgcaaacctaacaggagagccaccttgccgtaccgccgatgaagtgcggttacaattcggtgcagattttcctgtattggatgaaattgtgggagatgcacgcaatccatctgaaattcgagacttacgcacaaatcaactttttagacagggataatttatggatctttatgctgtatggggcaatccgattacgcaaagtaaatcgccattaattcaacgtcagttagccgcgcaaacccatcaaactatggaatacatcgcaaaattaggcaatcttgattcttttgaacaacagcttttggcattttttgaggagggtgcgaaaggttgcaatattacttcgccttttaaagaacgtgcctatcaactggcagacgaatatagccaacgagcaaaattggcggaagcctgtaatacgctaaaaaaactcgatgatggaaaactttatgcggataacaccgatgggattggtttagtgacggatttggagcgtttaaattggcttcgtccaaatcaacacgtattaatcttgggggcaggcggagcaacaaaaggcgtattattgccacttttacaagctcaacaaaacattgtgcttgctaaccgcactttttcgaaaaccaaagaattagctgaaagatttcagccttacggcaatattcaagctgtctctatggattcgattccactacaaacctatgatgtagtgattaatgcaacttccgctggattaagtggtggaactgctccagttgatgttgaaattttaaaattaggcttagctttttacgatatgcaatatgcgaaaggcacagacacgccatttatcgcattatgcaaaagtttaggtttaaccaatgttagcgatggctttggaatgttagtcgcgcaagcagcacattctttccatttatggcgaggcgtaatgccagattttgtcgcggtttatgagcaattaaaataaggtaattggcaatggaaaataaatacagcgattttatggtgtatgtcgatgaaagtggagatcacagtttacagtcaattgataaaaactatcctgtgtttgtacttgcattctgtattttttataaagaccattatcgaaataatattgttccacagatacagaagataaaatttgattattttggtcatgatatggtgatattgcatgagcatgaaatccgcaaagaaaaaggcgattttaatattttcacttctcgtgaacagcgtgaaggttttatggaacgtatttcatctattattgaaaatactaattttattcttgctgcctgtgtgattgataagcgaaaaacgccacaaaatgaaacaacacacccttatcatttttcactcaaacattgtttagaaaccctatacgaatttgtttgtgaaaagcatcaagaagataaaatcacttttgttgccgtggaaagccgtggacgtaatgaggatagagagttagagctggaatttttacgtatttgtgatggacaaaataaatttaaaaagtccttgccttttcaagtaaagattgtgccaaaacaaattaattctgtggggttgcaagttgcggatttagtggcaagacctatcgggagacatattttagatagtaatcaaccaaatcgagcctttgagatccttaaaaagaaattttattgtgaaggtggaagaaaaatactgggggaaaattttgatcaaaaaggactgaaacatttcccttagccctaaaaagcgaaaagcctcaatgaaactcactgaagctataacgccgaccaagcaccctcgatccacttggctcggaatatatcaaaatgttttattttgtcaagttttaatatgcaacaaataaccagatgcccttgggttggcgaacaacctatttatattgattatcatgacaaggaatggggaaagcctgaattcgacagccaaaagctatttgaaaaaatttgtttggaagggcagcaagcgggactttcgtggattacggttttgaaaaaacgtgaatcttaccgtgcagcctttcatcaatttgatccgaaaaaaatcgcaaaaatgaccgcacttgatattgatgcttgcatgcaaaattcaggattaattcgccatcgagccaagttagaagccattgtcaaaaatgcgaaagcttatttggcaatggaaaagtgcggtgaaaatttcagtaattttatttggtcatttgtgaatcataaaccgattgtcaatgatgtgcctgatttgcgatctgtgccaactaaaacagaagtatcgaaagcactttctcaagccttaaaaaaacgtggtttcgtctttgttggcgaaaccacgtgctatgcgtttatgcaatctatggggctggtggacgatcatttaaatgattgtccttgcaaaactcgctagtgtttatgctgatctcgctcccataaatcggcgtattttacaaaggttgaatgcgctgataacaccgctaataaaaatccttgtttgccatctaaaaaacccgcttttaacaaatacatcttcacaaaacaaccaagcgcgtgcgaaattccttgccaaagtgtggctttttttcctttagcttggcgttggtctgcccaggctttggcataacctgcggatttcactagataatgatgaatacttttataagtgaaatgctctaaatcccctgtcaatttttctacttttgtgccagctggaaattccactttttcatgtacaagtgaatcattatattgcgcatagtttgtgcgatagagacgaactacataatcgggataccagcctgaatggcgaatttcacgcccaaatacttcactcactcgtggaatttcataaacggtattttctcgatcatttttaaccgcacttaagatagcctgttgtaacttgggcgtaacgcgttcgtcagcatctaaccagagtacataatcactggttacatattgttgggctaattggcgttgtttaccaaatccttgccagtcgctattttcatagaatttagccccataactgagcgcaatttctttagtgttatctgtgctaccagaatctagaatgataatctcatccacccaatcttttacggtgtctaagcaattggcgaggtcttgtgcttcattttttacaatcatcgcaacgctaattgtaggcatattttcaatcctttttttgctatactagccgaaattttttcaagtataaccgaatttcatttatgtggcgttttttttataccagcttgcttttaatttgccagccgttgatattgtgttttattggcttgctcagtgttaaatctccacgttatcgtcagcgtttggctgaacgttatggtttttatggcaatgtgccttgtccaccaccacaaggaatctttatccacgcagcctccgtaggggaagtgattgctgcgataccgctggttcgtcaattgcaacaagattatccgcatttatccattacttttacgacttttacgccaacaggttcagagcgcgtcaaagccacttttggagacagcgtttttcattattatctcccccttgatttacctttttcgatccatcgttttattaattttgtacaacctaaattatgtatcgtgatggaaacagaactttggcctaatcttattcatcaattatttttacgcaatattccatttgttatcgctaatgcacgtttatctgcgcgttctgcacatcgttacggaaaaataaaagcgcacttacaaacaatgtggtcgcaaattagcttgattgcagcgcaggataacattagtggaaaacgctatgccactttgggctatccaaaggaaaaattgaatatcacgggcaatattaaatatgatctcaatacgaatgatgaactattacgtaaaattgattcattgcgaacgctttggaaacaagatcgcccaatatggattgctgccagcacgcataatggagaagatgaaatcattttaaaatctcaccgcgctttgttagcaaaatacccgaatttattgttattgctcgttccgcgccatccagagcgttttaatgtggtggctgatttacttaaaaaggaaaaatttcaatttattcgtcgttccacaaatgaattaccaaatgaaaatacccaagtgattttgggcgatagtatgggcgaactgatgttgatgtatggcatttccgatattgcttttgtgggtggaagccttgtgaaacacggggggcataatccactggaacctcttgcgtttaaaatgcctgtaattactggcaagcatacttttaattttcccgagatatttagaatgttggtggaagtgcaaggtgtgttggaagttaattcaaccgcagattccttagaacgcgccgtagaagccttattaaactcaaaagaagcccgcgaacgtttaggcaatgctggctatgaagtgctgatggaaaaccgaggggcattacagcgtttgttagatttattaaaaccttatttggagcgcaatgtatgacgagcgtgatttatcctggtacttttgatccgattacgaacggtcatttagacattattgaaagaagtgcggtaatttttcctcgtgttttagtggcggtggcgaatagcccaagtaaaaagccactattttcgttggaggaacgcgtggagcttgttcgtcaatctgttgcacatttatccaatgtggaggtgtttggcttttctgatttgttggcaaatgtgattaaacagcacaatatttctgccattattcgcggcgtacgcacaacaacagattttgaatatgaactgcaattggccgcccttaatcgtttactcacaaaaggcgtagatagtctgtttttcccaccagcagaaaaatgggcgtttgtttcttctaccattgtgcgtgaaatttatttacatggcggagatgtcgctgagctagttcctgagcctgtattcaatgcgttaaaagcacgatgataaaaacctttatttttttaaccgcacttatcgttttatctggttgtggttccgtggtcaaacttatcgatccaacagaaaaatataccgcctatgcaggggttgcttatgatcttgaaatggcgcaacaatggggattgccaatcttagatttgcctctctcatttttattagacactgtattactgccctatgcgtgggctcaataattcttatgaaactcaatcctcaacaacaacaagccgttgaatatgtgacaggcccttgccttgtgcttgctggcgctggttcaggcaaaactcgcgtaatcattaataaaatcgcccatttaattgaaaagtgcgggtattctccgaaacaaattgccgccgtcacttttacgaataaagccgcacgcgagatgaaagagcgtgtggcacattccattggcaaagaacaatccaaaggattgcttgtttccacttttcatacgctcggttttgacattattaagcgtgaatataaagcgttgggctttaaatcaaatatgaccttgtttgatgagcacgatcaatttgcgttgttaaaagagctaaccgctgatgtgttaaaagaagataaggatttattgcgcgagttaatttcagtgatttctaactggaagaacgatttgatttcgccaaaacaggcatttgccttggcacgtgatgctaaatatcaaactttcgcaaaatgttatgagcgttacgccacacaaattcgagcttacaacgctctcgattttgatgatttgattatgctgccgacattattgttcaagcaaaatgaagaagtgcggtcaaaatggcaggcaaaaattcgttatttgttggtggatgaatatcaagacaccaacaccagtcaatatgaactgattaaacttttagtgggtgagcgtgcttgtttcactgtggtgggcgatgatgaccaatctatttattcgtggcgtggcgcacgaccagaaaatatggtgcgtttacgcgatgattttcctcgtttgaacgtgattaagctagagcaaaattaccgttcaacccagcgtattttgcattgtgccaatattttgattgataacaatgagcacgtgtttgataagaaacttttttcaaccattggtacaggggaaaaattgcttgtcatcgaagcaaaaaatgaagaacacgaagcagagcggattgtcgccgagttgatcgcccatcgttttagccgtaaaaccaaatataaagattatgcgattttgtatcgaggcaatcatcaatcccgattactcgaaaaagtactgatgcaaaaccgtattccttacaaaatttcgggcggtacttcttttttctctcgtgcagaaatcaaagatatgatggcgtatttgcgcttggtggtaaatcaagatgatgacggagcattcctgcgtattgtgaatacaccgaagcgtgaaattggcaccgcaaccttacaaaaacttggagagttggctcaagaaaaacacatcagtttgtttgatgctatttttgagtttgaacttattcaacgcattacaccaaaagcctatgattcattgcaaaaatttggccgttggattgtagaacttaatgatgaaattcaacgttctgaaccagaacgtgcggtacgttctatgttatctgcgattcattatgaagaatatttgtacgaatacgcaacaaaccctaaagcagcagaaatgcaaagtaagaatgtcgccacgttatttgactgggttgcggatatgttaaaaggcgatgaaaccaatgagccgatgaaccttaatcaagtggtaacccgcctgacattacgcgatatgttggagcgaggcgaagacgatgacgacagcgatcaagttcaactgatgacattacacgcatctaaaggattggaatttccttatgtttatttgattggtatggaggagggcattttaccccaccaaaccagcattgatgaagacaacgtggaagaagaacgccgcttggcttatgtgggtatcacaagagcacaaaaagaacttactttttctttatgtcgtgagcgtcgtcaatatggagaattagttcgcccagaacccagccgatttttagctgaattacctaatgacgatgtgctatgggaacgcgataaaccaaaactcaccaccgagcaaaaacaagaaaaaacacaaaaccaacttgatagattgagggcgattttgaaaagttaataaaaatcggcagggaaattctctgccgattttttattttaaaagtgcggtcatttttcgtttgatttccaccaattttttaccgcactttcaattccagctaatgtagccaatgtagggtgggcttaagcccacgcgtttaactagggtttattccctacgggctgtaatcttccttatagtctagaaataacgtggcagacaaatagacttttaaaaattaacgtaaaaaggcataatggcaaccccattttttataattatttaggagcaaaaagatgaatattttattattagacggcggtaaggcgtttggtcattctcacggcgagttgaaccattcgcttcacaaaaaagcgaaagaagttttgaccgcacttggacacaatgtcaaagaaactgtaattgatgctggttatgacgttgaagctgaaatcgaaaaattcttgtggatggatgccgtgatttggcaaatgccgagctggtggatgcatgagccttggacagtgaaaaaatacatagacgaagtattaaccagtgggcacggcaagttatatcacagtgatggcagacacagcgttaatccaaccgagggctatggcacaggcggcttgttgcaaggcaaaaaacacatgctttcactgacttggaatgcaccgattgaagcctttactcgcgaaggcgatttctttgaaggcaaaggcgtggatgttttgtatatgcatttccacaaactcaacgagttcatcggcttgactcgcctgccgacattcttatgtaacgatgtggttaaaagtccgcaagtagaacaatacttagcagactaccaagcacacttggaaaaagtgttcggctaataaaaaaatccatcttcaatacgaagatggattttttgtttatttcgttgagattgttgttacttaacaactgccccacaaatcatattcatcagaatttgtgatggttactttaatcacgtcaccgactttgacattgattccgcttaaattatctacgtaaactaacccatctacttcaggggcatcggcttttgaacgaccaataataccatcttcgtcaatttcatccactaatacatcaagggttttaccaattttttgttttaaacggtttgcagaaatttcttgttgtaattgcatgaagcgatggaaacgttcttcttttacatcttctggtacttggtcagccatatctgttgcgggtgcaccttcaacagggctgaatttgaaacagcctacgcgatcaagttgggcttcttttaagaaatcgagtaataattggaaatcttcttccgtttcgccagggaaaccaacaataaaggttgagcgcaatgttaaatctgggcaaatttcacgccattgtttaatgcgttctaaagtgcggtcaatactgcctggtcttttcattgcttttaagattttagggctggcgtgttgtaatggaatgtctaaatacggcaatagcgtaccgtcagccattaatggaattaaatcatccacatggggatagggatacacataatgtaagcgaacccaaatgccaagttttttgggcaaccaaggcttacaaagccaatgcttggggttgaattttgcataaaaataaccgttttcgctctataaaatttcaaacgcaagattttactcaattttcgcaagaaaggcgataaattaaaggcttggaagggtaaagattttaagctaagtgatgtagaatagacgagtatgtctgacttatttttatcactatggaaaattcatctttacttttaaccgcacttttcaatcctgatcacttaattatttttagcaaaatgctattagcgatggtgcttggcagtgttattggcttagaacgtgaacttaaacgtaaacctgtgggtgtaaaaacttgtgccattattgccgttaccacttgtgtgctaaccattgtttcaattcaagccgcagagcattatgcacaagtttcagaaaatattcgtacagatccaatgcgtcttgcggctcaagtgattagtggcatcggttttttaggtgctggtgtgattttgcataagaaaaatgatgcgatttcaggtttaaccactgcggcgattatttgggcttctgcggggatcggtattgctgctggggcgggtttcgtgtttgatgcggtcatcgccactgtgatgattttggtgtctattcgattaagtccgttggttcaacgttgggttcatcgtaaatcacaacgtcgtcggacgaaattcaatattcttgtcaatgatgcggaaagcatagggaaagttacccaattgttagtaaataatcagtatcgtattgaacatatacaagtcaaagatcaaagtagtggagaagtgcggttacaaattcgttgcttttccattgattccacaatgttgaaagatgcgtatgctttacttaaagcagaagatggcgtaataagtgttgaagtagataactagaaaaagagtgattaaattaaattttcttttaaattaaccacacttttttattttttatttaatttctttcacaaaagatcaattttcattaaaaatacttgattttgctaacgctatcttgtaattaataatgctattcaagcacaacaaactaaggaaacaacaatgaaaaatgtaggctttatcggctggcgcgggatggtgggttccgtattaatggatcgtatgtcgcaggaaaatgattttgcaaatcttaatcccgtattttttacaacttcacaagcaggtcaaaaagcacctgtttttggtggcaaggatgcaggcgacctgaaaagtgcattcgatattgaagaacttaaaaaattagacattatcgtgacttgccaaggtggcgattacaccaatgaagtctatccaaaattaaaagcaacaggctgggatggttattgggttgatgccgcttctgcgttgcgtatgaaagatgatgcaattattgtgcttgatccagtaaaccaacacgtgatttctgaaggtttgaaaaaaggcattaaaactttcgtgggcggtaactgtactgtaagcttaatgcttatggctatcggcggtctatttgaaaaagatttggtggaatggatttctgtggcaacttaccaagcggcttcaggtgctggcgcaaaaaatatgcgtgaattactttcacaaatgggtttattagaacaagcagtttcaagtgaattaaaagaccctgcttcatctattttagatattgaacgtaaagtgacggcaaaaatgcgtgctgataacttcccaacagataactttggcgcggcattgggcggtagcttaatcccttggattgacaaacttcttcctgaaacagggcaaactaaagaagaatggaaaggttatgcagaaaccaacaaaattttaggtttaagcgacaatccaattcctgttgatggtttatgtgtgcgtatcggtgcattacgttgccacagccaagcgtttaccattaaattgaaaaaagacttaccattagaagaaatcgaacaaattattgcatcacataatgaatgggtaaaagtaattccaaatgacaaagaaaccacattacgtgaattaacgccagcgaaagtaacaggtacattaagcgtgccagtggggcgtttacgtaaattggctatggggcctgaatatttggcagcttttaccgtgggtgaccaattattatggggtgcggcagagccagttcgccgtatcttaaaacaattggtggcgtaagtttactttcactacaaagggcgtatttactacgcccttttcattaaaaaattatgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgtgcagaaaatatgttgaaatggtcagagctcgcttatgatttttatcatcaaggttatgatgtattgctatttgatcatcgcggtcaaggctattcacagcgtattattcctcaaaaagggcatttagacgaatttcgtttctatgttgatgatatggcgaaaatcatcgaaaaagtaaccgcacttttcagctattcaacgcagcatttgcttgctcattcgatgggcgcattgattgcaacctattatttggcaaattatgatcatcacattaataaagcggtactttcttcgcctttttacggtattcttttaaaacatcccattagagatgaactgattattgccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaacaatcttgaaaaattaaccgtactttttccgaatgctagatgtgaagttgtattcaatgctaaacacgaaattctatttgaacaggacaaattaagaaaggaaacaatctttaaaatattagaatttttaaataattagtagcttttcactcaaaaatagatttaatgtgtagataaaatattcaaacaaaggtgtttttcaaaaaatggtttgacatattttctaaaaaacgtattataccgctcacactgattgtggtgagatggccgagcaggctgaaggcgctcccctgctaagggagtatggggttaaaagctccatcgagggttcgaatccctctctcaccgccattgtttgttttatttattctgcacccgtagctcagctggatagagtactcggctacgaaccgagcggtcagaggttcgaatcctctcgggtgcgccatttttaaaacggctctatcttattaaagtggttatgaataattaaagcatcatctacgcacccgtagctcagctggatagagtactcggctacgaaccgagcggtcaaaggttcgaatcctttcgggtgcgccatttctacattgttactttcattaaaatattctttactattcaacatatttattatatttctttcttgtatctatttatttttaattatttaaaatatgaaaaaacaatctttaccaactaaatttagtccatttgcttggggtcttgctgccttttgttcgcctatattattgtgtccaatggcattattaatttctacagcatttagtaaaaatccctatctatcaagctggcaaatcaatttattttcaacgcttttttgggtttatccctttattctagctgttacagctagaatgctataccgtcttcatcaacataaacctaaactagcaaataaattattaacattaagtgcggtcattttttatgtgattttaattacgatttgtaaaattggtttataaaaaaatcctacgataatacgtaggattttttattctattttttctttattggtcgttgccaaccttgaatatgtcgttgagcaactcttgtaatcactaattcattttcgccaacatcacgtgtaattgtagtcccagcaccaatagttgcgccatttgcgactttcactggcgcgactaattgtgtatcagatcccacaaacacatcatcaccgatgatcgttttaaatttatttgcaccatcgtagttgcaggttatgacacccgctccaatattacaatttgagccgatttctgaatcgccaacataagttagatgatttactttagaacctttaccaacggtagattttttaatttctacaaagttaccgacatgcgtttcagctgcgagttctgcacctgggcgtaaacgagaaaatgggccaattgcggctttttctcctactatagaatcctctagcactgaatagggttttatttctacatcattgccaataacaacatttttcaatacgcaacctgcgccaatttttacgcaatcaccgagtttaacattaccttcgataataacattaacatcgatttccacatcttttccatgctctaatgttccacgtaggtcaaaacgagcgggatcgtagatcattacgccttcaagtaataatttggaggcttgtttattttggaaataacgttcaagtgcggctaattgtaagcgattatttgcgccttcaacttccatgacatctgttgcttgtacagcaacaacttggcaattatcttggtttgcgagagcaataagatccgttaagtaatattcgccttgagcattattattacctacacgagctagccattttttgaaacttgcaccatcagataccataacgccagtattgacttctttaatatttagttgctctgcatttgcatctttttgttctacaatggctacaacattcccattttcacggataattcgtccatagcctgttgggttatctaaatttacggtaagcaatgcaatgccattttctggtttcgcttcaattaatttttctaatgtttctttagtaattaatggtgcatcgccgtaaagtacaacaatgttttcgttatccttaaaaaaaggagctgcttgttgaactgcatgtgctgtgccaagttgttctgtttgtaatacccagtttacttgttcatttgcaagatgggtacgcattaagtccccaccgtgaccatagattaaatgaatattttctgagcctaattgatgggcaatatcaatcacgtgttttaccattggtttaccagcgattgtatgtagcactttgggtaaatcggaatacatgcgcgttccttttccagctgctaaaattaccgcacttaatgctttttttgtcataaattttctctttattcatcaataaaaacgggtaatattctatcttagaaagatagcaaatggtaagtttttaagtaaaagctataacaaacttttatataagaaaaaaccgatggtttcccatcggttttttgaattttaaagtggttaaaatagaattatttaacttctacttctgcacccgcttcttctaattctttcttaagtgcttcagcttcttctttagaaacgccttcttttaagttagctggagcagattcaactaaatctttagcttcttttaagcctaaaccagttgcaccacgtactgctttaattactgctactttgttcgcacctgcagatttaagtacaacgtcgaattcagttttttcttctgctgccgctgcgccgcctgctgctggagctgctgctactgctgccgctgctgaaacaccgaatttttcttccatcgctgcgattaattcaacgatttcagttacagtttttgaagcaatcgcttcaatgatttgttcgttagttaatgacataacaatcaattcctaaaataaataaagttagatgaagtaagaaacgcttaatgattaagctgcttcttgtaatttgtcgcgtaatgccgcgaaggtgcgagcaagtttgcctgctgcagcttctttcattgtgcccattaaacgtgcaatcgcttcttcgtaagttggtaatgttgccaagaattcaacatcttggattttaccttcaaaggctgcacctttaatttcaaacttatcgtttgctttagcaaactctttgaacaaacgagcagcttcgcccgggtgttcgttagagaacgcgataagtgttggacctacaaacgtatcttttaagcattcgtaatctgtgccttcaactgcgcgacgtaataaagtattacgaactacacgcattgtaacgccagcttcacgtgctgatttacgtaattcagtcattttctcaacagttacaccgcgagaatccgcgattactgctgaaagtgcacctttggctgcttcatttacttcagcaacaattgcttgtttgtcttgaagatttaatgccattggcttttagctcctgaatacactccgattactcggaattaatttacctaatcctaagattaggatgacttcggcgcccagaagcaagaaaaattcttattctgttcaccatctacgtaggataattaagattactcccctacggtcttggatggggcttgaataggtcaagcaccaaccagaaatttgttagattgactaacacaggcgcaggattatagagaaaagctatgttcttgtaaagaatattgttggaaaaagagccaaattcctatgatagcttctctactaattccactgcagccccaatataagtagcgggtgttaatttttgtaaacgtaatttttcttcttgtggaatatccaacttatcaataaattcacgcatagcctgttctgtcactcgtttacctcgcgttaattcttttaatttttcgtaaggtttttctattccgtagcgacgcattacggtttgaattggttcagccaaaacttcccagttttgattgagttcttctaataagtgcggttgatttacttcaagtttactcatgcctttgcgtgttgaagcataagcgatcaaacaataacctaatcctacgcctaaattacgtaatacggttgaatctgttaagtcacgctgccagcgagaaattggtaatttttgacctaaatgggtcatcactgcattggctaatcctagattgccctctgagttttcaaaatcaattggattgactttatgtggcatggtagaagaaccaatttcgcctgctatagttcgttgtttaaagtgatttaatgcaatgtatccccataaatcacgatcaaaatcaatgataatggtattaaagcgaactacagcatcaaaaaattcagcgatgtaatcgtgcggctcaatttgtgtggtataaggattccattgaatacctaatgaagtgacaaattcttcgctgaatttatgccaatcaatattaggatatgccgataaatgcgcattgtagttacctactgcaccattgattttacctaagatctccgcattttggagttgtttaaattgacgttttaggcgataaacgacattcgccatttctttgcccacggtgcttggtgaagctggctggccatgtgtgcgagaaagtaatggaatcgttttatattcttctgcaagacgagtgatttcatcaatcagtttttgccattctggtaaaatcacttcgtcacgagcggtgcttaacattaatgcgtgagagagattgttaatgtcttctgaggtgcaagcgaagtgaataaattcagaaacgttcactagttccacttcgttttgaattttctctttcagaaaatactcaacggctttcacatcgtgattagttgtgcgttcaatttctttaatacgcgcagcatcggcctcattaaaattagccacaattccatctaaaaaagcatttgcttgcgtagaaaatggcggtacttcggtaatatctgccgttgaagctaatttttgtaaccaacgaacttccacaactacacggaatttcattaacccgaattcgctaaaaatagcacgtaatggcgttactttatcttgataacgaccatcaagaggggaaagtgcggtcagtgtagagagttgcataaatgtttactccagaattgtattaataaatagaagaataaatctgttttgcggtggcaagtaattttctgcggaaaaataaaatttgccattttgttccgcccatttgtttccacagcacggcagagcgaatgcctgcaagtaaaactgcacggattttattttgcacgagttcttgtcgcaaataatcaggcgagcctaggatgtgaatttttttacccaatgggctaataatatcgctgtaaatatttgccataatagataacattgtttcactatcgcgagcgtaatgaatttcttgttcttttaggcgagaaattcgattgcccaatgtttgtttggcatcggagtttttcgataattttccttctaatgctaaaaggcttagccaatagcgagttaaattttgatcgccttgcgcgttgagctggtgaattaaggtttctagacctaattttaaatgacgaacttcgccaccaaaaacatcttcaattcgttgtggttgggtaatgaaaaggctattaagtgcggttaaaaatgtatctgaatctgctcgactttctgttgcaagttgatgaaccaattttgctgattggcacacgccagcaagggcaagaacaatatcgtggtagtttttcattagtaaatattaggaaaacgtttccgttaaatatagcatttttaacctagcttttgaactcgaacattaaaaaagcctagagtttctgatatgatgtgtgaacagttttaaggtattaaggattgattatggcaaaaccaattgtttttagtggcgtgcagccttctggtgaattaactatcggaaattatttgggtgcgttgcgcaactgggtgaaaatgcaagaagattatgaatgtattttttgcgtagttgatttacatgcgatcactgttcgtcaagatcctgttgcccttcgtaaagcaacgcttgatgtgcttgcactttatttagcgtgcggaattgatccaaataaaagtactatttttgttcaatctcacgttccagaacacacgcaattaagctgggtgttaaactgttacacctatttcggtgaaatgagccgaatgactcaatttaaagataaatcagcgcgttatgcagaaaatattaacgtgggtttgtttgattaccctgtgttaatggcggcggatattttactttatcaagcaaaaagcgtgcctgttggcgatgaccaaaaacaacacttagaaattacgcgtgatattgcaaaccgctttaatgcgctttatggcaatattttcactattcctgaaattttcattggaaaagcaggcgcgcgtattatgtcattgcaagatcccgaaaagaaaatgtcaaaatcagatgataaccgcaacaatgtagtgacacttttagaagatccaaaatctgtggcgaagaaaattaaacgtgccgtaacggattcagatgagccgcctgttgttcgttatgatgtgcaaaataaagcgggggtatctaatcttttagatattctttctgcggttacggataagccaattgctgatcttgaaaaagaatttgaaggtaaaatgtacggacatttaaaaactgcagtagcggatgaagtctcaactttacttgctggtttacaagaacgtttccatcaatatcgcaatgatgaaactttattagataatatcttacgacaaggtgcggaaaaagctcgtgcaaaagcacaagaaaccttggcgaaagtgtatgaagctgtaggttttgttgctgcaaaataatctgaataaaagggataatattatggcaattcaaactgaaaaaccgattgaatgtgtaggttgtaacacatttgatatgaaatcacttttcgataatcgtgattgtagtcaggttattgaatatatttatgacagtgaagaacaagcgcaagaagcactcgcattttttactcagaaagcgcgtgatgtagaaagtgaaccttgtgaaattcaatctgaaattacaaaactggatgatggctatttattaaaggcagatttcactttctgttgccaagctgaattggtgatttttcaaatgcgtattgcgtaagaaaaacagctgaaaaataagccgcacttttgcggcttattttgtgattagtgttctacaaagcttaaggcggtttcaattacttcaactcccgcaccttgtttaaacgcattttcacttaaatagcgtcgccattgacgggcacctttgcaattttggaatgcgcctagcatatggcggacgatatgattaaggtgtattccttggttaagttgttgttcaatataaggaagcattgactgtaccgcttcatgagcggtaacaattgcagcgttaggatcaaataaggcttggtcaatttgcccaagtaaacttggattttgataggcctctcgcccaaccatcacgccgtccacatattgcaaatgttgtttcatttcttcaatggtttttatgccgccattaattgcgatagttagatgtggaaaatcacgttttagttgatacactcgagcataatctaatggtggaatttctcgattttctttgggacttaaccctgaaagccaagcttttcgtgcatggataataaactcttggcaaccttttccttgaaccttctcaataaaatcacataaaaattcatagctgtctaattcatcaataccaatacgtgttttcactgtgactggaattttgaccgcactttgcatttgttctacacagtcggccaccaaatctgctttcgccattaagcaggcgccaaacattccattttgtacgcgatcagaagggcatcctacattaagattaatttcgtgataacctcgttcctcagcaagttttgcacaatatttgagttgttcaggatcacttcctcccagctgtaacgcaacgggattttcttgtaaatcaaaatccaagtgatcgtatttggcatggataatcgcaggcgcagtgaccatttcggtgtaaagtaatgcgtgctttgaaaattggcgatgaaaataacgacaatggcgtgttgtccaatctaacattggcgcaacagaaaaacggccgcggtaaaagtgcggtagattttgaggcatttttatttctcttgtttggttttgctgcgtaattcttcggcttgacgagcttgcatttgctggcgaaaacggcctgcagcaaagtggtaaaatggtttaggactaaattggcgcgagattatggatgcaataatgctggaaatcaagagccaaatgagaacgagttgcgcgcctgtcatttccactccaacagtgcggcaagcactaaacccaataataaagcaatataaataggatgttggcgaacccagccacgccatttttcaggtgataatcctgcgataccttttgctaataatcgtccaaatatgccacctagaatgccataacccaccccacaaattgcaagccaaagatagagacaagaaaccgatgttgccccttgataacgtggaaaataagggctgtttccttgaatcgcgacaagaataaaaccagtagctaatacgcccaactgatacaccgataagcatagccaaaaaggtaagaggaattttccaaatagtttggctgaattcaactaatttggttttatagctactatgaggaagattaattgatgcaatcacttgtggaataccacttcctccaacatatggagtatattttttcgtaaaccaagtcaggcaagccatgcctatgattaggcagataaattctaaacttttgtgggaaattctgtatgtttgacgtaatttcttatggaaaaaatagcgtaagtgaaatttgagtggacataacatagtagtttatttgattaatgccaattaattaaaaattatagaagtgtcatttataaggagcaatgtatttattgttctaggaatcaaataaatgacttattatctaaaatctattaacttaataaatatttaaacgaattatcaaatatagaataaaaaaatgcggagaattttctccgcacttttctttttacttcttctgtcttttatctttaagacattcaagagttcatctattatttgatgattttcgcaacaacgcctgcacctactgtacggccaccttcacggattgcgaaacgtaagccttgatccatcgcgattgggtggattaagcttactgtcatcttgatgttatcccctggcattaccatttccacgccttctggtaattcgatagtaccagtcacgtctgttgtacggaaatagaattgtggacggtaacctttgaagaatggagtatgacgaccaccttcatcttttgataatacgtacacttctgattcgaagtcagtgtgtggtgtgattgaacctggtttcgctaatacttgaccacgttcgatttcttcacgtttggtaccacgtaataatgcaccgatgttttcacctgcacgaccttcgtcaagtaatttacggaacatttcaacaccagttacagtagttttcgctgtatctttgataccgacgatttctacttcatcacctgtacggatgataccacgttctacacgacctgttactacagtaccacgacctgagattgagaacacatcttcgattggaagaaggaacggttggtcaatcgcacgttctggttctggaatataagtatctaagtggtttgctaactcaaggattttttcttcccattctgctacgccgtttaacgcttgtaatgctgaaccacgtacgattggtgtatcgtcacctgggaagtcatattgagatagaagttcacgaacttccatttctactaattctaataactcttcgtcatctaccatgtcgcatttgtttaagaatacgatgatgtatggaacacctacttggcgacctaataagatgtgttcacgagtttgtggcataggaccatctgttgctgctactactaaaatagcaccatccatttgagccgcaccagtaatcatatttttaacatagtcggcgtgtcccggacagtctacgtgtgcgtagtggcgagtcggtgtatcgtattcaacgtgtgaagtgttgatggtaataccacgcgctttttcttctggcgcgttatcaatttggtcaaatgcacgcgctgcaccaccgtagtgttttgctaatacggttgtgattgctgctgttaaagttgttttaccgtggtcaacgtggccgattgtacccacgtttacgtgcggttttgtacgttcaaatttttctttagacattgctaatgtttcctaagaagtgcggtataaaacaatcatattttacaccgctggtttacaaaaattattttttacgcgcttcaattactgcagctgccacacttgttggagcttcagcatattttaacggttccattgagtatgatgcacgaccttgagtttgtgaacgtaaatctgttgcataaccgaacatctcagaaagtggaacttcagcatcgatcttaacaacaaactcgttcgcttcttgaccgttaaccatagcacgacgacggcttaaatcaccaattacatcaccaacatattcaggtggagtttcaacttcaactttcataattggctcaagtaatactgggtttgcttttgagaatgctgctttaaatgctaaagacgcagcaagtttaaatgctaactcagatgaatccacatcatggtatgaaccgaagtgtaaacgtacaccaagatcaactactgggtaaccagctaatggaccagatttaagttgttcttgaatacctttatcaacggctggaatgtattcaccaggaattacaccacctttgatttcgtttacaaattcataaccagggccttctggatctaatgggtataagtcgataacaacatgaccatattgaccgcgaccaccagattgtttagcatgtttaccttcgacatcattaacacgagtacggatagtttcacggtatgatacttgtggtttaccaatattagcttccactttgaactcacgtttcatacgatcaacaatgatatctaagtgcaactcacccataccagaaataatggtttcgccagattcttcatcagtgtgaacacggaatgaagggtcttcttgtgctaaacgacctaatgctaagcccattttttcttggtcagctttagtttttggttctaccgcaacagagattactggctctgggaattccatacgctcaaggatgattggtgcttcaattgcacataatgtatcaccagtagttacatcttttaagccgatagctgctgcgatatcacctgcacgaacttctttaatttcttcacgtttattagcgtgcatctgtacgatacgaccaaaacgttcacgtttttgacgtacagaattcaatactgtatctccagaattaataacaccagaatatacacggaagaatgttaagttacctacaaatgggtcagttgcaattttaaatgctaatgaagagaatggttcttcatcacttgcatgacgctcaccttcagtttcatctgggttgatacctttaattgcagggatatcagttggtgctggtaagtattcaacaactgcgtcaagcattgcttgaacacctttgtttttgaacgcagaaccacaggttaccaaaataatttcatttgctaatacgcgctgacgtaatgctgacttaatttcttcttcagttaagtcttcgccacctaagtatttttccattaattcttctgacgcttcagctgccgcttcaacaagattttgacgccattcttcacagtctgcttgcatatttgcaggcacttcttcataagtgaaagtcataccttggtctgcttcattccagttgatcgctttcattttgatcaaatcaactacaccagtgaagttttcttctgcaccaattggaagttgaagtggaaccgcattagcacctaagcgggtttttaattgttcaacaacacgtaagaagttcgcaccagtacggtccattttatttacgaacgcaatacgtggaacttcatacttgttagcttgacgccatacggtttcagattgtggttgaacaccaccaaccgcacagtaaaccattactgcgccatcaagaacacgcatagaacgttctacttcaacagtaaagtccacgtgtcccggagtatcgataacattgatacgatgttgtgggaattgttgtgacataccagaccagaatgcagttgttgccgcagaggtaatggtaataccacgctcttgttcttgttccatccagtccatcgttgctgcaccatcgtgcacttcaccgattttgtggctaacaccagtatagaataagatacgctcagtagtagtggttttacccgcatcaatgtgcgcactgataccgatattacgatatctttcaataggggttgtacgagccattattataaccttgtttatttaatatcagtttatataagggtaaggcttcatcaatgatgaagccctttaaattcaaaaacttattaccaacggtagtgagcaaatgctttgttagcttcagccatgcggtgaacgtcttcacgttttttaactgctgcacctttattatctgaagcatcagataattcgtttgcaaggcgtaaagccattgatttgtcaccacgtttacgtgctgcttcaacgatccaacgcatacctaatgcgttacgacgtactggacgcacttcaactggtacttggtaagtagaaccaccaacacgacgagatttaacctcaacagttggacgtacgttttcaagtgcaacttcaaacgcttctaaaggctctttacctgtgcgttgtgctaaagtttctaaagcaccataaacgattgattcagcaacggattttttaccgtctaccatgattacattaataaattttgcaagtaattctgaaccgaacttcggatctggaagaatcttgcgtgcttcaacactacgacgacgtggcattgcgaatttctccgtattttaatcttcaggatatccaaaacccatcagcaatatttctcattgagaaaatttgcagcgcaaagcgcttttgactggagtttatggtttaaattgttttgctaatttagacgtttggccttacttaacggagaaccattaagctttaggacgtttaacgccgtatttagaacgaccttgtttacgatctttaacgcctgcacagtctaatgcaccgcgtactgtgtggtaacgcacacccggtaagtctttaacacgaccaccacggattaatacaacactgtgctcttgaaggttgtgaccttcaccaccaatataagaagttacttcaaaaccgttagttaagcggatacgacatactttacgtaacgctgagtttggttttttaggagttgtagtatatacacgagtacatacaccacgtttctgcgggcaagcctctaatgcaggaacgttgctttttacaacctttttcacacgcggtttgcgtactagctggttgatagttgccattaaaaaagctccagtttaaatgttattcaataatagaatgttgttcaaaaaatctacttccatatagaaatagacggcgaattttaatagttttacgctttattgtcaataattaaacaatatactctaggcttaaaactagattaaaatttaccgcacttttgttttttaataaaaaactttattccccacgttttagcatgccttgttttttcaaattaaccagaataattgaaatagcagcaggcgttatacctgaaattcggctcgcttgtccaatggaaaccggacgatgttgttctaacttcgcacgtacttcattagataatccagacactttactataatcaaaattagcaggaatagccgtattttcatggcgtttttgtttttcaatttcttcttgttgatgctcaatatagccttgatacttaatagcaatttccacttgttctacggcttctctatcttctattgcgggcttgtatggcgttaaagaagtcaaaatatcgtaggtcatttctggacggcgtaataaatcttcaccgctggcttcacgcacaagtggactgccaagcactttattggcttcttctaaatattcagaacgcggatgcagccaaatgctgcgtaagcgctggcgttcttgctcaatcttttccattttttgattaaagcgtgcccagcgagcctcatcaatcaaacctaattcatgggcaattggcgttaaacgaatatctgcattgtcttcacgtaataacaaacggtattcagcacgagaagtgaatacacgatacggttctttcgtaccgagcgtacaaaggtcatcaaccaatactccagtataagattgatcacgacgtggataccatgcctctttctcttgtacataaagacctgcgttaatccccgccaataagccttgtgccgctgcttcttcataaccggttgtaccgttaatttggcctgcgaagaataaacctgaaatagcttttgtttctaacgttggttttaaatcacgtggatcaaaataatcatattcaatggcataacccggtttaatgatgcgagctttttccaaacctttcatggaattcacaatgcccatttgtacgtcaaacggcaaactggtagaaatcccatttggatacacttcgttactggttaatccttctggttccaaatagatttgatgtgaattacgatccgcaaaacgcatcactttatcttcaatagatgggcaataacgtggaccgatcccttcaattacaccagtatacattggactacgatccaaattattacggattacttcatgagtttgttcattggtgtgagtaatataacaaggaatttgttgcgggtgatcagataccgatcccataaaagaaaatacaggtaacaccgcatcaccatgctgtttagctaaaatatcaaaattgatcgtgcgtgcatcaatacgtggtggtgtacctgttttaaggcgatctacacgtaatccgagatctcttaatcgatatgaaagatttacagaagcaggatctccagcacgaccaccttcataattttccaaaccaatatgaattttaccggctaagaaagtacctgcagttaataccactgatttagcacgaaaaattaatcccatttttgtgctaacgcctgtaactcgatcttgctcaattagaatatctgtcgcttcttgttggaaaatatctaaattaggttgattttctaatgctgtacgaacagcttgacgatataaaactctgtcagcttgagctcgagtagcacgtactgctggacctttactactatttaaagtacgaaattgaattcctgctttatctgcagcatgcgccatcaaaccacccatagcatctacttcttttactaaatgacctttaccgatcccaccaattgcaggattacaagacatttgccctaaagtatctacattatgtgttaataaaagggtttttaatcccattcgagctggtgcaagcgcagcttctgtacccgcatggccaccaccgatcacaatcacatcataagtttcagtgtaaaacatatctatctctatttattcggatcaaaaaattggcgttattctacagaaatttaaaacacctgacaaaaaaagaatggatctattgatcctttgaaagatcaggtttgtattagtaaataagatctctttttttatatataaagatcttattattgttactattaagatcctttgtaattgtgagtaaacttattagatccttacggaaactggtgttataggatctaaagatcttgtgaaaatgcgatcattttctttaaaaatcttgtgtgtaaaatggaaagttattaacaactttattttttctcaaagttatcaagtgagtaaaaacagttttatgacagattatttatgagttatccacagataaaaatgaatttttattgaaatctctataatttagctttttttaaataattaattttattaaatgtaagttttatgatttgactttgtagttactacaggttttatgcttctttcaaatcaaatagttaaggaaataaaatgaaagaagtttctctagtaaaaaattatactcctaaagaatatcagcagcatgcatcttgccctcatagtcaaatttctaaaaataaaatggtattaggcatcagttttgcaattattaccttttatatggttgttgaatttctagggggatattggtttaacagccttactttgatggctgatgctgggcatatggcaaatgatagtttatctatttttttagcatggattgggttatttttaagtctaaaatggcaaaaatggttagctttaatcaatggaatttcattagtttgggtcgctatttggatttttattgaggctgtaacacgttggcaggctccgatagaaatagccgctttgccaatgttaggtgtagctttactagggtttgggattaatttgttggtagcttttataatgctaaaaagtaatcgccataatttgaatattcgtgcagcatatttgcatgttttagtagatttatttggttcggttgttgctattattgcaggaataagtgcttggtggttaaattggcagtgggttgatgtagttgctagtggtatcttaagcatttttgtattacaaagcggtatttctacagtttttcaagctattaaatccttatatagtagcgatgacaattcattgccgaatgatcattctcattaaagtaaaaaattgcttgaggaaataatgaaaattaatgaattaagtaaatctacacatactaatattgaaactattcgctactatgagaaacaaggagtattacctccacctaagcgattggctaatggttatcgattttatgatgaagagagtatagagcaattaaactttattaaaaaatgtcgaatgttgggcttctctttagagaatattcgggaactcaatcgtattagatttagtacgaaagatcattatcaagcagatcaattagtacttaatcagcttattcaagtagaaaataaaatatctcaattattagaaattaaagcttttttgcagtctattgttaccgaaaatgaacataatgaagaagaatgtaaagcaatagaagggttgaaaagcgaatgcaatttgtaaaagaaagaagatagattcatgaaaatacttaaaaatttgaccgcactttagaagaaaaaatgccatctaaattttagatatttaggcggcattttatttttctaattattacttagataaatcaatttggtatacagcaaatccaacttcatctgtacccacttgtttcattggatactgtgctttttctttgatgaattgagctgcttgttcgcttggtgaggtttcaaaacggacatctaatttatcgttacctgagataggcacaaaacgccagtttttatccgcgctagggtttacagaaccttctttttcactggttactttaatgtaatcagctaaaatttgacggttttcatctggtgatgcgtaaacaatatgttgatcgccagtgcctgggaatttattaccgtaagcacgatagttattcgttgcaatcaagaattctgcttttggatcaaccggtttgccttgataagtgagattcactacacgatgcgattctgggttaatcaatttacattcaccatcataacgtgcaggtttagttagatcatattcataattgacaccatcaatcacatcaaagttataagtgcggaaaccttcccagtcgattaatgattgtggtttatcacttgtagggtcaatttgtttaaacataccagcactacattctaaccattcttttaattgttcgcctgttgctttaacaacgactaatgtatttggatagagatataagtctgccgcattacggaaagttaattcacctttatttacttcggtataacctgtagggtcatttttacgaccaccagctttaaatggcgctcctgcacttaaaataggtaagccagccattgctgcaacatttggtgcaactttttctacatacgctttttgtgcttggttcactatttggatggttggatcatcttgcactaatgcaagatagctgtacatattgtctgtggctttaccaataggttgagaaacaaacttacgtgtagcttcgtgaactggttttaaaagtgcggtaatttctgggtcattttctgcaagcacttttttatttttagcatcatagattggacgaagtactgcttttccagaggtaacaatccatttgcctttgtgttctgttaagcctaaatccaccacgctgatattatttgcccagtaaccagccatactttctggtacgccttttacggtaccatttacgatgtctgcatttggtgatttcgcaaattctttatttgggaataaacggtgtgagtgaccaaaaataacggcgtcaatatgtggtacatcagctagatagaatgctgagttttcagcaccttcttgataaggttcatcagatgggcctgtgtgagctaatgcaacgataatatcagccccttttttcttcatttcagggacatatttttgcgctgtttttacaatatcatgggtttccactttaccttgaaggttcgctttatcccaaaccataatttgcggtggcacaaagccgatgtaaccaatttttaatttatgtgttttgccattattatccaccacagatttttcttgaatgacataaggtgtgaaataaggttcttctgtccccgcttttactacgttcgcattcacaatttggaatttagcttgtttgatggcatctgcaagataattgagaccatagttaaattcgtggttacctaatgtacccacttcataattcatcgcatttaaacaatcgaccgcagggttagatttaccctctttatagccttgtgcagcttgatagtctgcaattggattaccttgaattaggtcaccgttatctactaatacactatttttcacttcagcacgtgcttgacgaataaggcttgctgcacgagtaaaaccgaatttatcggttggtgcatctttataatagtcaaaatcggtcaagaagctatgaacatctgttgttgccacaatgcgtaaatcaacatcgctctttccttttgccatcgcaaaacggtttgcacttaacgctaggatgctagttgctccaatttgaataaaatgacgtctattaatcattgagttttccttataaggtgggtaaatattgcctttattctaagaaaaatagcggattcttaaaagaaaggagtaaaaatatttttatttaattaagataataatttctgtactaaggaagtataaatattaaccccagtaagtaattgattttcatcaaaatcaaattcagcttcgtgatgacctgctgtgcgatctgcgccaagaatgaagtaaatagctttgcctccatgttcttgtacacgtctacctaaaatagtcgcatcttcacttgcattgaaagcataatctgaatttacgttatttatttgtggttgtttaagagatatttcttcgatgagttttataagttcaacatcgttattcatatccactgcttcacctacaatttcagtttcatatgcgacatcaaaacttatggagatacctttggctatttgcatgacttgttcagtcatgtattcattaattgctttattttctccccgcacttctaattgtaattcagcagaggatggaatgacatttcgtccttcacccgcttttagcacacccacattaattcttgtcatgccttcaccatggcgtgcaataccatgaagttgagtgactgtatgcgctgcagctaataaagcattacgacctaaatggggcgcagcacctgcgtgcgcaggtttacctttatagcgaatatcaatttttgtagtggaaagaaaatttcttggattagcaataacagtgcctgtatttgcgcaaaaactaatgtgtgaagaagcaaaataatctgcatcatcaattatgccactttgtgcaatggcagctgcaccacgaacaccttcttctgctggttgaaatacaatttttacttttccagtgagtttatctttgttctgagcgatccataatgcaacacctaaacctattgtaatgtgtgaatcatgtccacaagcatgcataaaaccatcgttaattgaggcaaaaccttctttatttggaatatgctctggtgagcgagtttccgttacattcacacagtctatgtcaaaacgtaatgcaatagttttccctggtttacctgaatcaaataatgccacacaaccagtgtacccttccattttttcgagccatttttcattggctccataggcttttgcattagctaagcctttatctactacggcttgttttcgtccacgaacaaagtctggatttataatttgtttgccaagaaaaatttcaaaacaatctaagtcttccaagtaatccgcaatgcgagaagttgtccaaaattcactccagccaatttctggaaaacgatgaaattcacgacgccatttaacaagttgatttaaatctaagttcatttttttcttcttttaaaagtctataaaaacagaccgcacttaaataaagtgcggtcaattttttactatttctacaacataaataatgctaagaataaaacagcaagtatcatgcctggtgcggtacgttttaccatttctactgggcttaccatcgcaaggcctgcacaaacaatagttacgcctgcaattggtgaagctgtacgaccaattgcaccagcaatggctgctgccataccaagatttatatgggtgtagccgagttctacagcatgtggcgtgacggcagtgttaaaggcaatcgctgctgcatcgccagagcctgtaattaagcccattaagaatggtccaattgttgcaccccaacgtacaaattcgttggattcttttaagaaagaaattgcagcatccactgcgcccgtagattttaatcctgccacaaatacactggctgcaatgataataccaagtacgtttgcataagaatttcccataccattgaaaaattcttcagtgatttttactggggaaatacgagtgacgataatgccgtaaattgcaccaattagcatcgcttgaggaacgcccattttagtccattcaagacccggtacttgttgtaatgatgttccaccaatcactaaaataactaatggtattaatggtgcaagggcataaagtacattgacgccttcaacaactttaatttcactttctttttgttctgcaagataagcttggcgatgttgttcaccataatctttaaaaacaagcgcaagaatggttaaaacaacagcacctattgctcccgcaatcatgttatatggagcatgtgaaaggtttacttgagtgatagttaatcctgacatttcactaatcattgctgagtgagaagaacccggactcatcattgatccaaaagtccctgctaaaatagctgcaccagcagtagctggtcgaacacccgcactttttaaaacgggaattaatgttgcgccaaccgcagcagcacaaccagcagcagaaggaatagcaatattgatgaaaaaggtaatgactgttgcaattggaattaagaagaattttaatccgcttaatggtttggtaagtaaatgcactagatgagtatcacattgagtgtatttcattacataagcaaaacccatactagaacagatagccataattaatccgccagatgtcatgcttttggcaaaagcatctaatgcacccattggattaagcgttagaatggacattattaaaccgacaccaatcaaaacggttcgggtttcggcttttttaatcagaaaataaattgtggcaataatgccaatcactgcaacgatggatttaaataattccattatatgttccctttaagttaataagaaaaagttgtattgatatcaaatgtgccacattccatattttcactgaagcacaaaataggattttcgcccaatacagttgccatttcattttgtatatgaagcgcagaaccttcaggtaatgcatatacaagtgcggttggattaacgagtaaaaattctgccaaacgttcttctcggctttcaccattgtggccttgcattttacctgaaataaagtgcggattaatttgatgaggaaaaagttgtaatgcttgaaatgaaggaggataagtaatcggcatatcattagttgtcataatagatgcgccagctacatttgccccagcactccaaccaaaataaggcgtaccgttatttactttttcacgaatgatatcaatcaaattgtgttcataaagctgttttaacaaacaaaatgtatttccaccgccaatagagatgacatctgcttgttcaataatatcccgatgctgtttaccatgatgaacggaaacaatattcatccctaaatcggaaagtgcattttgcacagttttttcatattcatcaaaagtgcggcttaccccagcataaggtacaaaagcaattgttttaccacgataatcagccaagaaattttgtaaccaaggtagggtgtgttcaagataacctgtgttcttgtattttgagctactgagcagtaacatatttttcatatttataatcctttttagggatgaaaagttattgctattatgcctaagctaaaaacaaaatccagcataaaagctggatttttatggattgcgtagcattattgatttagttgaaaacgatgcttttcaggaattaaaaatgacaaaagccaccttttaggtggccttgtctcaatattgtagggggggatgataatgctatcagtgaccaacgttccctatcgtcggggcggagtctatggttaaataattcaaatgtcaagtgataagtaggattatatgttatcagcaacgcaatttcttgttttagaaaaagcacttagtaaggaaagattatctacatacaaaaactatgtgaaaaataaaacttcagaaagtattaatgataacatggttgctttatatgaatggaattctgaaatagcgggctattttcttgaattatgtaatatatatgagatttcattaagaaatgctatttatagatcaatagattcgtatgatcattatggtatcagacagagacaaatacttagacaaagtcctaaattaagagaaaaagttgaagaattaggtagaaatgcgactgatggaaaaatcatatctagtttacattttcacttttgggaattttttgaagaagtttttcttgtggaattctcgtgagcttcacagaatgcctcttttgtatgcttatagaataatttcttttgaaaactcaaataaagataaggatatattatttattataaaagtcacaaagaatttaagagtgaacataagaaacagaatttgtcatcacgatcccatcttcaataaagatttaaagaaaattctgaaacaagttatgtgggtatttagtaaaattgattatgatttatacttagttattaacaatctatattccaataaaattatcaatcttttaaataagaagccaatctgactacaaatgtagaagatcaaacctcatctgacaaatcacaataaaaaatgagcatttcctgtttagtatatgagtgtcaaactcaatctaaacaggaaatgctcgtattttatttttacaacaggttagaattcaaactgaactgacattctatagtttttgcctggagcatagaaacgattaatacctgcacctgtttcttgattaatcaaattacttgtaccaaacatacgaattgaacgagcagaatcccaagtcatatattttttgtcaaataaattgtaaacacccgctcgtaaagttaaattcttcataggtttcacgaagaaagtaaaatctgtcactgtgtaagctttactacgccatttaatatgtttattttgaacatattctttatctcctgctgtagcatcttttgaataaatgttatatgtgtcactcgcttctttttgggaaacatgagtaagatataaatttgccccaaacagattatcaggatgcgtataggctaaactcatcacttgtgtcattggctgaatagcattaagtgggcggttatcgcttgctttacctttttgtttagttaattggtaaccaaaatcaacattcttcaaccatgatatccattttcctaatgtaaatttggttttcaattcaaatcctgtcactttagcattatctaaattaacagattgatataattcatgcttagttgcttgagaaccaaatgattttgttcctagataactaaaatcaataaaattattataatttgtgatgaaatatccaccagaaataaaaccgatttcatcatcatgtaaagttaatgataattccttagtttttgcaatttcaggttttaatttagagcctggaagaacagtaaattctgggtgcttgaatgtgaagtataattcatcagctgttggtgctctgaaacctttgctatattttgcttgaacttgtaaccaatccaatggatcgaattttgtgcttaaagcataagaactcgcattaaattttttgggttgagaaatataattaatattagcttctgcattttttcgtcgattaatttcatttggatcattagggtttagactccgtgtgttttttacaaaaggttcttttataaataaattaactaacatatcatcagggatttttggcgttatacccggttgataattggttttgtatttgactttgtcatatcgataaccgatatctaagccaagacgatcatttactctaaattcatctttaaaatagagagaaccatcttttgtttctacaggaataagaaatgatgctgtactattttttgtacataaatctgatgtactagattcacagtcttttggataatcaatccaccattttccactattaacttttaacccttctttatttatcattgattttgttgttttactccaaactaaaccataagataaatcatgttggctttttcctagttcaaaatgttttgttaaatccaaattaatttgttgagtacgagtatcaaggtcacgttttttccaaatgtttctattataaccaggtgaattaggtactagaaaacgagatgctttctctgggccaatattgtagccattttgatctgaaattttttcaataagtgcaaattttttaccttcttttgggattatttttattggtaaatccttaggcgttccatcagcttcgaaaccttgaattgtacctttatcacagttaattccatcacaagataataaattatcactattcgtgagccttgagttaataaaatactccttttttaaatcataagtgatgttattagctactaatgtttccttttcctcttttacatcagatcttagtctacacatcccctcgtgattagcatcaccgtgatttttaaagcagcgaggcgagtcaatataatattttccaccatattctttaagtttccattccttagcgagttctacaggaacttcttctttaaagttactgtatcgattaaagatagattcatcaatgtaagaatagtatgttacagaacgattttctaatttataggttacaggattattatttttatcaacaagtttattatcgttgttataatgtagtcctatggggttttgtaccccaggacaccgttcaccatcacaatgttcgtcacttcttgctcgttgagtaatactttgatctgtataagagagttttagggtatcccaaagtgggtttatatttgtattttcaaatgctatagatttactggttctaatgctttcatcatgagtatggcgagtatctatttcattatcatcacaaacatatttcgtgcatccatgtaatgagtaagatttgtctagacctttattttcaacccgtcttctatcataggctacggcaatgcgattattttcaccaagatttgtaccaattttcaataaaagactgcggtcttttttattataaggatcggtcttttctctgagttttcctagaatgtcgtctgcagatttgtaatcataatttttgatttcatgaccattacgccaagtgccgacagcaagtacatcgaatatacttgcttttcctgcaaaagtaatagaatttaatctttcatcattctcgctggtaaaaccagttttatatttaaacgcgtagtttttgttaagcagaagatctcttgcatctttagttttatagatgacggagccacccaatgcaccactaccagacatgagagaatctgcacctttggtaattttggcatcagataaagtttcaatttcaattccattacgcgtgttattaaaattaccatatccttcaaacaggtctttaaaaccttgggaagataatgtttctgcttgagcaacgccatcaaccgtaattgcaacacgattttcatctacccctctaatcgcaaaaccgctttgaccaaaacgcccagcttcaacaacagtaacgccagtctcgtatttaacgatgtctttaatgttgtttgcttgttctctttctagcgttttagccgtttttacagtttcggcaatttttggcggagttttcgtatcagtattttcggtagagccagatacatttatttgttctagttgttcagaagcattactattttggttggttggttggttggttggttggttggttggttggttggttggttggttggttggttggttggctctgcataagcaacacttgccgttagcccaagcataacggaataggcaagcacgtttaatctaaaattggtcatatttaatcctataaaaaaataataataattctcaaatatattatacgaggaagcattttctcacaacaataaagattgatttttgataaaaatcaagaaataaaaactattcttattattttctgtatttaaacctgcttgtttcctataatgcgagccgttgattgttgattagtagttgtagagtgggctttagcccaccaacaaacaatcgtgatattttggtgggctttagcccaccctacattaagtacgcatcattctatgcgtgcttctttttattttaggagcaatcattatgatgattttataaaggcaattcagttgttgatttgaccgtttttagagtaacttctgattttaaggttttaatgccaagcctagaattaagataggtatttttgactaattaaacactatataaagatacttgtactaccaataaaatggaaccaattagcaataagcatccaatcattggcatgacgaatttaacccatctatcaaatggaatatgcaacatttggagtgtcaccaaaactaatcctgtcggtgccaagaatagcattgcatattgtccccagttgtaagctgaaaccacgatatcgcgtggaatacccactgagtcagcaagtggcgccataattggcattgaaagtacggctaagccagaagaagacggcactattaaacctaggaaaataaatacgactaattggcctaagataaatacgctacccggcataccactaaccacattagacatataatcaaggatagtgtcagaaatcataccttgttcgagcactaagttcacgccacgagcaagaccgatgattaaggatacgcctactaattctgatgcaccttcagtgaaagattccacaacatctttttcagacaagccactaataaacataatgatgatagtaatggcaaggaaagatgcagccatttgagggaaccaccatccgccaaccattacaccccaaatcataatagggaatgagatgcagaaaagcgttaagattaatttgcgacgagctgagaatgggatagttgtgtttggatcaaagtttttcatataacgttgacggaattcttcgcgatcgtcgtaagtataagaaaagcttgggtcagctttgatttttttacagtaccaataaagatatgcgattacgcaagttgcccctaaaactaaacctagagcacggaaaccaataccttcagtaaattgaataccagccgcatttgatgcgataacaacggagaatgggttaattgtagagaatgcagttcccatagatgcagcaaggaatatagcccctacgcagactatcgcatcatatcccagagccaagaatactggcaccagaatcgggtaaaatgccactgcttcttcttcgataccacaggttgtgccgcctaacaccattaagacggatacgcagaatacaataaaaaactcattgcctttggttttcttcacgagagccatcaaaccagcattaaaagaaccagtacggttaatgacaccaatcataccacctaatacaaagataaagaccataacatcaacggcttcaatggtaccttctaccatacttttggtgatatcttcaatgcctttatggtgttgttctacacgttgataagtgccaggaatagcgattggttttttgatcacgccttcggtgaagttggagagtttaattttgatattgagattatcaagagtgtctgttgtggcgggataagttttatcatcaacgccataagctttgacgacaaaaacattatcagtagagttatatgttaattttgaatatgaaccggatggaataacccaggttaatccaacagcgagaattaagattgcaaataaaattgtaaacgctgatgggaaattaaacgttttcttctttttggacgcatccatagcgagttccttatgtttaacgtttaaagtgcggttggtaaaacattggttaaaccaaccgcactttttaccttgagaatggcttcccaaagttcctttattatttaagcataataggatatgccttcagcttttttcgtaatacgagtaccagctttgcctttcacaatgtccacaatatcagataaagatcctattactgcatcttttcctgtttgtttcgcaaagttgatcgcggcttgtactttcggccccatggaacctgaagcgaaaccaagttctgaaatggcttcaggtgaggcaactgaaattgctttttgattaggtttaccccaatctacgaaagttgcggaaacatcagttgcgatgatgaataaatcagcgtcaagattttctgcaagtaaagctgaacataaatctttgtcgataacggcttcaacaccttgtaaattatggtgttcatcataataggttggaatgccaccgccccccgcacaaattacgatactgcctttttcaagcaaccatttgaccggacgaatttcaaaaatacgttttggtaatgggcttggcacaacgcgacgatatttatcaccatcttgtgcgatagaccaatttttttcttttgccaaacgttcagcttcttcttttgtataaacaggacctattggcttagttggatttttgaaagctgggtcgttgatatcaacttctacttgagataataacgttgcaaatggcacttcaaatggaactaaattaccgagttcttgttgaatcatataaccaatcattccagctgtttctgctcccaatacatctaaaggataggttggcacatcagtataggcagcaccttgtaaggcgagcaaacccacttgtgggccattaccgtgtgctatcactaattcattatttggccaaatcttagcaatttgctcacaagcaatgcgaacattttgtcgttgattttcggctgtcattggttctccgcgtcgtaataatgcattaccgcctaatgcaatcactattctcatacgttctccttatgccaaacttgctaccattaccgctttaattgtgtgcatacggttttctgcttgttcaaatgcaatgttcattggcgattcaaatacctcttcagttacttcaataccattagctaattcaggatatttttcagcaatttgacgaccaactttggtttcgctgttatggaaggcaggtaggcagtgcataaatttcacttttggattaccagtgcgtttcattaattcaggtgtgacttgataaggaagtaataatttaatgcgttcgccccaggtttctaatggttcacccattgaaacccacacatcagtatggataaaatctacgcctttcaccgctttgtcgatatcttcagttacagtaatacgagctccactttctttcgcaaatttttcgcacatttccacaagatttgcttctggtaataatgctttaggtccacaaatacgaacatccatacctaattttgcaccaattaataaaagtgaattacccatgttattgcgagcatccccaatatatacatagctaatttcacttaatggtttgtcgcaatgttcaatcatggtaagtacgtcggcaagcatttgtgttgggtggaattcatcggttaaaccattgaatactggcactccagcataatcagccagttcttgaacgatactttgtttaaagccacgatattcaataccatcatacattctgcctaatacgcgggcggtatctttcatactttctttgtggccaatttgagaggaattagggtcgatgtaggtgacttgtgcgccttgatcataagcggcgacttcaaatgcacagcgtgtgcgggtggaggttttttcaaagatgagcgcgatatttttgccttttaatttttgttgttctgtgccggcatatttggctcgtttcaaatctcgggagagatctaagagatatttaatttcacgttctgtgtgatgaacaagactaagtaaatgtctatttttcatattgaaagccataataatctccttgtgttttgactatacattggggaataaacatacatcattcgagatactgcttgttgttcgaacagttgcattataagagaggtaaaatgaaatttgttgtcgtttttcaactggtaatgccagtatgtagaattttattgcgagatttttagtattattagaatttaataaaaataatctaactctttattgttatttgtttgatttctaatagtagatgaatttaaacgaaaatatgttttagtttatttttgatgaagaggaatgtgtctatctatacttaataaaagtgcggttatttttattgcagtttttaatatattgatcttcagcaagtaccatttgtatatttagtgatatgataaacatagtttattttttgaggtttttatgaatttaccttttcgagcaatggtgtctgatttagatggcacgcttttaacacctgaacatttagtgggtgatcttaccattgatacgctgagagcattagagcaaaaaggcgtagatattattttggcaacaggacgcaatcataccgatgtgtcatccattcttggaaaaattggtgcggaacgtgcggttatgattacatcaaacggtgctcgtgtacgggatttacagggtaatttgctttatagcaatagtttgcctgaagaattagttcttgagctttacaaaacgccatttgatacttccaaagtatgcatgaatagctatcaagatgaaggttggtttactaataaagatattcctgcaatgcgtcagttccataaagaatctggattcgattataacgttgtcgatttttctaaacatcatggacgtgggacagaaaaagtcttttttattggtaaaactccagaggatttagttgcagtagaaacttatttacgagataagtttggtgacgtaacgacaattgtttattcagcattagcttgtttggaagtaatgaataagaatgtttcaaaaggggatgcattaaaacatttactcgaatcacgcgagtatcagttaaaagactgtattgcttttggtgatggaatgaatgatgtagaaatgctttcttgggctggaacaggttgcattatgaaagatgctgatattcgtttaaaaatggcttgtccagagttagaagttattggctcaaataaagaagaatcagtcgctcgttatttgcgaaccctatttggattagattattaatgcaggcattattattcataagttatggtgcaatattaggcgcgtcattgcgttgggctataggattgttatttaatcctttattttcctcatttgcttttgggactttaatcgctaatttgcttggttgtttaattattggtgtattacttgggtttttttggcaatttccacaaattagttctgaatggcggttatttttaattacgggttttttaggatcgctaaccacattttcgtctttttcttccgaagttgtggaattattttttaatgacaagtggttaaatggattttgtgtattaatgatgcatttattcggatgtttagctatgactgtgttaggcatttggatatataaaatttgttctcaacttttatcttaatcccattcactttggttttgcccaattaaatcagcaaattcatcgctacgaaatccgtgtgatagcatatattgccaaattttttgtttcattttagacgtttgctgttcgttataatttgggaattttttacgtaacaagttctcagccatttcataccaatcaatttctgattccattaaaacttcatcaataatatcagaagacacaccttttaattggcgtaattcttgtcgaattcttcctacaccacaacctttttgtgagcgtgaatttagataattttctgaaaaacgacgatcgctttgccaattttttgcttggcataaagataatgcatcatcaatttcttcttccgaaaagttcttttcctgcattttattgcggagctcgaattcactatattctctgcgggaaagaagattaactatgtaattaaaagcaagagatgacaaggatttattccttcattttattgaatcgatataaagtgcggtcatttttaaccgcacttttggcatttgtaattttctttattcaaaatcactttctgattcagtattattttcagattgttcaatatccgccattaaggcttgttctggattggccactaattcagcacgtaaacgagcttctaattcatctgatttctctatattttcgttaagccatttcattgaattagcctttccttgaccaattttttcgccattataggaataccatgcgcctgatttttctacaagtttgtgttttacaccaagttctaataattctcctgcttttgaaatgccttctccatagagaatttggaaatccacttggcggaacggtgccgctaatttgtttttcactacttttacgcgagtttcatttccaataatattttcgccatcttttacagaacctgtacggcgaatatctaagcgaacagaagaatagaattttaatgcattaccgcctgtggtggtttcaggattaccaaacatcacgcctattttcatacggatttggttaataaacacaactagacagtttgcatttttaatttgacctgtgagtttacgcaaagcttgagacattaaacgtgcttgcagacccatatgagaatcgcccatatcgccttcaatttcagcttttggtgtcagtgcggcaacggagtccacaataattacatcaattgcacctgagcgaactaatgcatcacagatttcaagtgcctgttccccattatctggttgagaaacaaaaagttcttttacatctacaccaagttttgctgcataaataggatcaagtgcgtgttctgcatcaataaatgcacaggtttttcctgctttttgcgcttgagcaatgacggaaagagttaatgttgttttacccgatgattcaggcccgaaaatttctacaattcgacccataggcaaaccaccaatcccaagcgcaacatctaacccaagtgatccagtagaaatagactctacatccaacgttttggtatcgcctaatttcataattgagcctttaccaaattgtttttcgatttgccctagtgcagccgctagggctttttgtttttcttcttgagttgccataattaaaatcctgtttgaatgttcaaatttttgtgattatatctgtattgatgtacaggtcaagaaaaatatttatattaataaaaaaatatggggtatatatttcagtaaagaggatggggaaggcttaaaataaaagtttttaacagagaattagattaaattatatacaaaaataatctcagaaaaagttttaaatatagtatatttatatataaaccaatcgtttagataaaaataaattttaaatttacgatctggctcacaaatctgacatttatatttaggtgtagtaaaaatttcatgatataaatgaaatcagaagtacttctactgactcttttaaaataattattcattggaggtttaatatgaatataaaggatgagcatatagatagcgtttgctccttgttagatcagttagtaggaaatgtttcctttaaaaatctttttactggttacggtttgtttcacaaggaagagacaatgtttgctatttggcaaaataaaaaactttatttacgcggtgagggtgttctcgcaattcaattaactaaattaggttgtgaaccttttacaacgaatgaattgaataaacggtttgtgctttcacaatattatgcactttctgatcagattttacgtagtaatagattgtgtagaaaattgattattctttctattaagcagattcttgagcggaagctagaatgtacgttaagaaaattgaatcgattaaaggatttacccaatttaacgattaaacatgaaagagctttaataaaagttggtattacaaatgttgcgatgctaagagagattggcgcagaaaatgcattggtggaattaaagaaaagtggcagtggtgctacgcttgatttttattggaaattagtatgtgctttgcaaaataaaaatagtcagatgttaagtcaagctgaaaaagagcgtttattgaagaaattaaacgaagttttgagaaaaaatggcttaaaaggctatagaaaattagatgatgaataaaatttgttcattcaaataattttttgcaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttttaattttgaagtcttaataggtgcttaactgaaaattcatcattacttttttaagtagtgttttatttatagctaagtagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttagcaaatacataaatagaataaagcagagtagaataaaagataagaacccccagtcgaaaggctgggggtttttctatctttaaatttcaaaaaattagtaaaacagtatttgtgtttaccgattactcaatagcaatactgggcagagacggggatacctcttgtccttacaccagtaccttatttactaagatagaataaaaaataatcaatttactctcattataatgaacttaaagcaggagaaaagtgtatgcttatcccaatttttgaaaatggtaagaaaatatatcaagatagctctggtaataagtaccagtatgatttaaccaattcaatggatcaattctcttattctacagatctcagtgcacaaatgcgtgataaatcatctattacggcaacacgaaatccaaatggagggggaatttatgagtaatttctttaattctttattttctgataaaggagaaattaaaggtattgataatcaatattctgtatctgaaatcgtagatattcttaaggaagaaggttattctattaatgtaatacaagataattttttggtgtttagattacaaggtacgaatgttgtagttgttccccatgatggaggtgatattcaattttttatcatgtatgacgatgatgagaaccgcttttcattaagaaaagtgaataaaataaatattgattatagactcggaaaattttatttaacagatgatgataaattaggaatcgagcttcttttgcgcaatgatggtaatggtgtaactaagtctcaaattattcaaggactatcagatatttctttattaaatggattagctaagaaagaattttggtaagttattagttccatatcctaagatcaaatcaaatatgctgcaggttattttacatctgtcttagagggaattaaaaaagtctcccaaattcgaatattaatctaagccccatttggggcttttctacacattctttcttagctgtgctataatcccgctaaaattctacccttaaaaacaagagaaattatgaccgcacttaatgtattaatttatcctgatgatcacttaaaggttgtctgtgagcctgttactgaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgcggatggtttgcttgcgatctgtattcagcacgagatcgatcatcttaatggaattttatttgttgattatctttctccacttaaacgccaacgtattaaagaaaagttgattaaatacaagaagcagattgcgaaaagctaaaacgtagggtgggctttagcccagcaatcatttcaaaaaacggtgggcttaagcccaccctacttcctttttcctatcaattaccataacgtaggacattatgaaatcacttaatattatttttgcgggtacgccagattttgctgcacagcatttacaagccattctaaattctcaacataacgtgatcgctgtttatacgcaatctgataaaccagctggtcgcggtaagaaattgcaagcaagtcctgtcaagcaacttgctgagcaaaataacattcccgtttatcaacctaaatccttacgtaaagaagaagcacagtctgaattaaaagcgttaaatgcagatgtaatggttgttgtcgcttatggattaattttaccgaaagctgtattagatgcccctcgtttaggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagtattaatcgatgttttagataatcttgaaaacagtaaatttatagcggaaaaacaagatggcagccaaagtaattatgcagaaaaactttccaaagaagaggcacaattagattggtcacttcctgcaatgcaacttgagcgtaatatccgcgcttttaatccttggccaattgcctatttttcaacagaagacaaggatggcaatgcacaaactttaaaagtgtatcaagcggaagtgttgcctcatcaagataaaccagcgggaactattttaagtgcggataaaaatggcattcaaattgcgactgtcgatggcgtcttaaacttattgcaattacaacctgcaggtaaaaagcctatgtctgcacaagatttattaaatggccgtgcagaatggtttactattggtaaggtgcttgcataatgaaaaaattttcttctaaaactatcaaagtaaaaaattcagtaaaaatgaccgcactttcgaccagggctattgcagcaaacttaattttgcaagcattggatgaaggtaaatccttgtcggcgttaattccagaagtgcaactttctgtaaaagcccaagatttgcccttgctacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaagttgtgaacgcaacaaaatcattaaaatctgatagttttagaggattagtgaatgcggttttgcgtagatttttacgtgaacaagatgaaattttggcaattatcgataaaaattggcaaacgcttcatcctgaatggttcgtgaataaattaaaaaaagcctatccgaattggcgtgagatcattgaggcgaacaatcagaaaccaccaatgtggctacgtgtgaattcacaaaaaaatgccctcgaaacttaccgcactttacttgaggaacaaggtatttctgcaaaaacaagtcaccatcctaatgcgctatgtttagatataccgattgcggtgcaaaaattaccgcactttgaagaaggtgctgtaacggtacaagatttgagtgcgcaatgggcggcaatgttgcttgagcctaaaaatgaggaatggatccttgatgcttgcgctgcacccggtggtaagacgacccatattttagaactggcacctcaagctaatgtgattgcattagatgtagaatctcatcgcttaaaacgagtagaagaaaatcttgcacgtttaaatcagcaagcgatagtggtttgcggcgatgcgagtaaacctgacgaatggttagctgaaattggtaaaagtgcggtgaaatttgaccgaattttacttgatgcaccttgttctgctacaggggtaattcgacgccaccccgatataaaatggttacgcaaagaaaccgatatcgctcagcttgtcgaattacagaagaaaatcctgagtgcactttgggaaaaactgaagccaaacggtgttttgctttatgcgacttgttctgtattgccagaagaaaattgcgaacaaatccaagcatttttaaatgctcacgcagatgcggagttattgccattacctgttagtgatgataaaagtgcggtgggttttcaattcattccgcaaccaaatagtggcgatgggttctattatgctaaattgcttaaacgagcataaaggagagcgataatgaaaatcatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgccgtgacagcctccgatgaaatcaatatggtcgcttgccaaatgggctatacattatttaatacgccaacgcgaattgcacgtatccgtaattcagaatatttacgtgaaaaagacaagttgttcaacaatgaaaatatacctattgatcatttaatttcgcctgaaaatcttgtcactgatgaaattacgcgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgtattatgtctattttacgtaatggcaaaccgattcgtccacaaggctcaaccattgtagaagctggcgatgaaatcacgtttatttgcgctactgaacatattaaggcggtaatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaaccattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttagtttttttacttttcagagtgatttattataatagtcgctctttttatgtaatttttgaaggggaacattattatgaattttattaaagaatttcgcgaatttgcaatgcgtggcaatgtcgtagatatggctatcggtgtgattattggtagcgcatttggcaagatcgtaagttcacttgttagtgatatttttacgcccgtgttggggattttaactggtggtattgatttcaaagacatgaaatttgtattagcacaagcacaaggcgatgttcctgctgttactttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataatatttaaagaatgaaagttagcagaaatgctgactttttttattactattttttaagctataatcagccctcaattttagggaaataaaatggaaaaatataataaacttcgcattgaatgggattgtcgccgaggaatgttagagttagataaaatcataatgcctttttatttgaagcattttgatgaattaacagatgacaaaaaagatatatttattcgtttattagcaagtacagatctgcagctgttttcttggttttttaatcgtggtaaatcatcagattcagaaattcaatctatggtagagtatatccaaaacgtacaaaaaatcacaactaattaaaattattaagatacgtatgaacttttttcacacacctgtgtctgagattgcagcaagagcttgctgtcttgaatattaaggcgtgttagatattggcataggagaaatatggctgaacagctaacagatcaggctttggtagaaagagtgcagcaaggggataagaaagccttcaatttgttggtttcgcgttatcagaataaagtggcggggcttttgactcgctatgtatcacgtaacgatattcctgatgtggtgcaagaatcctttataaaagcttatcgctcaattgaatcttttcgtggcgaaagtgctttctatacatggctttatcgaattgccgttaatacggcaaaaaattatttaacggctcaaggtcgccgtccaccaaatgaagatattttggcagaagatgctgaaaattatgatgtgggtacgcacttgcgggatgtggatacacccgaaaatgaaatgttgtctagtgagttagaaagaattgtttttgatactattcataacttaccagaagatttaaaaaccgcgattacgttacgagagctagaaggtttaagttacgaagagattgcagaaattatggattgtcctgttggtacggttcgttcccgaatcttccgagcaagggaaatgatcgaaaataaaattcaacctctaatgtagagcgaataaaaattggagtttactatgcaaaaagagcagctttcagcctatatggatggcgaacaagtcaaaactgacttgacagatgctttattaagagacgaagaattacaagcgtcttggcattcatttcataccgttcgttcagtaatgcgtaaagaaagtgcggtctttttagggggggattttaccgctaaaatggcagatttgattgagttagaagacgtgaagaaagtcgatgtcattgcggtgtctcaacctgaaccagaagatgcacataattctgcatttatgcaaaaattaaaggcattttttgcgccaatgacgcaagttgctgttgctgctggtgtatgtttagtggcagtacttggtgttcaatctttcaatagtaaaaacgaagcgtctaatttacctgaggctccagtattgcaaaccttgccatttaataatgcggttcaagaggttagctataatgcgccaagtaaagatacattgacttcagatcagcttgagaaaaaaagtcgtcgtattggtgcaatgttgcaaaactatgaattgcaacgtcgtatgcactctgatgctagcagtcaagtaagataaattggtttcctttgttcagattattgattcaccacctaattgttatttagtgtggtgaatttttatcctttagatttctatgaaaaaaatcgcattaaaatttaccgcactttctctttctttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagcgcattatatagtgatggcttatttacttttacgttgtttgtctctaatgtaagctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttagataaaaagtgcggtaattttttacgatatttttatcaataactgattttgagttaggcattgactaagattcgcacgtttttacgtgcgaatttttattttcttaattttattaattctacttggtgattgtgacctttttttagaattagatttgctcgctcacgagttggaagaatattttgattaaggtttaacccgttaatttcatcccaaattttactagcggtggtaatggattcttctttcgataaattggcataatgtttaaagtaagaattaggatcgttgaatgcgctttcgcggaatttcagaaaccgtttgatataccattctttcaataatttttcttctgcatcaacataaatagagaaatcaacaaaatctgatacgaatgtttgattggttttattattacctgtttgaagtacattcaagccctctaaaataagaatgtcaggtttatttatcacattaaatttatcaggaataatatcataggttaaatgcgaatagattggtgcttccacctcagttttgccagatttcacatcagctaaaaaatgaataagtttgggcgtatcataagaaatagggaaaccttttttgtgtaaaagatgatctttttttagtttttctaatggatataaaaaaccatcagtagttataagatctactttgcgctccgctggccaatgggaaagaagtgattggagtattcgtgctgaagtgcttttccctaccgctacgctacctgcaatgctaatgatataaggtacttttgttttattacgccctaaaaaacggtgtaaaacagcttgtctgcgaaggttttcgtcaatgtaataattaattaaacgagctaatggtaaataaatcatactgacttcatccaaagatagctcttcattaaaacctaaaagcggtttaagatcttgttctgtaagttttagggggacagatttacgcaattctgcccattgtttgcggttaaaacttaaaaaaggggttagattcattgagatattattgagtcaaatagacaattggagaaaaatatacgctataaataaaaatttagcattcatttttcattaaatgtgcactaatttgattaaaaaatcacttttttgattgtgatttaaacgaataatcaaaaaaataaacttttttataaaaaatacttgtcagttaaagttttttccatataatacgcctcacttgcttacgacacgccgacttagctcagtaggtagagcaactgacttgtaatcagtaggtcatcagttcgattccgatagtcggcaccattctttcgtatcaagtattcatttagtgtggaggggttcccgagcggccaaagggggcagactgtaaatctgttggctcagccttcgaaggttcgaatccttctccctccaccatcttttagatggatcctgatgggacagacgaatttaggacttgcgggcatcgtataatggctattaccttagccttccaagctaatgatgcgggttcgattcccgctgcccgctccagacgctgatatagctcagttggtagagtgcacccttggtaagggtgaggtcggcggttcaaatccgcctatcagcaccagtcttataattcctcatccttatatcaatcagcaaataaatttattggttaatgtggtttaatttacccatcgataaccgtgtctatttagagggactatttcaatgtctaaagaaaaatttgaacgtacaaaaccgcacgtaaacgtgggtacaatcggccacgttgaccacggtaaaacaactttaacagcagcaattacaaccgtattagcaaaacattacggtggtgcagcgcgtgcatttgaccaaattgataacgcaccagaagaaaaagcgcgtggtattaccatcaacacttcacacgttgaatacgatacaccgactcgccactacgcacacgtagactgtccgggacacgccgactatgttaaaaatatgattactggtgcggcacaaatggatggtgctattttagtagtagcagcaacagatggtcctatgccacaaactcgtgaacacatcttattaggtcgccaagtaggtgtaccatacatcatcgtattcttaaacaaatgcgatatggtagatgatgaagagttattagaattagtagaaatggaagtgcgtgaacttctatctcaatatgacttcccaggtgacgacacgccaatcgtacgtggttcagcattacaagcattgaacggcgtagcagaatgggaagaaaaaatcctagaattagcaggtcacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggcgataacatcaagatgacagtaagcttaatccacccaatcgcgatggatcaaggtttacgtttcgcaatccgtgaaggtggccgtacagtaggtgctggcgttgttgcgaaaatcatcaaataattgatgaactcttgaatgtcttaaagataaaagacagaagaagtaaaaagaaaagtgcggagaaaattctccgcatttttttattctatatctgatactttgcttgagtatttactaaattatttgatttttatagtgatagctgtggtaaataattttcagtgattccaacaagttcttctattgatattaattttatcttgctactttgaggtaaaagtgcggtgagatttcttgctaaaatatcttgttttaatatcatgcaattccctttacatttggcaaaataatcaggatattttattgccaataacacaccgtcttgccatagtactaccgcatctttttctgtaatatatgaaaaatagtcatctagttcagttttgggataatctgattgagaaaatgtataaagcataatattccttagaaagtaaacaatttttctgcttgattaagcttttctagcaataaagagcggtcaattttttcacaagataggataagttctctattatctaatttaaatttctgcaaagacgctgtgcagataaagcgttgttctacatcatataaatctaataatttaaaggctctaatgaaatctttttgttgaatgatttcgggttgttggttatcgataagatttaatacgccatcatcgataaaaaatatcccaatatcattgggttcacaaaaagctgtcgcggcaagaattgcatctaagccttctcgtgaaatggatgtgccatgtggagatgtgcgaaataaaaaggctatcttcatagggttattactcgatctgcgtttaaacttgctgctataaattctccaagacctgcaattataaatccttctgcaagattgtagtgagctgtagttggtgtagttaagttatcaacaacacctcgtcgttgagatgctgcaacacataaatgtaaaggaacattgtgggtgatggaaaacatttgccaatgtttttgtaaattaacttcatcattggctggatacactaatgcatttccgttactcactccatcttggaagaaaaaaatctgtgagatttcgtgtccttttttgattaaggcatttgcaaattgataagctaaaaatgccccttgctttccgtaaatagggcttttgacggcgataacatagcgcattattcttgctcttgtttgatttgacggatgtacaggtaaaccgtatgtcgggaaatatctaaacgttcagcgactaaattaatcgcatctttaatatcaaaaatacctttttcgtaaagagaaaggacgatttgtcggtttttagtattattggcaacagcgcgatccgcattgacttcttctattgttttttcaatagtctgcgcaaccaagtcttccactgaattcgcaaagttcactgaagatgtttcattcgtatgctccgttggcataaagcattgcaaaaattgagacatgggtacatctaaattgatattgatgcaaagcaaaccaataatacgttgagttttattacgaatagcgatagtaactgatttcatcagtacgctgccttttgctcgtgtaaaataaggttttgaaacactttcgctttgcatatttcgtagcgaacgtaaggcaagatcagtaattggcgaaccaacttgtcgattagtgttatgtccgttggcaatacaaatagcagaatgttcaatattttccagagaatgaagcactatttcgcagtgctcgccaatcagtgcgctgacaccatcaacgactgctttgtaggaatttatgatagcttgatcttcatcagtgaaaggatatttatcgtttaatgtcatagcgttaggttaaaagtgcggtaaaaattccgctcgttttttataataaaaagcacgcgttaaagaacgcgcgctattaaacttatccgttatttttcagatttcggattgacgtctaatacttccacatcaaaaattaatgttgaatttggtggaatagatgcgccagcaccttgttcgccatagcctaattcaggtgcaataactaattgaatttttccgccttttttcactaattgaagaccttcagtccagcctttaattacttgatcaagttggaattctacaggttgtccgcgctcgacagagctatcaaatacttttccatttggtaatttacccgtgtaatgtactttaaccgtatccgttgatttgattgtatcgcctttacctgcactttcaattttatacattaaaccagattgcgtcgtttttacatctttccctttagcaaattcagcacggaatttatcgccttcttcttttgcttgtttagcaatcgcttctgcttttgcttttgatgcagccactaattttgcttcaatagattctaaggttttttggattttttcatctttacgaacatccactttgccttctaaagcatcttttaagccatctaaaatacgcgcattatcatatttaataacttctttgtgggaatcaacaagatctttcatttgactgcccatgagcgtacctactgcataagatgccgctttttcatcgaatgtgttatcttctgcaaaaacttgaccagaaattaccgcacttaccattaatgctgcgatagataatttttgaatttttaacatataagttaatcctttataatgaatggaataatacgaggaatagattaaatggctttctatctattctcaacttttttttagaatttagagaaaatttatgcaaattcaacaaatgttagaaaatcgcatcgaagaacttgaaatgaaaattgcatttcaggaacagttattagatgaattaaatcacgctttagttcaacagcaatttgatattgataaaatgcaagtccaattgcgttatatggcaaataaattaaaagactttcaaccgtctaacattgcaagtcaatctgaagaaacgccaccgccccattattgatttttgcaataaattcgtacaaatgaaaagggcgcttaatgcgccctttaaattacattctcaaataataatcagctaaatacttgcctgcttatgcaaagtatttttccaaatcgtcgctaccgccaatgtgtttaccaccgataaacacttgtggaacagtagcacgacctgaaactgcacgtacgctcacgattgttgcatcgtgacctaatatgatttcttcaaagcttaagcctttatcgtgtaaaagttgttttgcttttgcacagaaaggacagccaggttttgtaaagattgaaatagactcttgcacttggtgttgtggtgcaaggtatttcaacatagtgtcagcatcggatactttgaacggatcgcctggttcgtttggttcgataaacattttttcaactacgccgtttttcacaagcatagaataacgccatgaacgtttaccgaagcctaaatcttctttaccaactaacatacccatgccttcggtaaattcaccattaccatctggaatgaaagtgatgttttcagatttttcatcttctttccatgcgttcattacgaaagtatcatttacagatacaacaagaatatcgtctacaccgtattttttgaatactggcgctaattcgttgtaacgtggtaagtgtgatgatgagcaagttggagtgaatgcgcccggtaatgagaacacgatcactgttttgttatcaaataactctgaggtagttacatcaacccatttatcaccctgacgagtgcggaatgtcacttgagggactttttttccttccatactagacattgttttttctcctattggttgttaatttaaattttacgtgctgtattatagggaaaattatgatatagtcataatcaattaattctattcttttaattgaatttttctatagggaaaatctcatgaatatccgtgatctagaatatcttgttgccttatctgaatataaacatttccgccgtgctgccgattcttgtaatgtgagtcaaccaacattaagtgggcaaattcgtaagttagaagatgagcttggtattattttgttagaacgtactagccgtaaagtgttgtttactcaatctgggatgttattggttgatcaggctcgtacagttcttcgagaagtaaaattattgaaagaaatggcgagtaatcaaggtaaagaaatgaccgggccattacacatcggtttaattccaacggttggtccttatttgctcccttatattgtgccaatgttaaaagcggcattccctgatttagaagtgtttctttatgaagcgcaaacgcatcaattattagaacaattggaaacggggcgtttagattgtgctatcgttgccactgttccagaaactgaggcttttattgaagtacctattttcaacgagaaaatgttactcgccgtatcagagcatcatccttgggctcaagaaagtaaacttccaatgaaccaattaaatggtcaagaaatgttaatgcttgatgatggtcattgtttgcgtaatcaagcgctagattattgcttcactgctggtgcaaaagaaaattcccatttccaagcaactagtcttgaaactttgcgcaatatggtggcagcgaatgctggtatcacttttatgcctgaattagcggtactgaatgaaggtacgcgcaaaggtgtgaaatatattccttgttattcgccagagccatcacgcaccattgcgttggtttatcgtcctggttcgccattacgtaatcgttatgagcgtgtggcaagtgcggtcagcgatgaagttaaatctattctagatgggttgaaataatggctggtgttcgtgctgttcaaaaagaaaagactcgtcgcgctttagtggatgcagcatttaatcaacttagcgcagaaaaaagtttttctaatttaagtttacgagaagtggcgcgcgaggctggtattgcgcctacctctttctatcgccattttagtgatatggatgaacttggcttagaaatggtggatgaagcaggtttgatgttgcgccaattaatgcgtcaagcgcgtaaacgtattgatgcgggcggtagtgttatttctgtttctgtggatacattttttgaatttattactaatagcacgaacgtttttcgcttgttattacgcgaaagttcaggcacttctcaagcttttcgtactgcggcagcacgcgaaattaagcattttgttgatgagttagcagaatatatttcctacaaacatcaatattcgcaatatgttgcttatgttcaagcggaaggcatcgtaacaatcgtattcactgcaggggcgaatgctttagatatgagtaaagctgagcgtgagcaacttaaagctcgtgtgattttgcagttgagaatgcttgcaaaaggtgctgattttgcagcgaataaggaaagaggcaagtaagatagtttatatctagcctattagttttctctttgtgcttaggtatttgctatcttttattcttccaagttatttttcataccaaattttatttatataaagggtaataaatcctgatggcgtttctacccgcacttcgtcgtctaatgtttttccgattaaagctcgagcaactggggaatcaatggatatccaatttttcgcaggggcaaattcatcacaaccgacgatacggtattgcttaatttcaccttcttcattttctaattccacccacgcaccgaagaaaacttttccctcttgctttgggttgtaatcgacaatttgtagcacttccaatcttttagttaaaaaacgcacgcggcgatcaatttcacgtaaacgacgtttaccataaatatattcggcattttcgctacgatcgcctagcgcagctgcatctgaaacggcttgagtgacttttgggcgttcttctttccacaaaaacttgagttcttggtcaagcacaagccagccttgacgggtaatataatttgattttgccataataaaaataaaagaaagttttttgaattatatttgagccagcccactaaaaccagtattctatctttgtttttttataataaagaagtacgacaatgttaaatcaacaaattagccaaattattgcggcagaattaaccgttcaaccccaacaaattcttgctgccattcaattattagatgatggcaacaccattccatttatcgcccgttatcgtaaagaagccacagggggcttagatgacacccagcttcgccattttgaaacccgtttaatttatttacgtgaattagaagaacgtcgtcaaaccatcttgaaatctattgaagagcaaggaaaattgaccgatgaattgcgtgacaaaattcatgcgacacaaagcaaaaccgaattagaagatttatatttgccgtacaaacctaaacgtcgcaccaaagggcaaattgccattgaagctggtcttgagccattggctaatttactttggaatgagccaaaaaatgatccagaatcaaccgcactttcctttgtggatgctgataaaggcgtgacagacaccaaagtagcccttgatggtgcacgctatattttaatggaacgttttgctgaagatgcaggtttattagcgaaagttcgtgattatttagcgaaaaatgccgttatcgtatccaaagtgatcgaaggcaaagaaacggaaggggcaaaattccaagattatttcgatcatcaagaattattgaaaaatgtgccttctcaccgtgcattagccatgttccgtgggcgtaatgaaggcattttacaacttagcttaaatgcggatcctgatgcagaagagggaagtcgccaaagttattgtgaagagattattcgtgattatttagatgtacgtttcactagccagcctgcggataaatggcgtgagcaagtgattgcgtggacatggaaaatcaaagtttcgttgcatttagaaacagaattaatggcgagtttacgtgaaaaagcggaagaagaggccattgatgttttcgctcgaaatctgaccgcacttttaatggctgcccccgctggcgcaaaaagcactatgggcttggacccaggcttgcgtacaggggttaaagttgcggtggtggataacacaggtaaattattagataccaccaccatttatccacacacggggcgtgaagctgaagcgcaagtggcgattttcagcttaatccgcaaacataacgtagaattaattgccattggtaatggtacggcttctcgtgaaaccgaacgctttgcgaaagaagtgattaaagaaattaaagaaaataaacctcaaaccgttgtagtgagcgaagcaggtgcatccgtttattctgcttctgaatttgccgcaaatgaattccctaatttagatgtatctttacgtggtgcggtatcaattgcgcgtcgtttacaagatccattggcagaattagtgaaaatcgaacccaaagccattggtgtagggcaatatcagcacgatgtaaaccaaagccaacttgcacgtaaacttgatgcggtggtggaagattgtgtaaacgcggtaggtgtggatttgaatacagcatccgcgccattgcttgctcgtgtggctgggatgactaaaaccttagcgcaaaacattgtggaatatcgtgatgaaaatggtcgttttgaaagccgtagagaattgaaaaaagtgcctcgtttagggccaaaagcctttgaacaatgtgcaggttttatgcgtattgcaggcgggaaaaatccacttgatgcttcaggtgttcacccagaggcttatcctgtggtcgaaaaaattttgcaagctaccgcgcaatctattcaagatttaatgggtaatgcgggtgtggtacgtcagcttgatgcaaaacaattcattgatgagcaatttggtttaccgaccgtccaagatattttcaaagagttggaaaaaccagggcgtgatccacgtggcgagttcaaaaccgctgtatttgctgagggcgtggaagaaataacggatttaaaatctggaatgattttagaaggaacagtgactaatgtaactaattttggcgcatttgtggatattggtgttcatcaagatggtttagtgcatatttcatcattaagcgataaattcgtggaagatcccctccaagtggtaaaaacaggcaacattgtaaaagtcaaagtgttagaagtggatgtgctgcgtaaacgcattgcattgacgatgcgattagatgaaagtgcggtcaaaaatgacggtaaatctgaccgcactttatccgcaagacctcgtggaaatacgcagcgagaggcgcgtagttcaagaggtaataatgcgatgggcaatgcctttgctgatgcgctaaaaaattggaaaaaataacaagttatagggcgaaattattcgccctttttttatcgctttcctttcccgaaaagcatcgccaaaacggcgattttttgctataatctcgcccaatttttatttacaaaagaatgagataaattatgtcagaaacgaccaatgataactatggtgcatcgagcattaaagtattaaaaggccttgatgcggtgcgtaaacgtcctggtatgtatatcggcgataccgatgacggtactggtttgcaccatatggtatttgaagtggtggataatgccattgatgaagccctcgctggccattgttccgatattatcgtgacaattcacgatgataattctgtatcggtgcaagatgatgggcgcgggattcctgtggatattcatcctgaagaaggcgtttctgcagcagaagtgattatgactgtgcttcacgcaggcggtaaatttgacgataactcttataaagtatcgggcggtttacacggcgtgggcgtatcagtggtgaatgcgctttctgataagttacaattaaccattcgtcgtcaaggtcacgttcacgagcagttttatcatttaggggagcctcaatcgccattaacagtgattggcgaaacagaggcaacggggacaacggttcgtttctggccaagctcagatatttttgctatcacaacctttgattacaaaatcttagcaaaacgcttacgcgagctttctttcttgaattctggcgtatctattcgtttaatcgataaacgtgatggatctgaagatcatttccattacgaaggcggtattcaagcattcgtagaatatttgaacaaaaataaaaacccaattcatccaaagccattttattttaccgctgagaaagatggtattggcgtagaagttgcattgcaatggaatgatggtgtaaatgaaaacgtgtactgctttaccaataacattcctcaacgtgatggcggtactcacctagctggtttccgtggggctttaacccgtagcttaaatagctatatggaaaacgaaggcatgctgaaaaaagaaaaagtggcgacttcaggcgatgatgcgcgtgaaggtttggtggcgattatttccgttaaagtgcctgatccaaaattctcatcgcaaacgaaagacaaactcgtgtcttcagaagttaaaagtgcggtggaatcagcgatgaatgaaaaaatgcaggaatatttattagaaaatcctgcagatgcaaaaatcattgtaaatcaaattattatggctgctcgtgcgcgcgaagccgcacgtaaagcgcgtgaaatgacgcgccgtaaaggggcattagatattgcaggtttaccgggtaaacttgcagactgccaagaaaaagatcctgcgctttctgaactttacttggtggagggggactccgctggtggttctgcaaaagttggtcgtgatcgtaaaactcaagcaattttgccattgaaaggtaaaatcttaaacgtagaaaaagcacgtttcgacaaaatgttgtcttcccaagaagtgggcacattaattactgctttaggctgcggcattggtcgtgatgaatataacccagataaattacgctatcatcatattattatcatgactgatgctgatgtggatggttctcacattcgtacgttgcttttaacgtttttctatcgtcaaatgcctgagctgattgagcgtggttatgtttacattgctcagccgccactttacaaagtgaaaaaaggaaaacaagaacgctacattaaagatgcggatgaaatggagcaatatgaattaacccttgctttagatggcgcagaattacatatcagcgcaaatgcaccagcaatgaatgcccttgtatttgaaaaattggtggcagaatataacagcgtacaaaaacttatcggtcgtttaaaccgtcattacccagtgcctgtattgcaaggattaatttatcagtcgccaatttctattgaaatgatgaaagaggaaagtgcggttgaaaattggggtaaatcttttgttgaacaactgactgcaaaagaaacagaagcgcatcaatattcagtgcgtacacaatttaatgcggaacgccaagtgtatgaagcggtgattactgttcgcaaacacggtattgataccgattatttcttgaattttgattttgttcacggcaatgaatacgcaaaaattgtttctcttaataaacaactcaatggtttattagaagaaggcgcttatgtcacacgtggtgaaaaagtacaaccagtgcgtagttttgaacaagccgttgaatggctagtgaaagaatctcgtaaaggtcttgaagtacaacgttataaaggacttggggaaatgaatgcagatcaactttgggaaaccacaatggatccaaattcacgtcgtatgttgaaagtttctattaaggatgctgttgcagcagatcaactcttcacgaccttaatgggagatgaagttgagccacgtcgtgagttcattgagctgaatgcgttaagagcaaatttagacgtgtaaattttcgtctatttatattcaattcatgactgaaagggcaccaaagtgccctttctttgtttatcttgttatttcatataaggattactattggttttttgaacttaagtgagtaaactaaatgcactcattttctcaacggagaacctttatgaaaccttatcttatcgccccatcaattctttctgccgatcttgcacgtcttggcgatgacgtacaaaacgtacttaatgcaggcgcggatgttattcattttgatgttatggataatcattatgtacctaatctcacttttgggcctgcagtatgtcaagctttacgtgattatggcattaccgcaccgatagatgtgcatttaatggtaaaaccgatcgatcgcattattcccgattttgctaaagcgggtgcgaactacatcacttttcacccagaatctagcgaacatattgaccgctctttgcagcttattcgcgattgtggttgtaaatctggattagtttttaatcctgcgacgccgttgagctatttagattatgttttggataaagtggatgtggttttattaatgtcagtgaatcctggatttggcggacaatcttttattccagcaacattgaagaaattacaacaggctcgtaagatcattgatgaaagtggttatgacattcgtcttgaagtagatggtggcgtgaaggttgataacatcgcagaaattgccgcggcgggtgcagatatgttcgtggcaggttctgcaatttttggtaagccagattataaacaagttattgaccaaatacgtacacagttagcaagtgttagcgcataactgttattttaataaaatacgatcgtaatagaacagagaaaaacaatgaacacacaatttaaacttattggctttgatttagacggcaccttggtaaatagcttgcctgatttagcgttatccgtaaattctgccttggctgaatttaatttaccgaaagcgccagaagaattagttttaacttggatcggtaatggcgcgcctgtattaattgctcgagcgttagattgggcgaaaaaacaaacaggaaaagtgctaactgaaacagaggttaagcaagtaacagaacgttttaatttttattatggcgagaatttatgtaatgtcagccgcttgtatccaaatgtaaaagaaactttagaaaccttgaaagaaaaaggctatgtcctagcagttgttaccaataaacccacaagacatgttcaacctgtgttggcagcatttggcattgatcatttatttagtgaaatgttgggcggtcaatccttacctgccattaagccacatccagctccactttattatttatgcggaaaatttggttttgaaccacgccaagtgcttttcgtgggcgattctaaaaatgatattatcgcggctcacgctgcgggctgtgcagttgttggtttaacttacggctacaattacaatatccctatcactgaatccaatccagattgggtgtttgatgattttgcccagctattaacgattctttaagtttcttatctaacaaaaaagtgcggtgaaaattgatctgcaccccaaaagttggactaaccaaaccaacaattgaggggcagattttttatgggtaaacactacacaatcgaatttaaattacaggctctccaacctattttgaatggaaaaatgagtattagagaagcggctcgtttttacaatattccttccaacgccttagtcgggacatggttgaaacggtttgaaaaaagtggcataaatggactgattccccgtaaaccatcaggacgaccgccaatgaaacccaaatatgccagaatgccaccgccacccaaaactgaagaagaccgtttacgtttgagaattttacagcttgaagcggaggtagcctacctaaaggagttgagaaggctcagacttcaggaagaagccgagcaacagaaattatccaaaggttaagaacacgctatccgttaaaatggcttttaggctttgcacggttagcgcgtagtacgttttttgctaaacttcagattaaacgagataaggatgagccgctgaaaaaggccattaaacgcatcaaagccaatcatcctgattatggctaccgacgtgttcatgcctatttgccaggtgtgaatcatatcgtcgaatcttggctgaacatggcatcattcaaagtatgtcgagaaaagggaattgcttggacaatgcagcgatggaaagtttctttgggcgattaaaaacggaatgtttttatggttgggaatttaacagtagagaggagatagttgatgccgtcagggattatttgggttactataatcaccgacggattcaactaaaattaaaaggactgagtccgatacaatatcgaaaacaatcctttaaataacagtctaactttttgggggcagatcaaatctgttacttactattggtatttcagttaataaattatttggtgttgtccgtagttcctctggtaatgttgattgtttactcttatggaaacaagctaaattaaagtccattccaccaagagatttctcctgcttaaagtagttatttttttgataacgttcagaaataaaccaataacacttataaccaatcttatctaaataggatatcaactcattagagtgatgaatatgagcttctacaaaaattataggcttatgtctctctatgagattctttgcaccatttaaaacatttagctcaaatccttcagcatcaatttttaatagatctatatcttccaatcgattaacttctgggtgtttatctaaagaaataacatgtatcaattccttagattctacacctataaaattaccctcggtactaaaccctttatctaatgaaaaacttccataattccaagcagtatcataatttgatgagggaatctcaatcaactgttcattttcaccaacccccaaattataggcatgaacatttgttaattgattaagcgacaaattcgcacaaagtgtctgaaaaattactctttgaggttcaaaacaaaataatttccccccccccccacttattgtctttgcaataggaactgcgtgcattccaatattcgaaccaacttcaatgacattacttgaagaatttaggttttccaaaaaaaattggacttctacatctgaccattcgccataaagtgcagcatattggctaataaaatccccttcaataagattaaaggttccccactttaattgataaatagatgttttcataaataatattccttagatttaaattaccgatactataacaaaaacagaactctttgtacgataaaataaataaaggaattaatttttaatcatccgtacaaattactctatacaaattctccgtacgacttacgaatctcttatatgttatctttcaactgcactttttcatcgcattttgctgtatttcacggtaaaccatctcaagttttcagaaataataggtaatttatgcgtcttttcattggaattttagtgggtgtttaaaccattctctttggcagattttcgatggaaaatgcggcactttactttggtattgcgagtagtggaaccccttagtcaatggttgaaagcctttcggaaaaacggtataaatgggtgccatcccaaacctaaaggtcgcccaagtatgaaacccaaatacgctaaaatgtctccaccacccaaaacagaagaacgtttacgcctacgcatccttgagtgagaagcagaggttgcttttctaaaaaagttggacgaaataatcaagagggacgaagctaaacggcagaaacagtccaaagtttgagagtgcattatccttatagattaagtcgtcgcccaaatggcatgttagtgcaagaaatgttgttacaagcggtgaaaaaattacagagaaatgcgaatttgatattacattcagaccaaggaatccattatcaaatgcttagctatcaacgcttattagcgaaaaataggatttctcaaagtatgtcgagaaaagggaattgcttggacaatgccgcgatggaaagtttctttgggcgattaaaaacagaatgtttttatggtagggaatttaacagcagagaagagatagttgatgccgtcagggattatttggattactataaccaccgacggattcaactaaaattaaaagggctgagtccgatacaatatcgaaaacaatcctttaaataacagtctaactttttggggtcagatcaatttttaccgcacttttgttatctacttaattgattttaaagaatgtttgaaaattcttctaacatttcttttggccatacgcttgattgcacttcaccgatatgttttttacgaagtaaaagcatcgctaagcgagattgaccgataccaccgccgatagttaatggcaatttcccgtttaataaatcttggtgccaatccatttttaaacggtcttcatcgcctgttaagccaacttgtaaacgtaatgcactttcatctacgcggatacccattgaggatagttcaaaggctttgcctaattggtcgttccataccaaaatgtcgccatttaagcctttgtagccattttcagattctgttgtccagtcatcatagtcaggtgcacgaccatcatgaggtttgccatctgaaagtttgccgccaatcccgattaagaatactgcaccgtattctttacaaattgcgttttcacgctctttactgcttaaatctggatagcgttttactaaatcttcgctatgcacaaaggtaatctgttttggaagaatggaaggaatatcaaaacgtgcttctacggctaattctgttaaacgaatagcacgataaatagaatttaccgtttcttttaagtatgcaaaattacgacgaccttcaggaatcactttttcccagtcccattgatctacataaacagagtgcgttggatcaagagaatcttcatcgggacgcaatgctttcatatgaacaaacaagccttcgtcttctttaaagttgaaacgagctaatgtatggcgtttccatttcgcaagagaatgcacaacttcaaatatggcatttggaatacatttcacattaacctgtacggctttttcaatgcctgataagttatcttgcattccgttacccacttggctcaaaattgggccttgcacttcaataatgccaagttgctcaataagattttgggtaaaagtgttcttcacaaagctgatttcttgttgttgtaaaataaatgtctttttcattttgataaccttttttaacgaggagtaatatttttgagtattattcagtaaataatgattttatttcaagtattttatttactttcttttcttggttaaatatcatctaattcattgtgaaaaaattaaataaaatctaaaggaggaagttttatgcacaacattgatagtttagatcaaaaaatattacgtgtactcactaaagatgcgagaacaccatacgcagaaatggctaaaaattttggtgttagtccaggaacgattcacgttcgggtcgaaaaaatgcgtcaatcgggcattattaaaggcacaaaagtaattattgatgaacgtaaattaggctatgatgtatgttgttttatcggcattattctaaaaagcgcaaaagattatgaaaaagtgatcaaaaagctagaaagttttgatgaagtagtcgaggcctattatacaacgggcaattactcgattttcttaaaggtgatgacacacacaattgcagaattacattccgttttggcgaccaagattcagttaattgatgaaattcaatccactgaaaccttgatttcaatgcaaaatccaattttgcgagatattaaaccttaagaacatagaaagtgcggtgaaatttttattcaaatttatcttggtgtttaaatttcaataaatctctccgctcttttttatttgggcgacgatcaggatggggcattgaaagggaattattttttcttgcccacgcgatttcttctctttttttcacgctactttcggtttcttgatagagtaattgtgcttctggcgcacctcggcgttgatcgcttaaggcgataatttttatttctttttcttcgtttccctggcgaagttttaacattgcgcccacttccacaattttacttactttcgcacgttgattgttgtaatgcactttaccactttcaatcatcgctttagcaatgctccgtgttttgtaaaatcgggcagcccacaaccatttatctaatctgacttctttttctgccattattttctccttattttgattcgacaaaatagtaccacaaagtatgctaatgaactgttattaaaaattttattctttaataggatttttattaaatgaaaaaaaataaaaacaggttaatttaaacatttttcaataaaacaaattttatgttaaaaaaacttgaaaaatagtcaaatttttgacaaggttgagtggttttctttttttaagctcaaggaacaatttatgcataacgaaaacttaaaagaattgaccgttcgaggaattattctcggtgcattgattacggtaattttcactgcatccaatgtgtatctcggtctaaaagtgggggtgacatttgcgtcatctattccagcggccgtcatttctatggcagtactcaaatttttcaaagattctagcattcttgaaaataatatggtgcaaactcaagcatcttcagcaggtacgctttcttctgtgatcttcgtcttgcctggtttattaatgatgggctactggcaagattttccattctggcaaacgatgttgatttgtgcagctggtggtacattgggcgtgttattcactattccattacgccgtgcaatggtggtaaatagtaatttaccttatcctgaaggggtagctgctgcagaaattttgaaagcaggtaatcatgcagatggcgacagcggtgtgaaagatattgcttacggtggtgttttagcgggattagtggcatttttaactaacggtttacgcgtgatggctgatggtagtgcttggattcaaacaggaaaagcggcgttccaattaccaatgggcttttcacttgccttactcggtgctggttatttaattggtattgtcggcggtattgcgatgttaatcggtgttattttgacttggggtgtggcagtgccatatttcacaatgtcagaagatattgccgcggatgcaagtttaattgattctgcgatgactgtttggaaaaccaaagtgcgttatattggtgtgggtacaattggtattgctgcgatttggacattgctgattttaatgaaaccaatgattgaagggatggttcattctttccgtatgctgaaaggtgggcaagaggcatcagaacatcgtattgatattgacctttctccaaaaacaatgatttatatcttaattgcgacggttgcgttaattgttatttcattacatcactttattgcggcggcaccaatttcgcctgagctttccattttattagtggtagtttgtactttcttagcggtatttatcggcttctttgtggcagctgcttctggttatatggcaggtttagtgggttcatcttcaagcccaatttctggtatcggaattatttctgttatcgtgatttcattagtattggtgtcaatcggtaatgcctcgggcttatttgaaactgtagatggtcagaaatttttaaccgcacttacattgtttacggcatctatcgtaatcactacagcttgtatttctaatgataatctacaagatttaaaaacgggtttattagttgaagcaacaccttggcgacaacaagttgcattaattatcggctgctttgtcggtgcacttgttattgcgccagtattagaaatcttatatcacgcgtatggtttcagtggtgcattgccacgtccagatatggatccttcacaagccttatctgcaccacaagcaacgttaatgaccgccatttctcaaggtattttcacaaataaattggaatggacttacatcttaactggtgtgggtttaggtgctgtgttaattacgattgatgcatttttgaaaaaagtcagcaacaaagtctttagcttgccagttattgctgtggggattggtatttacttaccaccatcaattaatacgcctgtgattgttggtgcattcctagcgtggattatggctcgccatattgcaaaacttggtaacaaagaagtgtcagctaaagcagaacgtttcggtacgcttttctctgcaggtttaattgtaggcgaaagtttaatgggtgtcattttagcattcattattgcggcttctgttaccactggtggttctgaagcgccattatccttaaatcttgaaaactgggatacaattggcgagtggttcggtttaatcgtatttatcgtgggcattgtgatttttgcatctcgcgtattacgtgcgaaaaaaatctgattaatccttaaatttattttagaataggttatcttctggataacctatttttcactatgaaatcttacttaaaaacacttattttttttcctctgattttacagatagtcgtcaccgcacttttgatttggttcgatgatgactcaagtggcgttatcgttcctttttctagctatgctctcacagcatttcttctcgccacaattcccgcatttttaaccgcacttttagccgcaaaattccgttacacacgttataacattgcttcgattgtattagtttcatcgatcatttcatttgtttattgcaatatggcatcttatttttatttgttattactcggcgaacaagacacttccttttggggctggttgaccgaagggggattgtccctcgggttaataagcacatgcggaatggttttttatgctctatttgtaatgccttggttgctgccaaaaacaagagaataattttatgctgacgctaaacgaacatttacttaaccaagtattgctgattgcttaccaagcgggtaagcatttgcaacagttttatcaaaaacaggttcatgttgaattgaaagaagacaacacgcctgtgacggaagcggatctttttgtgagccaatttttaaccgaaaaattgaccgcacttttccctaatgtccctgttctttcggaagaaaattgccatatttcctttgaagaacgtaaaaattggaaagaatattggttgattgatcctcttgatggcacacaacaatttattaatcgtaccgatcaattttctgtgttgataaccttagttcgtaaaaataaacccgtgttaagcattattcatgcgccaattttatcaataacttattatgcaatgcgtgatttcggagcgtttaaaaaacaactggatcaggtaaaaaaactcactaaaaacacgacgaattttgaccgccctttacgaattgcggtaggtgcaaccacttcacaagaaaaagtgcggtcgattttgccgaaggattttacttgtgaatttgttgtggttggttcaagtagcttaaaaagcggtttggtggctgaaggtgcagtagattgttatgttcgtttaggacaaacaggcgaatgggataccgctggcgcagaagtgttgctgaatgaaactcacggtgccatttttgactctcattttgagcctttaacctataaccaacgcgaaacattgattaatccgcattttgttatggtgggcgatcaatcgttcgattggcgttctgtctttcaatttaattgattggttcgattggtttttttctctagaatacggcattattttcgacattactcggaagccgaataaggaataattatgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcaaaaaaatgcgtgaggcgttaattcataatgaagaaacaacacctgacactttagatgctttctgctctcatctttattaccaagcagtgaatacttcggatgctcaagattacggcaaacttgttccacgtttagacgaacttcacgataaatatcaaacctgtggtaacaccctttactatatgtccactccgccaagtctttatggcgtgattcctgagtgtttggctgcacatggtttaaatacggaagaatatggctggaaacgtattatcgttgaaaaaccttttggttacgatgaaaaaacagcgcaagcattagacgtacaaatccaccgtttctttgaagaacaccaaatttatcgtatcgaccattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattacaagtccttgctatggttgcaatggagccgccagcgattattaacgcgaattcaatgcgtgatgaagtggcaaaagtgatgcatagtttgcgtccattaacttcggaggatatggagaataaccttgttttgggtcaatacactgcggctgaaattaacggcaaaatggaaaaaggctatctagaagaaaaaggtgtgcctgcagattctcgtactgaaacctacatctcattgcgttgtgaaattgaaaactggcgttgggctggcgtgccgttctatgttcgtacgggtaaacgcttaccagctcgtgtgactgaaattgtgatccattttaaaactacgccacatcctgtattcagccaaaatgcaccagagaataaattgattattcgtattcaacctgatgaagctatttcaatgcgttttggtttgaaaaaaccaggtgcaggttttgaggcgaaagaagtatcaatggatttccgttatgcagatttagcaggcacgcaagtattaaccgcttatgaacgtttattgttggatgcgatgaaaggcgatgcaaccttgtttgcgcgtactgatgctgttcacgctgcatggaaatttgttcagccgattttagattacaaagcgaatggtggtcgtattcacgaatatgaagccggcacttgggggcctgtggcagccgataaattaatcgcaaaacaaggcaaggtttggcgtaaaccaagtggattgatgaagaaaaaagtgtaacgatgatgacctagggtaggtttaccctaggctagcaagagtactacccctttggggtagaattaccgtttcccaaaatggaactactatcacgtaattagccgtgggtatatttacttacgacatcataaacggaacagcaatgaataccatcactttcccaactgctcaacacgcagtcgaaaaaatcgcgcaagaatttgtgatttacagtcagttaaatcgtcctgtacatatttctctttctggtggatcaacacctaagttgctatttaaaaccttagccaaattgccttatgctgaacaaattaactggaaaaatctgcatttttggtggggagatgatcgtatggttccgccatctgatcctgaaagtaactatggcgaagtacaaaaacttttattcgatcatattcaaattccagcagaaaatatccatcgaatttgtggcgaaaatgaaccgcactttgagttaaaacgctttgaagaagaattaagtgcggtcattccaaacggtatttttgattggattattttaggtatgggaacagatggtcataccgcttctctcttcccacatcaaaccaattttgatgatgaaaacctagctgtcattgcaaaacaccctgaaagcggtcaaattcgcatttctaaaacagctaaactcattgaacaagccaaacgcattacctatttggtaacgggtgaaagcaaagcagatattttaaaagaaattaaaactaccccagcagaaaacttgccttatcccgctgcaaaaatcaaagcaaaaaatggggtgacggagtggtatttggataaagccgcggcaaggctgctctaatggaaattttagctcatattttaacttgcacttgtcacccttgaacatttctacattctctatttagaaatgttcaccattgaaagcaaaagtggtgttcgtcaatcgagggttatacaacggcttttggcagcagggattatttttggttatgccatcaaccaaatttcggtgatttatttctttttaggttgtgtgattatcgccgcagtttttggggcggttacgacgaagaataaggggatattggtaaagtaggagttgcctgcagtgttggcaaaattgatcgcttgtaggggcaaattacatttgccctataaaaacaattacagcggaatgtatgactacgaaatataatgcaggtattcatcatcgaagctcgattcgtttaaaacattataattatcgttctgaaggattttatttcatcaccatttgttgtaaaaataaagaatgtctatttgggcatatcattaatcaacaaatgcaattaaatgatttagggaattacgtaaaacagtgttgggaaaatattccaatgttctttccacaagtacgaattgatgaatttgtgattatgccaaatcatttacacggtattattgaaattattgaacaggtaaagggcaaatgtaatttgcccctacaatcgagagtaacgcagttgccacaaaagggaacatctcaaacaattggctcaatagttcgtggatttaaagcaggtgtaacatcttgggcaagaaaaaatagtgaaatttttgatgtttggcagcgaaattattatgaacatattattcgtgatgaaaaatcctatttgcagatttatgaatatattcaaaataatcctattttatgggaacaagatcaattatatgtagattaaaagggcgaatgtaataccctcctacaatttatctacatcatagacaaacatgtaggggctaattatattagccctcatcataaacaaagatttagtaatccaacaggagaaaacaatgtcagtaaaaggcgacatcggtgttatcggcttagccgtaatggggcaaaacctcattttaaatatgaatgatcatggctttaaagtggtggcatataaccgtaccacttcaaaagtggatgaatttttacaaggtgcagcaaaaggcacgaatattattggcgcatactctttagaagatttagcttctaaattagaaaaaccacgtaaagtgatgttaatggtgcgcgcgggtgatgtggtggatcaattcattgatgcgttactaccgcacttagaagaaggcgacatcattattgatggtggtaactcaaactatccggatacaaatcgtcgtgtaaaagcattggctgaaaaaggcattcgctttatcggttcgggagtttctggcggtgaagaaggtgcacgtcatggaccatctatcatgccaggtggtaatcaagaagcatggcaatatgtgaaaccaattttccaagcaatctcagctaaaacagaacaaggcgaaccttgctgtgactgggttggcggtgaaggcgctggccactttgtgaaaatggttcacaacggtatcgaatatggcgatatgcaattaatctgtgaagcttaccaattcttaaaagaaggtttaggcttgagctatgacgaaatgcaagccatcttcgcagaatggaaaaatactgaacttgatagctatttaatcgatatcaccactgacattcttggctataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaactgcgttgttatggcgtgaaggttgtatcattcgtagccgtttcttaggtaatattcgcgatgcttatgaagcaaatccaaatcttgttttcttaggttcagatagctacttcaaaggcattttagaaaacgcattaagtgactggcgtaaagtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacaccaactggactggtcgtggcggtaatacagcatcaactacttatgatgtgtagttaaaaacatcaataagaattaccgcactttaaactgttgccataaatttggatagtttattaatttgctgaaatattgggctctacataatgtagagctcaattatttatactaagggtatactttattgatggcagcgatcgtaaagcggttgtaattgttgaatggtgtgtgtaataaataaaatgggatctatttgatttaactcggctttttcaatacttttcccaatgcaccaaaaatcctcatctgaacgtaagatcagatttttttcagaaatgaccttcacttggcgaaaatcatcatattcactttcatcctctcgccaaatctcaaaatcagcaaattgtttgaaatcaaattgatcaagccactgattatattgttgcacattaatttgtgagcgatctgcacgatagcaatgccaatctaaacacactcttagtcggcgacgatttaatagcacagaaaagattgcggcagaattttggttaaactcgtatttaaaataagcgaagaaatgcgcccgtacctgccaaccattggtccagctttcaatatgcggtttcgcaaaaggcgtaccgagttgtgctgaaacagattgaattatcgctttccaattatcccaatgtaatttgtaatccgctttaatcgctggaatatcttctgggcagaattttttcatttgggcgaattgatagaaaggaatattgaacagttcacaagattcagcagtgagcgagagcatagcgtttccttaaaaatcactgtaatttttgaccgcactttgtgtgaagatctgcttgtcttcccagcgtaacatagtcattcgattattccacacacaaccagtatctagggcataaacaccttttggggtaggctcatccactaaacttgcccaatgtccaaagacaatgggaatttgtttataaagtggattacctaaattaaaccaaggcgtgagctctgtaggtgcatattttaaaggggatttacaggcaaaatccaagcgatgatctaaatagcaaaaacgcattcgagtaaaagcattaataatgtaacgatgacgcgctaagccctgtaaatcaggcgaccagcgatcaggttgttcggaatacatattttcaatgagataatgaaaatccccattttgtaaaatctgttccacttcagccgcacaagatttcgcagtttccaaattccaatcaggcgaaatacctgcatgcaccatcaggaagtttaactttttattatgtacaagtaatggctgatggcgtaaccaatgaatcagttcatcaaaatcgggcgcattaaaaatagcatcaacacgatcacgcggttttacttttttaatacccagtgcagtcgcaattaagtgtaaatcatgattgcctagcacggtttgtgccgaatcgccaagtgattttacgaaacgaaggcattcaagtgatttatccccacgagccacaagatctcccacaagataaagtttatcttgcgttggattgaagttcacacgttctaataaaagctgtaattcatcataacagccttgtaaatcaccaacgaaataggttgccatttttgaccgttcttttataaataaattttgagaattttaacacagacttttattgttgatttattcttttcgtatagtagaatgcaaaaaatttagttatttccatttttatttaaatatgagtgctattgaaaatattgtcattagtatggaaaatgcaactgaacgtcgcaaacatattactaagcaatttgaatcaaaaaaactttcatttagtttctttaatgcgtacacttatcaatcaatcaatcaatcaatcaatcaatcaatcaatcaatcaatcaatcaatcaatctccatattacataatatagaggaatctagaatacttactaaaggagaaaaaggctgtttaattagccatttcttattatggaataagtgtgtgaatgaaaatttggaatatctcacaatttttgaagatgatgtaattcttggcgagaatgcggaagtgtttttggcacaagatgaatggttaaaaacacgttttgattttaatgatatttttattattcgtttagaaacttttttacagccagttaaacttgagaaacaaactaaaattccacctttttattctaggaactttgatattttaaaatcgactcactgggggacggctggttatattatttctcaaggtgcggctaaatatgtaattgaatatttaaagaatattccttctgatgaaattgttgcagttgatgaacttatttttaataaattagttgatgttgataattatattgtctatcaacttaatccagcaatttgtattcaagaactccaagcgaatcaaagtaaaagtgtattaacaagtggattggaaaaagaacgagaaaaacgtccaaaaatccgtaagaaaaagacattgaaacagcgtttaactcggataaaagaaaatattatacgagctttaaatagaaaaaaatggaaagaacaacaacgtattaaagaaatgcaaggtaaagaaattgtccgttttatgtagaaagccaaggtgtaacaaggattacaccttttattatttttactcttctgaatctaatatttcatcgttattaacatctgctggtggattatctgccagccagttcgctaagcgcgcataatctgcgatagccaaattttctgcacgtgcatttaaatcaataccaagtgcggtcagattttcaggtgaaaatagtgttgaaagtgcattacgcaatgttttgcggcgttgattgaacgcttgggagcaaacacggttcaaccaatataaatcttttacagggtgcggcaattctttatgcggaattaaacgcacaacggctgaatccactttcggtgctggtttgaatgcagaaggaggtacttcaagtacaggcatcacttggcagaaatattgcgccataatggttaagcgaccataagctttgctatttggccctgcgcataagcgtttaaccacttctttttgcagcatgaagtgcatatcttgaatcacatcatgatacttaaataagtggaacattaatggcgtagaaatgttataaggcaagttaccaaatacacgtaatttttgccctttttctgctaaattctctgttgtataaagctcatcaaaatcaaattgcatcgcatctgtttcaataacggtgagcttttgatgtaaaaatggatggtgacgtaaacgttccgcaaggtctcggtcaagctctaccacagtcagatgatcgacaagttcaccaacaggctctgttaatgcgccaagtcccggaccaatttccactaagaattgattgggttgtgggtaaatcgccgccacgataccttgaattacagaagtatcatgtaaaaagttttgaccaaagcgtttacgcgccgtatggcctaagtgtttttttgaattcataagtactatttaataagaaaagtgcggttattatagagcctgtatttcttttgtaaattttagtgtaactgtcatgggtaatatcatttagcgatgagttccagtatagctttaatatgatgactcaaacttggattataacgaatacaatccattggattgagaatacggtgtagctgttcagatgcttgttttactgatttttgaattgcctcatctaaagtacttatgttttctctagaaaatgtatagccaaattcgttttttaatacttctaggcatcccatgttttcagaaaaaataactggcgtaccagataatatagattctagtccaacaagcccaaatggttcatattgagatgccataatagtgaaatctgccgcttgatataattcaggcatatttttgcaaaaaccaagtgaagaaattttaggattttcttctacaggcgttcctgcgaccactaagcgaataggtaactgagttttttcaaaatattttttcaaaatatcgaaaccttttcgcgtatggccagtagaagggaataggtaaatgatttcatcttttttgaaacctaacttttctctgagctttactctttcttcttcattgatttgtgtgaatttatctgtattaatagggggataaatcacatcaattttgttttcagagacatgatataactcaacgagttcttttttcattaatgcagaatgagcgatgacatatttggactgatttaaggatttttgttcacccatgattttaaatcgatctgatatgctgggctttttctttgatgcttgtaaatatcctttatgatttccaccacaaatgaccacgtcagatagggtgtaagaggttgtcagagagatttctgatgtttctttatatttatttgaaaaataggaaagaaacgaggttctccattttttaggaacaaaagaaagattaatcttaattggatataattagattatattcaggtaatgcagtatcaaacttggcagagtaaattttaggtgtaatgttagcctgagataatccattaacaatatcaataagatatcgttccatacctccaccgtattgaaatttttgacaggttaatgaaatatttgggtgattattattacttagtaatgttttattcatttgtatctacctagtaatggggttatttatgttgattatagggggtgttttgattttgtaaatcatttttcagttatgtcgaattgagttttttatgaacaatattattttttctttcgcagaaagctaaaaacggctataatccgcccgtttttcttaacttttccgcctaaagtgcggataaaaaatcgattatttttagaggatacaatggcgaaagaagattgcattgagatgcaaggcacaattttagagactttaccgaatactatgttccgcgtggagttggaaaacggtcacgtggttactgcacatatttccgggaaaatgcgtaaaaactatattcgtattttgactggggataaagtgaccgtagaaatgacgccttatgatttaagtaaaggacgtattattttccgcagccgttaattgcagaatatgtgagatagaccgatatatatcggtcttcttttttgctcaaaaagaactcaaactggttgcggaacgtaaaaaaatcggtataatccgcaacccttagccacattgaatttttcgttccttgcctttgcagattggtggctgatctacgtcaaaggctgattaacccgtaaggagcagtaatgcgtcactacgaaatcgtgtttatggttcatccggaccaaagcgagcaagtaccaggtatgatcgaacgttacaccggttctgtaaaagaagctggtggtcaagttcatcgcctagaagattggggtcgtcgtcaattagcgtacccaattaataaattacacaaagcacactatgtgcttatgaatgtagaagcgcctcaacaagtcatcgacgagctagaaacgactttccgttataacgatgctgtattacgcagtcttgttatccatactaagcacgccgtaacagaagcgtccccaatgaaagcggctaaagaagaacgtaaacctttagctgaagttgaaaacaacgattttgaggatgctgaagagtaatttgaaaattgataatcgtttttcggttatgggagtcgtttctcagttaccaaagcgattaaaaagccctagtggaattgagcattgcaagtttttgttagaacatcgttctgatcagattgagagtggttttacacgtcaagcttggttaaaaatgccagttcaaattagtggtaatcaattgatagaaaaaactcaaagcattacggtcggtagtaaaattttggtggtgggatttattacctcacataaaacccaaagtgggttatgccaattagttttacatgccgagcaaatcgaatttatagattaggagactagccaaatggcacgttatttccgtcgtcgtaagttctgccgtttcacagcggaaaatgttgttgaaatcgattacaaagatatcgctacattaaagaactatatttcagaaagcggcaaaattgtacctagccgtattaccggtactcgtgcgaagtaccaacgtcaattagctcgtgcaatcaaacgcgctcgctatttagcgttacttccatacactgacaatcatcagtaattaaggagacacggtaatgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaataatttatccaatagataaaataaaacccagtttaaaactgggtttttttatttttatcatatataaatttagaatagggtaataaaaaatatcccttattttagtagatttgagccctaagtcatatagagctcaaattttctgttgggatagattttttactcgtataagcgaattacatcattccacccataccgcccattccagcagcacctaaatcggctttatcatcttttggaagatcagttaccatacattcagtggtaatcattaagcctgctacagaagctgcgaattgcaatgcagaacgagtgactttagttggatctaagatacccatttcgatcatatcgccgtattgttctgtacctgcgttataaccaaagtttccttctccatttttaaccgcacttgccacaacagatgcttcttcgcctgagttagtgacgatttgacgtaaaggtgcttccatcgcacgtaatgcaagtttgatacccacattttgttcttcgttgtcaccttttaggcttgctgcaactttcgctgctgcgcgaactaatgcaacgccaccaccggcaacgataccttcttcaaccgcagcacgagttgcatgtaatgcgtcatctacacggtcttttttctctttcatttcaacttcagttgctgcgcccactttgattacagccacgccgccagctaatttagcaacgcgttcttggagtttttctttgtcgtagtcagaagttgattcttcgatttgctgacgaatttgagccacacgacctttgatttgtgcttcatcgccgataccatcaataatggttgtgttatctttattgataacaacgcgttttgcttgacctaaatcttccaatgttgctttttcaagctccataccaatttcttcagaaatcacagtacccgctgttaaaattgcaatatcttgtaacatcgctttacgacgatcaccaaaacctggtgctttcactgctgcaactttcacgataccgcgcatagtgtttactactaaggttgcaagtgcttcgccttccacatcttcagcgatgattaataacggtttacctgctttcgctacaccttctaacacaggaagtaattcacgaatgttagagatttttttatctacaagaagaagatatggattatctaattcaaccgttgcagtttctggtttgttgatgaaatatggagaaaggtaaccacggtcgaattgcatgccttcaaccacatctaattcatcttcaagacccgtaccatcttcaacagtaattaccccttccttgcccactttttccatcgcttgtgagattaattgacccacaatgctgtcagagtttgcagaaatggtacctacttgttcaatttcttttgctgtttcacaaggtttagataaatttttaagttcagaaacaaccgcacttactgctttatcaataccacgttttaaatccattggattcatacctgcagctactgctttcaagccttcatttacgatagcttgcgcaagtacagttgcagtagttgtaccgtcacctgcagcatcatttgctttagatgccacttctttcaccatttgtgcccccatgttttcgaatttatcttctaattcgatttcacgagcaacagacacaccatctttagtgatagttggtgcgccaaatgatttatctaaaattacattacgacctttcgggccaagggttacttttactgcatccgctaatacattcacgcctttaagcatttttacgcgtgcatcgttaccaaattttacgtcttttgctgccattttcttttttccttaatttaaattattccacaatcgccaaaatatcgttttcagaaatgattaacacttcttcaccatcaattttttctgctttcacgccgtaaccgtcgttgaaaattacggtatcgccaactttaacatctaaaggttgaacggtgccattttctaaaatacgacctttacccacagctaatactttcgcgcgggttgatttagtcgctgctgaaccggttaatacgataccgccagctgaacgggtttcgacttcttcacgtttaataattacacgatcgtgtaaaggacgaatattcatgattaatttccttcttaagaatttgtaagtgcggtttctatataaggaggattttttttctttcaaggggcttacaaaaaattctgacaaaatatttttcctattttagattttttacgtaaaattcgctgactttcgtataataaattaaggaatgaaaatatgcacttaacttccagagaacaagaaaaactgatgcttttcctcgcgggcgaacttgcggcaaaacgcaaagcacgcggcgttaaattaaattatccagaaaccattgcttatattgcgagccatttacaagaggctgcaagagacggaatgagtgtagcggaagtgatgcaatatggcgcaacacttttaactgttgatgatgtcatggaaggtgtggcagaaatggttcatgaagtccagattgaagctactttccccgatggcacgaaacttgttaccgtgcataatccaatcagataaccgtagggtgggctttagcccaccaaaataaaaatatcaatggtgggctaaagcccaccctacaaggaacaaagatatgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttgttggttaccaaatcatggagagtttccttattggtatcgcctaaacggattctttttcgtactatgccatatgtcgtctgttcatactgaactcagtacaaacagtctgaactcgtgcagatgacg

SEQ ID NO: 682 - DNA, 135356 bp, H. influenzae
  misc_feature (222)..(222): n is a, c, g, or t
  misc_feature (228)..(228): n is a, c, g, or t
  misc_feature (135317)..(135317): n is a, c, g, or t
  misc_feature (135320)..(135320): n is a, c, g, or t
  misc_feature (135328)..(135328): n is a, c, g, or t
ttccgattttttgtgccgtattccaaattgacacgatagtaccgcgttcagatttagcccaccaatgcaccatagtacgaccacatggaggccaacccataccttggaaccaaccatttaagaagatcattacccatataatggcaatgcctgaagttgcccatgggaataaacccattaaggtcatacataaaccagagagcaataaaccaaatggtaagnatacantccgatattatgtgccgtattcccaaaatgtaagaaaaaataatataaaaagtgtaatcattgtagagaagtgcggcaaaattaacaacattttgagtgtaaaagaaagcgattttgtgatattgatcacaataattttcgcattcgctcaaacggtgtaaagatttgtgaaacacttcacatttttgattttttttactttcttatttttttattttcttttatgattcgcaaatcccttactgtttcaaaagggtaaatttagatgacacataattaaaaagttggagaaaaaattatgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataattagcttaaaaaaggcggtgggcaaattgcttagtcgccttttttgtaactaaaatctaaaaactctataaaaatttaccgcactcttaaggagaaaatacttatgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacaaccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaataatttataaattaattctcatacaaaaagagcggtcaaaacttcttttattttgaccgctcttttattctgtatctgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatcgcacgcgcagtattacccgtatcaactaaatcatctaccacgataaatccttcgccaccatttggcacttgggctgcatgaagaacttgtagttctccctggttgttatgatcgtgataacttgcgatacaaacggtttcaatatgacgaagacccaattcacgagccaatacagccgctggaaataaaccaccgcgactcaccgcaataatacctttccattgagaagctggaagtaaacgttctgataattttcgggcatgcatttgaaacatatcccaagttaccacatatttttcgctcataattgcaccttagtttaaattttgcataaagatgcactacccgcgtttttcacagacgtaaatcaaatgtatgatgcattattgaataaatcaggggcaacaggtgtatttactgatttcccagatacttgcgtggaattcttaaaaggaataaaataatttctattataaccgtaggtaagtttacttacggttattaatgccgtctatgatgaaattatcttttcaattgaaaagtgtttttcagaaagacttactatatccttaatgaataggaacataatatgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaaaaccaatttaaatataatttagtttggggctaagctcattttttactggcttagcctttttaatttttcaagttcactcaagtaatcatcattactacagcctgaagttttgctatgatgttgcaagcctttcaaaatagaaatctaattcaatgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaattataaaaatagggcaagtatttcgtttgccctaaatttttctcccataaatattgcgcactgagtaaattagcactatccgcaacgcgatgagcttgagcttggtcaatattgaattgctcacttaaccctcaagcggtgcacgctcgaatatctgcaacttggaagttttttctaggctataaatgacgccttcgcgcaatgcaccgtcagaatagcgcatttgttgaatatgaaaaacctcaaacactgcacttaaaatcgctaaaccgggtacaaaaacatccacacggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaagcctaaatcttcgattttattgaccgcactttggcgcacgcgttgaaagttttctggggaaatgatgccatcggtaaaaaaattgagtcgcaaaactcacgcatcccatatgtcggctttcagccataagcggcgtgaaatcatcgccgataatcatttctgtcgagccgccaccaatatctataacaagctttctgcctttttctggctgagtatggcatacgccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcggcaaataaggctaagcaattcacgccacgtgtgatagcctcttgattaagcaccgcattttcatctaagccttccgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagcgtcattcataacattcctaaaattcaaatttataaagtaaatcaaacacttggtttgtgctagaaacggattgaaaataaagctgtggcattaggcgataacgtaatgtaacttctgctaacccatcaaataaacctacgccatattttatttgtaagcgattggtaatattgccacttactgtaaccttagatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccactactttctaacgaacgacctgttaataaataagaaagtgcttgatcttgtggtttgcttggttcactgaaaatagtgacttctgggctatcggctatgccaatcactctcactccagcagtaattttgctgtcttccattgtttcaggattacgaatagcctcaatattcaacgtaggttgtgccgcttgcccagaaaaactaataagccctttacgaatgagtaaatcttgtccgaaagaagcatagcgacctttggttaaattgatttgcccgaataaacctaaattgcctttgtcttgtttcacagaaagtaaaccatcaagattggtttttaagccataggcatcaaggctgacgtctttaccaatattgatgcgtaaatcagagcgaatatccattcctgatttcgtttttgcggcaaattcacgtttaatcagttcttctttgctcttgtgcgggccgtttaaaatcacttcatcttcgctgactggctcagcagtatctggcagactgtcaattttaatacgcgcccaaggaatatccactgttccgcttaaattcaattccttaggattggcttttatcgtgatatctggactgaaacgtagcttcgccatagatggaatatccacgttgaaattatttgcttgtgcattcaattctgtcgtccaatgttcaatattcgcccagtttgcacgtccagttaagtttaagtgactatctactgtttcgattttcccttgcaatgttgaacggttaccattaaagcgtagggcaatatcgccatctgtaatattgactggcatagatttcaatttggtacgaatattacgaatattgaagtcaccatttaataatggtttctctaaattcccgccgaaactcaacttcgagactaccttaccattcactgattcaccgctagtaagtagctgatttgcgatcgacaagtttaatcgttctatcgcaagggttccgccaagttggcgagttttaacaaaatcatttaaacgaatatcgcctacaattctgccttgattatgcaaattgatgtctgtttttaaaaccaaattattattttgaatgtcggcattaagggttaattttggaatatctaatttaaacgtgcggtaatccaatttttgagagaaagctaaatgattgccatctacttttgtgctaaattggaatggtttatccgtaaaccaagccacattaccttgcgcttgcaagtttcctttgaggctatcttgttcgataagtttattcattaaatccaaattaacacgtttgaattggaaagggatattaccttgcttgcctgcattgaatgcttgtgggaaacataattctatatctgtgttttgccagcaatgtgcggcaatattggcttgtgtttgtttgttatcgtaagacaccgcaatagcttggttagattttacatcgccaattggggtttcaaattttgcttgggaaagtgtgcctttccactgttccaaagtgcggtcaaaatggccgttaatttgtaaatttgcagcaacaggctcgccttgagattttaggattaatttgtgattttgttcatcgcctgataaatcaagatcaagtaaatggagtttaatattttcgccataatgaagttgttctgatttaatattcaattttccactcgagagtggggtattgtttatatgaccttttatacttgctttagctaactgaaaaccttgtaaatgtaaattggatgaagttaaatcaagatcaagattaggtgtcgtaatttgaccagaaatcgctactcgcccttttaaatctgaccataaaccacgtaaatttggtgcatctatatctagcacaaaatcagaatgatcatctaatacgccactggctttaagataattttcgccatatctaatctgtaaatcaggcacggttagaagtacattttgattaagcgttgcagaacctttcaagctaattggttttgcagacaatattccatttaaatcagctgtaggcacttccacttgccaaccttgagagtccgcaaaaccgcgagaatgtaatttacccgataatatggcaggcataactggaacaaaaaaaccaatattcattttttctaaatcggcttgaatatcccagtttgcaccatttttccaatttgcattacccacaaattcacttttaccgtctaatgaagctatccccaatttatttacggttatttcataaagtttgccgtcggcattaaagtctacttgagatgcgggaatataattcattcctgccacattgcccttaaattcggcgtgataattcagtaaatcccccgtgagtttaagcgtcacatcattaattttgagtggcgtcattgtgtttacaaaagtgtattgtccttttgccacgtttaatgtgaggtttaagggcattttatcttgtgctaattgcacgttgccattcagttcagcatctaatacgccttttgttttcacagaaagtgcggtggattttttcaatgatcccgaaagcgtaagatccacatcactctctggcagaatttcttttccagcggatttcaacggctccaaatgggattttaaagttaaatctagcggcatatcgccatcgagttgtaatttaccttgtgaagaaagattacccaacgagctttctaccgctaatttttgtaattgcagttggttatcgacggtatccgcctgtgcaattaaactagacatttcaacagattgaagcgtttcgtctttttcattcactgcttgatactgccagtttttgcctgaaatttcaggaatatgtaaatcaaaaggaagaattatgtctgatacattgcctaaaaaagcaggcgttaaagattgctcaatcgcagcccaatctacaggtttattcggctgtttggctttcagctcaggtttaccttcgggcaatttttttgcaatcactgaaatatcgttaatttcagtcggcgcaatagttaagcctttttcattatttaaacttaccgcacttttaaaatttccaagcgtaatattagtctgatcaatgtttacagataaatcttgcaccaccaaattttctgcattgatactaattggcaaggaaatacgcttcattgagccagactttgaattatcaggtgccgatggaggcaataatgcagtattaatcgcaatggtcggtttatttaaggtgaagtctcgtaaacaaacttcacgtgaaagcaaacaaccaaaatcgagctgtaaacgtgcttgtgcaatatgtgtctcaatcccagcggtttgataacgaacattctttaacaccaagccattttgtaatccgccttcaatttgctcaacggaaaaactatcaagcattttatcgacaagttgaattaaacctctttgccccgcatcgaaagaaagcactccagcaacacctaaaacaggtataaaaatgaccgcacttccgatacaaacagccttgcgtacccaatgttttttattaggtttctcaggtaattttggtgaagtttctgatggttgtagttgttctgtcataaattcaccttaaatttctgtaccaagtccaatgtaaaattgaatatttttgctgttatctttatcacgaatgggtgtggcaatatcaaatttaatcgcaccaactggcgatgcccaacgcacaccaacgcctgcaccataacgcaattcttttgccgtgtaattatcggcagctaatccactatctgcaaaagttgccgcccaccaatttggatagacttgatattgatattctaaagaagcggtaagcaatcgcgaaccaccaactaattttccgtttttatttttaggcgcaatttttttatagccgtaaccgcgcacactacgatcgccaccagcaaagaaacgcagtgtaggcggaattttttcaataccttttgtatgtaaatacccgatttcagcacgagcaacgatacgatgattttctgcataagtacgaacccacgcgctagatgcttgcacttttataaaagaagattctgatagccaaattcgtttgcttaaatcaaaagtaattttttgcacatcgccccaagtggcaaaggaaccaccacgtaatcgagtacgagtaaatccaacagttggataaagaagtaaggttttatcagtgatatccgcttgtgtaaaactgtcgtatcgcgtacgaagtccgccaaaatattgccaaccatgcgcattattccaataacgtaacgctgacaacgtaagcactctcgtattggtatcgttctctttttccccttcccaaccgacggcaaaatcatagtaataatttaatggatttttaagcagtggcattcgataagttgcctctagagtttgttttggtgcagagagataaagatttgaacgcaaactatgtccacggctattaatccaaggttttgtccagcctatttgtccgtgaacgccgccatcagtagcaaagcccacaccgagttccatcgcattttttttacgtggataaagaatgatttctatatctaccgttttacttttatgattgatattaggctgaactaatactgagctaaaccaatttgaagatgaaaaatcgctggttaaatccgacaaattattcattaaatacggatcaccagatttgatgttaagaatattatttaagtaatcatcccgaatttgtgaatggctaaaagtaatattgccataatgataacggacaccactatcaaataacattcgccaccatgcttgatgggtttcagggctgatttctaaacgtgaaattttaaagttcccatcaaaatacccacgatttaatgccaagcgtgaaatcgctgttttgtaatcatcgtaagtttggtgctcaaccaaaacgccatctttcggtaagtttttacgcaatgcattaaaattttcatcttgtgcggcttccccctcaatttgcacatcagtccccgcaatttttgttggctcgcctggtgtaacatgagcaatcaataaatcgcgtttgccttgacgctgttttcgttcaaaacgcacggaagattcataataaccaaacacacgcaaaccacgatccacggctttggttaccaaatgttgatagcgttcggagccatccatttcttctttattaatcaaattaacattgagatctgtattacgcacagcacggaaaccacgaatgccttgaacttcaatatcaacagtttgttcagcaaatgcgggaaagcaacttaatgctaaaaaaagtgcggtgagttttagcgattttttcttcattttaaggggttaaaattttctaagtaaattgcactatagtctaccgagaagttcgttaggatccaatattttcagtgcattttgtcggttttttcataaaaaataccgcacttcattgccaaagtgcggtaaatttttgagctgttttaattagtgaccgccgcaaccacagctgccgtgattatgttcgtgattatgttcgtgatgatgaccaccacagccacaaccgtgaccttcttcgtcatcatcgtggctgtgtgcaccgtgaacgtggccgtgagcaatttcttctaacgttgcttcacgcgctgcaacaacttcaaccgtgaaatgtaattcttgccccgctaacatatggtttccatcaactacaacttcatcgccatcgatttcagtaatcaccactggaactgggccaatgtcagtatccgctaagaaacgcataccgacttcaagttcatcaacaccttggaatacatcttttggtacacgttgaaccatattttcgctgtacgcaccataaccttcttcaggttgtacacgtacttcaaatttgtcgccaacttctttaccttcaagtgctttttcaagaccgactactaaattattgtgaccttgtaaatattctagtggttgatttgctggagcttcatctaccaatacgccatcttgtgtgcgaacttggtaagaaatgctcaccactacatttttttctactttcattatgttttccttataaaaatcggttaaaaagccgtatcattgtaacgaaaattattccacgcgcaagactttacggattaatgaacacgaggctcttcttcatcttcatcatcaaaaaattccccatcgtcaccgtattcatcgtcatcggcatttgggtcttcaaaataggtgccccaaccatcataaatgcctttatgtttttctaacaatggaaggatttgtttttgttgtgcatcgataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcgatgtgatgctcaataatgtaaagcgcatttggatcactgccatcattaagtaaatcttcgataatttcacgggtttctgcttgtaattcagccaattttgacataataaaatccttcaacaagaacaaaagtgcggttattttagtggataaatcaccaaaagtcgcatagaatttcgcacaattattttcgataaaaaagaacccttaaccatgctcgaacaactcccttatttggcattaaaaactccgccaaaaaccaccgcacttttaaaggctgaatgcgcggattttattgtaaaagagcatttaggctatgaaatgtcgggcgatggagagtttgttgcattgtatgtacgaaaaacagattgcaacaccttatttgttggcgaaaaattagctaaatttgctggtgtttctgaacgcaatatgggatatgcagggttgaaagatcgtcgagcggtgacagaacaatggttttgcttgcaaatgccaggaatggaaacgcccgatttcagtcaatttgaattagatggcgtagagattttaacggttactcgacataaccgaaaaattcgcacgggtagccttgaaggaaattatttcgatattttattacgcggtgcagaagaatctgatgagcttaaagtgcggttagattttgtggcaaattttggtttcccaaattattttacggaacaacgttttggtcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattaattgggtttgtggcggggttttagcccaattccttacaaggggtttacgctctgcgctggagtaatgcaaatggcatttttcccttttgttatcaccgcatttgtttcacgtttagcacgtttcttgctagtagcaaaattagctgcatggggcggtgaaaaattcgcagcaaaattgcgaaaatctattgagattattggctggtcagtggttgtactggctataatcgcttactttatactgaaaaactaggatagaaaatgaacaaattaagtcttgttttagtagctggatttcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaataaaaatgaaataataacggaacaataaggaataactatgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgctttacgtggttacggtaatttaatcatcatcaaacataatgatgatttcttaagtgcttatgcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaagatctctttaaaaagtgcggtaaaaaatctcaacaaatttttaccgcacttttttattaaaaatattctgtgaggagtatcacaaaataaaaaaataatagatgacaatgttaaattttatattattctgataatgcttcgtagttagaagtcagtgttaagttttattaagtatctcttctcttaaaaggagtttaatatgctcaacttgctctctcctaaccaaacttgggttcttgttgatccaagattatctttttattttcccataatttattaatcctttcttattaaccatcaaagtgttttcattttagaaaataattttttatttaaactaagcaaattaatttttggggattttgctatggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggtggtttagaaggtggtgcaatggaacgtttggctgttggcttgcatgatggtatgcgccaagaatggctggcttatcgtattgcgcaaattgaatatttggttgcaggcttagaaaaaattggtgtgccttgccaacaaccaggtggccacgcggcgttcgtagatgcgggtaaattattaccacatattccagccgaccaattcccagcacaagcactttcttgcgaactttataaagttgcaggtataagagcggtagaaattggctcatttttattaggacgagatccgaagacgggtaaacaactaccatgtccagcggagcttttacgcttaactataccacgtgcaacttatacgcaaacgcatatggatttcattattgaggcattccaaaaagtgaaagaaaatgcagagaatattaagggtttaacctttacttatgaaccaaaagttctccgccactttacggcacgtttaaaagaagttgaataatatcacgaaaaatgcagttcattttgaactgcatttttttatcaacagctaactcaataatttgttattgataaggatgttctatgaaaaaacaaccttccatctttggtggtgcgtgtattattgctagtgtttgtgttggggcaggaatgcttggtttgccgacatctggcgcgggtgcttggacaatatggtcagtattagtaatttgcttaacaatgatagtcatgacattgtcaggctggttattacttgaggcctactctacttatgatttaagagcttcatttagtactgtaactaaagatatgctcggttcaactgtcaattctattaataatcttgcggtatattttgtcgggggtattttactttatgcttataccactgcatctggcggtatactagaaaaccttattaaaccgtggattgattttggttcatctacattggcaatttgttccactgtatttgtattagttttttccttctttgtttggcactccactcgcattgtagacagaatatctgttttattgattgtatgcatgggttttacttttatttttagtacttatggattagcaactaatattagtttagacactttattagatattggtggaaaggagacaaattatgcaaaatatgcggtaggaatgtttcccgttgcattaacatcttttggctatcatcattctgtttgtacgatgcgagcttactatggggaagaaaaaaaagcaaaatacgctatcttaggtggaacagcaattgctcttacgctttatttactttggattttctctatttttggcaacttaccgcgagatcaatttgctccagtaattgccagtgatggtaatttagatattttacttaacacattaggtggagtaatcgaatctaacacggttaaacaaatgattaatgccttttctatcgccgcaattttatcatcttttattggcgtaggattaggcgtatttgattatttggctgatttctttaaatttgataattgtaaaattggacgaacaaagtcatgggctgtgactttcctacctccactaattatgtcaattttatttccattgggtttcttaaaagctattgggtatgctggtgcggtagctacgatttggacaagtataattcctgctcttcttgcctataaatcccgcaaaataaatacagctgcaacattccgagtgtgtggtggaaatggtttaataatctttattgcattatttggtgtttttgtagctattttccattttcttgcaatgtttggctgcttacctttctttaagttctaaggggaaaatatcaattttaagtgcggtaaaaaatctcaacaaatttttaccgcacttttttatctggctttttcccctttcggcacctaaaatagccgccataaaacctatctttattcagtttcaaagcaggtaattagatgatttccgaagaaaatttccaacagcacacgccaatgatgcaacaatatctaaaactcaaagcagagaatccagatattttgttgttttatcgcatgggggatttttacgagttgttttatgacgatgcgaaaaaagcggcggcattgttggatatttctttgacgaaacgagggcaatctgcaggacagcccattccaatggcaggaatgccttatcacgcggtggaaggttatttagcaaaattagtgcagttaggcgaatctgtggcgatttgtgaacagattggtgatccatctacaagcaaaggacctgtagaacgtcaaattgtgcgaattgttacgcccggtacggtcagtgatgaagcactgttgcctgaacgccaagacaatctgattgctgcggtatatcaagaaaaagaaaaatttggattagccactttagatatgacttctgggcgttttcagctttgtgaacctgcagataaagaaacattgcgtgcggaattgcaacgtattgtgcctgtagaattgctgtattgtgaagaatttaatgaaatggcagccatagaacattgtaaaggattacgccgtcgcccgatttgggaatttgaacttagcactgccattacgttattaaatcgtcaatttggcacaaaagatttacgcgcctttggtgtagaaaaatcccctctcggcttaagtgcggcaggttgtttattgcaatatgcaaaagaaacccaacgtaccgcattacctcatattcaaagcattagcttaattcaaaaccaagactgcattcagttagatgccgccacgcgcagaaatcttgaattaacacaaaatctttcgggtggcacagaaaatacgttagcctctgtcttggataaatgcgttacgccaatgggcagtcgtttgctgaaacgttggattcatcagcctattcgtgatgtggaaaaattaaaacaacgccaacaagcgattgcggaaattctgaattttgatttagtcgatgaactccaaccttatttgcaattagtcggcgatatggaacgtattttagcgcgtgtggctctgcgttcagcgcgtcctcgcgatctcactcgcttacgcacagccttagaacaaattcctgcattacgcacgattgtgcaacaaaaaacatcgccatttttaaccgcacttttcagccaaattgccgatttcagtgagcaatgggatttattgcaacgtgcattgattgaaacgcctccgcttttaattcgggatggtggtgtaattgctgaaggttaccatgcggagttggacgaatggcgtatgctgtctgatggtgcaacgcaatatttggaaaatctcgaaaaacgtgaacgtgaaagtacaggtattgatacgctaaaaatcggttttaatgcagtgcatggttattacattcaaattagccaaggccaagcgcataaagcacccattcattatgtacgtcgccaaaccttgaaaaatgcagagcgttacattattcctgagctcaaagaatatgaagacaaagtactgaaatcgaaaggtgcagcgttagcattagaaaagcagctttacgatgaattgtttgatttattattaccgcacttaggttcattacaactggctagccttgcactctctgaattggatgtgttagtcaatcttgctgagtgcgcagataccctcaattacgttatgccaacattctgtgatgaagtgagtgtgaaaattgaaaatggtcgccatcctgttgtggaacaagtattgaaagatcctttcattgccaatccagtggagttaaatcacaaccgtcatttgttaattatcactgggccaaatatgggtggtaaaagtacttatatgcgtcaaaccgcattaattacattgcttgcgtatatcggtagctttgtgccagcagacagtgcgcgaattgggccgattgatcgtatttttactcgaattggtgcgtctgatgatttagcctcggggcgttcaacctttatggtggaaatgacggaaatggcaaatattcttcaccaagccactgagcaaagtctcgtgcttattgatgaaatcggtcgtggcacatccacttatgatggcttatccttagcttgggcttgtgcggaatggttagccaaaaaaatccgctcgcttacattatttgccacccattattttgaattaaccgcattgccggaacagctagaaggcattgccaatattcatttagatgcccttgagcataacaacagcatcgcctttatgcacgccgtacaagatggcgcagcaagtaaaagttatggtttggcagttgcggctttggcaggcgtgccacaatccgtcattaaactagcaaaacagaaattgacacaattagaaaaaaactcaagctattcagccgaacagcaaattcaagcgttgcgtgaagccaatcacaatcagggcgaattattgtttgaacaagaaacggatgcactaagagaggctattgaaaagctggatcccgatgatttaagccctaaacaagccttggcgtatttgtatcagttaaagaaaatggtggggtaaatattatatcctagcgataaattcaaaggtttatatggattggcggaggggaatgggagttgaacccacccaagaacgctggcgtcctcaacaggatttgaaatcctgccacctcaccggagatgacgcccctccgtggttgaaattgcggtcactttagcgtaaattaatcggcaattcaacgttattttaaacggattcaaaaatgaccgcactttttcaacaacttccttccgttgataaaattctcaaaacatctcaaggtctacaacttattaccgaatttggtcacactgcagtcgtggcaacatgtcgagaattattaacccaagctcgtcaatttataaaaaaaaacaatcaacttcctgaatatttttctaattttgaccgcacttttgtagaaattcattctcgcctacaaaaacaaaaccaagtacaaatcaaagcggtgcataatctgacaggtacggtattgcacacaaatcttgggcgggcactttggtctgaagcagcacaacaagcagcgctttctgtgatgcaaaaaaatgtttcgcttgaatatgatttagataaaggtaagcgtagtcatcgcgataattacatcagtgaattattatgcaaactcacaggtgctgaagctgcctgcatagtgaataacaacgctgctgcggtattgttaatgttagcgacctttgctcaaggtaaagaagtaattatttctcgtggcgaattaattgaaatcggcggtgcatttcgtattccagatattatggaacaagctggatgctatttagtggaagtgggcaccactaatcgtacccatctgaaagattatcgtaatgctatcactgaaaatacggcttttttaatgaaagtgcatagcagcaattatcaaatttgtggttttacctcttcagtttcagaagaagagcttgcggaactaggccgagaaatgaatgtaccagtagtcactgatttaggtagcggcgcattgatagatttaagccaatatggcttaccaaaagaatcaactgtgcaagaaaaagtcgcacaaggtgtgggtttggtctctttctctggcgataaattgcttggtggcgtgcaagcaggcattattgtgggtaaaaaagaatggatcgaacaattacaagcccatcctctcaagcgtgcattacgttgcgataaagtcattttagctggcttagaagccacattacgtttgtatttaaatcctgaaaaattaactgaaaaattaccaactttgtacttactcacgcaaccattaaaacaactcaaaataaatgctatgcgtctcaaagagcggttagaatctcgcttaaattcacaatttgatattcaaattgaagctagccaagcacaaatcggtagtggctcacaaccaatggaaagaatcccttccgtggctgttactattgcagaaaaaacaaacgtaaaactttccgcactttcagctcgttttaaacaactttcccaacctattattgggcgaatggaaaacggaaaaatttggctagatttacgtagccttgcagctattgaaacattattaaatacattggatgaactatgattattgttacttcaggtcacgttgatcacggcaaaacagcattattaaaagcattaactggcacaagtaccgcacatttaccagaagaaaaaaaacgcggaatgaccattgatttggggtatgcctatctgccgttagaaaacaaagtacttggctttattgatgtgccggggcatgaaaaattcttgtcaaatatgctggcaggtttaggtggtgtgcattatgcaatgttaattgtcgctgcggatgaaggggttgcgacgcaaacaaaagaacatttagcgatattacgccaacttcaattccacgaaattattgttattatcacaaaagcagatcgtgcaaattcagcgcaaatagaatcgttaatccaagaaattaaacaaaattatagttttttacgtggtgctaattacttcgttacctcagcagaaacgggacaaggaattaatgaattacgtcattacttagctaatctacctgaattatctgatacccaaaaacctttccgttacgcaatagaccgagtattcaacgtaaaaggggcgggtaccgtcgtgacaggcacagccttttcaggaacagtgaaagtaaacgatgaaatttacctttccactggacagaaagttcgtataaaagcgattcacgcacaaaatacatcaagcgaacaaggtattgcggggcaacgtttagcgttaaatttaaatgctgatttagaccgcacatcaatgaaacgaggtgattggttattgcagaatgagccacttccaccaacagatcgcatcagtgtacaaattttggctgaagtaccattaaatgaaaaccaaccagtgcatatttatcacggtgcaagtcgcactacgggtaaactcactttattacagggaaaaaatgccgcaaaaaatgaccgcactttagctgaaatcatattggattcaccattattcttggcttttggagacaaacttattttacgcagtggcgatacaaaaaccttaattgccggcgcacgagtattggaaattaactcgccaaaacgtcataaacgcactgaagtgcggttaaatttcttagcgaatttagcattggcagagaacgcttcgcaacgtattgcgcttacccttaaacataatgcgacaacagcacgccaattaatgtggacggaacaactgacttccttgcaattagataaagcactcgtcgagcgagacgccgtacgttatcaagattggtgttttaatactaattacatacaagaaaaaacgcagcaaattttaaccgcacttaatacttatcacgagcaacataatgatcaacttggtgtaagcaaagccagattatatcgaatgaccgccttaaaccagcctgaaaacttgatcaatcattttattgatgaaatgttaaaagagggaagattacagcaaactcgaggttggcttcacttacccgaacataaaatccaatttagccaagaagaacaaaaatattggtcaagtgtattcgatgaatttgaaaaagcccaaggtcaagccatttgggtacgtgatatggcaaatgctctcgctattgatgaatcaattatgcgtaattttatgtataaagctgggaaattgggttacctcacgccaatcgtgaaagatagatttttcttaactgaaaccatctatgcttatgcgagactcatcaaacaaatcgcagaagaacaaggaaaagtttccgtaaatgaagtacgtgataaattgaatttcggacgcaaacttaccgttcaactgatggaatattttgaccgaatgggatttttacgtcgcaaaggcaatgaccatattctacgcgataagaatgtttttgatttatgatttaaaaaggaaaaaagtatgaaaaaaacgctcgttgctgcattaattagttctgtcatcttgctcacaggctgccaagataaagatactgaagcaaaaataaaacaactaaatcaaacggtagcacaactcagtgctgaaaataccaaattaaaagagcaaatagaaaaaacagttccagcaattattgtggaaaatgatgaaatatttaatcaatctgaaattattaaacatcctaaatcgaaagaagattaccagcctgaagaaaccaaaattgagtattcaatttcaacaataaaaaccaatattgattggcttaatgatctattgtggaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatttaaatcctttaacttttgaatagcaatcaaaatccctaattacattaaaaatgagagactatagattttgcacttcatctttattataatagtctttcaatgtaatactaaggagaaaaattatggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaattatcttcgcccaaataaagaaaccctagcagctattgatgaattagatagtggtaacgcagagagcttctttattgaagctagtgaaaattattctgccgaagaatttacaaaacgcattcttaatggtggtcaataatgtcagaagagaagccattaaaagtaagctattcaaaacaatttgtaagagatttaactgatttagctaaacgctcccccaatgtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaatagaagtaatcttaaataataatccgcacgtaaaatgtgcggattatttttacataggattaaaattcaaactgaacagacattctgtaatttctgccaggtgcataaaagcggtttaagccttcaccagtttctgtttttactcggttaattgtgccaagatgtcgaacagagcgagcagagtcccaagtgagatattttttgttggttaaattatatacaccagcggtaaatgtaagatttttaattggtttccaataggcaatcgtatcgatcactgtatagcgattattacgccataatccgcgagaatcttttacatctttgccgtttgcttttgtagcaggtatatctgttgcattgtcagtatattgcttttcttttctggcgaccatacttgtccattgagaattaaagctatcttttgctttttttgctgcaacattagtgatatacatatccacgccccatttttggcttggtgcatcatagccaatattgtataccgatgtggttggttgtaaggcattcattggttgaggtttacgagcaatggcttcgtattctggatgttcatctttattcaattccaaaaattctttatattttggatgtaatccattgtctttgattctgcctttttgataggtaaatttatagcctaaatggaaaccttgtagtttttcaaataaatcgcccatctcaagacgtgaagcaatttcgatacctctgactcttgctcgatctcgattttggttttgatggaacggatattttattgcagagccttcttcaataggacgttcgcccacttctactaagtcaataaaattacggtaatcgttttgaaacgcatttaacgtaatataactactgtttttataaaaagtgaacgcgacttcttttgttttggaggtttcagcttttaaatctgtgttaggctgaatggaaaattgtggatgtttaaatgtcatataaatttcatcagaggttggcgcacgaaaaccattggcgtatttaagctgtacacgaagccaatttgtgggatcaagatttaaccctaaattgtaagaatgatgtttatagtcagttttgcgtaataacagggcaagattgtcttcaaaattttttttataacacggtgtgtcgtaagtgcaattttcatatcctggaggtattgagtatttactaccataaacatattcctttgagctaaatttcttaaatagcccagtaattaatccattaggaacaggaatgtttttgtcataactaggcaaatattttacgtggtcataacgataatttaaatctagtcctagccaagaggtaagttgcacattatctccaaaatacaacacattatttttagtggtaacagggattaaataggtatctttacctttattggaattcattaagctacatctgtaagcactatgatcaggtgcaggagtatgctccacaggatatgtgccatctacaggtttgttacagaaaaaattgccagcccaccattgcacattggcaacagtgtagtattgatgattcaccatactttttagtgttttttcataaagtccaccatattttagttggtgttgggtatgccataggtgaaattctttgtctaaatcaagtttaatttgttgggtatgggtgtttaaatcacggtcattaacgaagtctgtgctgtagccatggctttttggaaataaaaatttagcactttcatattgggttaatccataattaccttctgctgattttagtgagatttcaccatattttttgccatttaattctttaatggtaatatttcggtcttcataattatatttgtcattcccattttcatcttttccaacaaaaacctgaaattttttattacaatttaatttttcacaattaattaagaccgaatcaagtgagcctccttctgtatctacatcattactaacatcttcaccctttttgttttgtagttctaagccataattatattttcctgtaaattcttgattgtctttatctttaatcttataaattccaccttcttctactaaatgtagcccttgtggattacgtacaccagcacaagtggattgatgacaatactcatcagagcgtgctttattggtaattttttgtgaggaataacttagtttaatatgatcccaaaaaggggtttgactgaaattttcataactaaattgaatattttttcttttagattgatcattaataactcgctcgccatatttttcctcacatttagtatttttgcattgattgaaaatataagacaaatccataccctttgtttctaaagtggaatcatctaatgccacgctcaagcgatggttttcattaggctgaaagcccaattttattaatgtgctttggcgggtaatttgataaggatcggctttttcacgggtaggaccaaccgcacttaaatccgcctgtttattgggataaattttataatcgtagttttctatttcgtgcccatcacgttttgtatcaacgactaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcaccactaccggattttaaggagtcagcacctttggtaatagttgctgttttaacattttcaatttcaatgctattacgagtattattaaaattgccatagccttcaaataattctttaaatccttgagagcttaaggtttcagcttgacgaagcccatcaaccataatacctacacggttttcatcaacccctcgaacagcataaccacttgcgcccgttctacctgtttcaaccaccgtaatacctgtttcatagcgaacgagatcacgagaatcagacgcctgctgtttcgctaattttttggcagaaatttgggtttcacctacctttttctctttcacattaattgtttctgtacttcctgaaacattaatttgttctagttgttcagaaacattactattttggttggttggttggttggttggttggttggttggttggttggttggttggttggttggttggttggttggttggttgggcagcataagctgtgcttgcatttaatgcaaatgcaatagagcaagcaagcaggctgaatttaaagttggtcataggtttccttatttttaatgataataattgtcatatattaaataattcaatttatctaatcaatatcaaaaaaagtataataagtacaaaatctaattgctttatatgagcataaaagaaaatcatttttgaccgcacttttgtttgtaagtcatattttaaaattatcaaaatgcaatttttaatcactcttttatcgactgcgtagatttctttcgttataattgagcgtctttttatttaacaaacgtgttcggtgtggattttgaccgagtgcaaattaattgaggtaacaaatgtcattaaatattgaaacaactcaaggtttagaacgccgcgtagcgattaccgttccaactgaaattgtctctaaagccgttcgtgaagaatttaaacgtgctgcaaaaaatgtgcgcgtagatggtttccgtaaaggtcatgttcctgcccatatcattgaacaacgttttggtgcgtcaattcgtcaagatgtattaaacgatttattaccacgtcatttttttgatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggtcctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtgccagcttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagcataataagtaatattattatgattgaataaaagtgcggtcgctctttttaataaaagcgatcgcatttttatttgtgggttatttacgataaaataattagcagttttaatgaaaaaggtaagaaaatgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgttaagggtatataatgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcagatgcaaccacattaacggaagctggttatgtgggagaagatgtagagaatgtattacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatagcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttgatgaaatttggtttaattccagaatttatcggacgcttgccaatgattgccccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcgccaaaattagaatattagatttaatcgcaaaagtgcggttgttttcgccagattttctatgttgatgcttattttcaataggcaaggcgaaaagaaaatgctacaatcgcacgttcttatggcattattttttacatttccatttaaaacggattcaattctatggcaaccgaaattgttgataaaaagaaaaatacgcaagaagtgatcgttgaaggcaaatctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattctaaaatgactgaagaaacaacagtatcaaaaaaacgttggtatgtattacaagcgttttctggctttgaaagtcgtgtagctctaactttacgtgaatacataaaacaacaacaaatggaagatcaatttggtgaagttttagtgccaactgaagaagtggtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggtcgcttaaaagtgtctgtatcaatctttggccgtgctacaccagttgagcttgaatttggtcaagttgaaaaaatacactaagaaatgattaaaatataaccgcacttttgtagtgcggttttttgtttttaatgtttgttgaaacagcataaaagagtgtttttatacgcaaaatttgttgttatttcacaaattaggtagaataatcccatatttatgtaaggatcaaaaatgaaaacaaaggtaattttgaccgcacttttgagtgccattgcactaacaggttgtgcaaatcacaacgccacgaaacaagcaagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggtagctacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgattaataaacagaaaagtgcggtaaaaattacccaattttttatcaactaaggagaaaatgatgactcaaattattcatactgaaaaagcaccagcagccattggcccttatgttcaagcggttgatcttggcaatctagttttaacctcagggcaaattccagtgaatcctgcaacaggcgaagtgccagctgacatcgttgcacaagcacgccaatctttagaaaacgtgaaagcgattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgctgtaagaaaataattttctgtttggtaatccctgcttaaaagtgcggtcataaactcgcatgtttttgaccgcactttttgtttatctgctgataacaaaaattttacattacaccttgaattttttgtgaattttccccacaaaggaaatacttaaccctaactttgagagaacacattatgatgcgaattcttcttttcttggcaaccaatatggctgtaatgctggtattggggattattttaaatgtgactggtattgcaggaaatagcactggcggcattttaattatggctttgctatttggttttgctggttcattaatttccttattcctgtctaaaacgatggcattacgttctgtagatggagaagtgattactcaacctcgtaatcaaactgaacgttggttaattgatactgttagtcgccaagcacagaaagcgggaattccgatgccagacgtggcgatttatcattcacccgatgtgaatgcttttgctacaggtgcaacgaaaagcaattctttagtggcagtgagtacgggattattaaacaacatgacggaggctgaagctgaagctgttttagcgcacgaaatttctcatatttccaatggcgatatggtgacgatggcgttattgcaaggcgtattgaatactttcgtgattttcttatctcgcgttatcgcaacggcggtagcaagttcgcgtaacaataatggagaggaaacgcgcagttcaggtatttatttcttggtttctatggtattggaaatgctctttggtgtgcttgcgagtattatcgcaatgtggttctctcgttaccgagaatttcgtgcagatgctggttccgcaagtttagtaggcaaagaaaaaatgattatggcactgcaacgtttgcaacaacttcacgaaccacaaaatctcgaaggttctttaaatgcctttatgattaatggtaaacgcagtgaactctttatgagccatccaccactcgaaaagcgtattgaagccttacgtaatctttaaaaattataaaaaatcgaccgcactttaatgaggtcgatgttttattttcctcttttcacccaatatttgaacgggggcttttccacttcactttgcagtaatgtgtgatccataaattgacagaaacttggaatatctcttgttgttgcaggatcgtcagcaataatcaaaagtatttctccatcgttaagatgacgaatatttttacgaacaagcatgacaggttctgggcaacgtaatcctaaagtatttagggtttgtgtgacggaaatttcagacatattcttttttcttttgaaaaacagagccatatcataccgcacttacggcaaaatttcgacaaatcccagtcatcagtgatagactagtgtcattgaaattaccttgaaaaaagaaatggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggtagtcaattaggtgaaatcagtgcggtggtggttcgctattatggcggcattttgcttggaacgggcggattagttcgtgcttacggcaatggcgtacaacaagcgttaaagctgattgaaagcgaaattaaagttgaacgaacccctttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattggttattcaacttttagagataggcgaatagttgtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgacagcgggcacattgctttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggcctcttaaagatcaaaaatctttgcctaaaatttcagaagtggcgaaagcgctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcggtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattatttttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaataataataattggaaaattattgtatttttgaccgcactttttaataaaatgtttatatttccatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaagattaaaaacgaagcgaaagcaacgttgaaaaataaacgttaaaagataaaaagaaaatagagtatctttaattgatgtccccatcgtctagaggcctaggacatcgccctttcacggcggtaaccggggttcgaatccccgtggggacgccaattaaagataactttattagattgtcttactgttctttaaaaaattggaaacaagctgaaaacaagagattttcgagagaaagtctgagtaggcaagacaggaaagtgaaagagagaactgaaaaggaaactctaaaaacaaacctgttttgtaaaaaaatcttgattgaacaaaagcaatcaagtgtttagttgaataaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcttggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgataccataccgaactcagaagtgaaatgttgtaacgctgatggtagtgtggggtttccccatgtgagagtaaggcactgccaatcatcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccattaaaaaacctttcattttcaataatttactacattgtaaaaattttcttgtgagaaataatcctattcttgtagtgtaaatgtgacatttattcataaactttattatgtgatcgcatttaaatacgtaggaatataataatttctaataattatttttaaataattttgaccagttttataattttacattagtatacgagtcttaattttgttgtaaggaataaaaatggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacaagcagtaatgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatatatagttttagattcaaaacaacaaaaaacgcacttcacttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagatcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgtgctgcaggtaacttgttttgttgcaataaaatgcgagtacgggcaatttccacgagcaaattatcagagccggctaattctgtcgcttcaattaaatagcgatttgcactaaattcgtcgccacgttgttgagcagcttctgctgctttgatgagatttagtacaggttcagcagaatgtttagcatttttgccaattaatttttctgctttagcgtaatccccttcattcatttttaccaagccttcaagggtttgtttttgcgcttttacacgtttgcgattagaaaaccattgataagagctacgacttaaacgaaagaaacgagtgatgccccattcaaaagcataaattattgctaaagaaataatgaaaaaaatcactaaggtagtgatggacatttctataatacgatttgctgtctcaatgcgcacataaccttgctgaccagaaatataaggccctgctacaagtcctacaagcaatgtcagcattaaaaagagcactctaaacatagacttatccttattgttgtgattcagattgtgttggtttaacagcttctactttaggcattgtatcaatcgccttgtctgcttcaatttccactttttgtagatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcacttttttcaatattttgttgccagtcagtaatgttgttggataatttatcattatttttagatgtttcatcaaaatttacattcaaagcctgtaattcatcgactgtgtttgcaagctgtgacagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaatttcagctatttgttgctgaccaaaatagtatccagctccaccaatacctagcgcaacaagtattgctaataaactcaatgctgtacccgtttttttcacaatagtttgcggaacagactgcattgtttcagcttgttcaacagctgttttgggcgtatctgtaagttgttcagtgaggtcgttaggttgctcttttgccatatcaattccttaataagtgatattgagtaaggtattttataatactttgcgttgataagaaaaatatcaagctatccactaataatagaaaatatagatttttatatcggcagaattaagctatttacgcaataaaattaggtgctatcctaccactcttaggtaaaaaagtcattttgattgttgataggtaaaacttataatatattttaaaaaaattgtgatttatgtcacatttttttgcatttatactccctaagtggtaaattgttcgccaatttttgttgttctggtagggacaccacgtggaatgtaatctagcacaagcaaaacaatgggttagcgccttggatcaacgccgttttgagcgtgcattacaaggttcaggcgatgcattccaacacgttttagcgattgcacctttacttctacacctaaaccatccgcaacttcccggctatgttattcacgccccctctggcattgcgaatttccttgcttctgattatcaaaaaaaatggctcaccaatgaatacagtattcactatgccgatcataagccatcaacactcaaaagtgcggtaaattttcacgaagttttaccaccaattctaggcgtttatgtaatgggtagctttggctcaataagtcaaacctcttcttcagatcttgatacttggatttgtgtccgtgatggcttgagtccagatgaatatacacttcttactcaaaaagccaagcggattagtgaatgggcaatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggctggtaaacctctactttggttgcatttatgggtggaaaatgaaaaagactatgaaaaacaggtggcgcgtttaattactgaaggggaaatagatccaaatgattgggtggatttcggcggtttaggacaattttctgcaaacgaatatttcggtgccagtttatggcatctttataaagggattgattcaccttataaatctgtgctcaaaattttgttgttggaagcctattccaaggaatacccaaacacttgcttaattgcccgcacttttaagcgagatttactttcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcatattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgtggcaataaacattttaaagatagttggtaccttatcaatcaaccaatacaccatattatgttctccaaagaacgggtgatcgaatacggagaaagcctgaataaattagtttcttgggcttatttcaatcatttactcacagaaaaaaccgaattgtcaatttttagcaagaatgtgactttaagcacattgcaacgctttgtcactaacttacgtcagtcttttccaagcaccatcgccaaacaacctaaaaatagcgatttattgaatcaatgtgaaattcgtagcttgtttattgccataaatctcacgaccgatccaacatccaaagtagaagaagtattaacgggtatttcatcgcgagatttatttagttttggatcgcttgagcaaagccttgtgggcagtattgattttacttatcgtaacgtgtggaacgaaatccgaacgctccattttgaagggcaaaatgccattttgcttgcactaaaagtgctttctaacaaaatttatcgtggcgttaatcgcccagattccatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcggcatcagcttacaagaaatcggaaatgaatcggtctgtaatgacgctgaaagtgcggtggattttgacgaagttttacaaacaccaattgaagatggcgagacaaaccaagaaagtcgtcgctatccaccagaaatggatgccttcgcaagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatggaaaaaatggcatatccatcgtgccgtttaaattccgccaaatgaataagtaatattttcctgtggttgataggttaccgaaagatatctatacttatttcctcttttactagataaattgtagatatgataacttcgcaaacaccaatcactgtgctaggtgcgggatcttatggaactgcgctggcaattaccttttctcgcaatggttctcccactcacttatgggggcacaatcccgtccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaattaaaccgcacttaaaagcccatcaccgattaatttgggcaacaaaaggtctggagcgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcgcgggaatttcagtctcgtattcattgtagtaaaggtttccgagtttatataaattcggatatgactggcgttcaacttggtggtgcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaaacgcacaagatgtagcaatcagccttttggggcgagcatgtaaaggcgaataaaataaaaggagaaattatgacattagatgtgtggcaacatattcgccaagaagccaaagaacttgctgaaaacgaacctatgcttgctagtttttttcactctacaattttaaagcatcaaaatctgggtggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccacgcaattcaaagctatcgaattacccattatttatggaatcaaaatcgtaaatcccttgccctttatttacaaaaccaaatttcagtagctttcgatgtagatattcacccagcggcgaaaattggccacggaatcatgttcgaccatgcaacaggtattgttgtgggtgaaacatctgtaatcgaaaatgatgtttcaattttgcaaggggtaacacttggcggtacgggaaaagaatcaggcgatcgtcatcccaaagtacgcgagggtgttatgattggggcgggtgcaaaaattctcggtaatattgaagtgggtaaatacgccaaaattggggcaaactctgttgtgcttaaccccgttcctgaatatgccacagcggctggcgtgccagctcgaattgtaagtcaagataaagcagcaaaacctgctttcgatatgaaccaatattttatcggcattgatgatggaatgaatttaaatatataaggagacaccatgatcaacaaagatacccaactctgcatgtctttatcaggtcgtccgagtaatttcggtactacctttcacaattatttgtacgacaagctagggttaaatttcatttataaagcattcaccacgcaagatattgagcacgccatcaaaggcgttcgcgcattaggcatccgtggttgtgctgtttcaatgccattcaaagaaacttgtatgccatttttagatgaaattcatccgtcagcacaagccattgaatccgtaaataccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggctgcctttaaaaattcaggttttgagaaattaaaaatttacgcacgcaacgtaaaaacaggtcaatatctcgccgcactttatggctacgcatacattaattctttagaaaaccaacaggcagatattttagtcaatgttacgccaatcggcatgaaagggggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggtgcagaagtgattgtacttcaggctgtagaacaatttgaactttatacgcatcaacgcccaagcgatgaattaatcgctgaagctgcggcgtttgctcgaacaaaattttgaaataaagatatggtacattgtgtttttattaaaatttgttgctctcgatcacatttctgaatattgctcgttgcatctttataacattcatttaacattgaaccctatttaagtgatagctctaacggaggaactttatgggtgagatggcatctttaagaagtcataaaaatggcattatttttattttagatattgtgctgttttttgtgttattaaatgtattaccttttgaaccaaaagctaattctggtttggcattattagcttttatcgcggtgctttggttaagtgaagcattacacgttactattactgcattattagttccacttttggctgtggcattgggattagttagtaccaaacaagctttagttggttttgctgatccgacaatatttttattttttggtggcttttccttggcgacggcattgcatattcaaaaacttgataaattgattgccaataagattatggcactagcacgcggtaatttatttatcgcagttatttatctctttttgattacagcctttctttctatgtggatgagtaacacggcaactgctgcaatgatgttacccctcgccatgggtattttaagccagcttgatcgcgaaaaagatcataacacctatgtgtttgtgctgttagggattgcttacagtgcatcaattggtggtatgggaacccttgtaggaagcccaccaaatgcaattgtagcaagtaatttaaatttaactttttctgattggttatggtatggcttaccaataatgattattttgttgccgttgatgattgggattctttatattattttcaaaccaaaacttcatctcaattttgaacagacctttgaaaatattgaaatgaatcctatgcgtatattgacgtttattattttttcagtcattgctttaacgtggatatttagcggtaaaattaatccgtttatttcaggattactaggattacaaaaaaacattgcaagttttgatagtatcgtagccttattggcggcaattgttatttgttcaacaggcgttgcaagttggaaacaaattcaatcaaataccgattggggcgtattaatgcttttcggtggtggattaacattaagtgcggtgttgaaggattctggtgcaagtaaaattttagcggatagtattgtttttatgattgatggacaacatttctatcttattggtttattagttgcggcgttcattattttcttaactgaatttacttctaatacagcgagtgcggcgttacttgtacctatctttatttctatcgctcaatcattgggtatgccagaaattggtttagcattaattattggtattggtgcatcctgtgcctttatgctaccagtagcgacaccaccaaatgcgattgtatttggctctggtcaagtaaaacaaagtgaaatggtcaaagttggtttcttactgaatttagtctgtgttgtagttattgccactatgggttatatgttctggcttaaataatatagaattgtttacttttaataaatgatgattgaagatcataaatttaaacgtaagaagtacaataaagccatttaaataaatgggttaaagcaaatgaagctttaacccatttttcataaccgttctatacaaatctatttattgtgttcataagcataaagcgtattgctcatcaacattgcaacggtcattggcccaacgccaccagggactggtgtaatgtaagccgctttttcggctgctttatcaaactctacatcgcctactaattttccatctactcggttaattccaacatcaattacgaccgcactttctttgatccaatcgccagaaattaaatttggtttacctaccgcaacgacaagtatatctgcttggcgaacgtgattttccaaatttttagtgaatctatgtgttactgtgacggttgcccctgctaataataattctaaagacattgggcggccaacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaagaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttgtctgtttaactagatcctgtttagttttttcaaatataagcactttcagtctgttagattttatgctcataatctgcatcatttgagtgaagaagcttaaatacactcttaatgatgcagataaaaacaatattttggctatttaagtattttccaagctctgaagccataaatggcaattactacaaaacagattaatggtaggataaaggagaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaagacataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccctcagctttagtgaagcctaaacgttcagcatattgtacgataaatgtccaacacataatttgaacacccacgtaaaaggcttgtgcgatcacaccctcacgatatttagcttttttagccagtttgcttattgcacttttaaagctaatttgtccactttcttctacttttacagcaggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaattcgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaagacaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagactggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtactttcagaaatgtccacaacatcaatcggtaaatttaaggtgtttgcacggatttgattccacaatacattttttgaaccacccccaacacaaattaagcttttagcttggaactgactgacttgatgtagcacggataaaccgtttttgagtttatttgccatatgttgtaatgcgctgacataaatttctccacgagtagcaaacatggaaagtccactgatattaccttgtcctttttggctaaaaataccttcaaaattgaccgctctttttcccgcattaaaagctttttctccctctttgatcattgtggtgtaatagtgatcgctaccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacccagcgatgctaaaatcgatggatcccaattaccgctagtaaggtttgtcatcattgatgttcccgccattgtgtgatctgtagtgaattgaccagttaagcgttgagtgagcattgacgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcatttttatcaaaaggtgcgccatccacgccgaaagtggtaacagatattcctacaatatcttttaaatcaatgccttgttgtattaattgattgaaggtttgagttgcacaagagattaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagtgcagtcaaaaatccttatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgctccccaatttgccatgactgaatacacatcagtaaatgcaccttttccagttaaacgtggaacaaaccatgttgttggccaagtttcattagtacgttgatttaatttattatgtacatcttgaggtaggtcgattgaccatccttcagcaatttgtagaacgggacctagacctttaataaggttaatgcggtgcattgtaaacggtatgccacctttggttaggaattgagaagataaaccgcccccacgaaaatattcgtgaacagcaggacaccaacgcgtattttctaagcaacgttttgcttcttcttcggtgacatcccatgccggttttaaggttggattgccttgagcatcttgatgctctcctgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcatagcctccataaaatctccgtttggcaaatgatcagtccaatgacgctgcccttgaaaacctgctgcaatggcattatggcctaaggcttcttctgcataatttaatgttgctaattttggatttcctaccatcaaatcacgagtgataatggtcattttcacaacattttcccaaagttctgcacgctcttctgcattgcgttgattctctaggctatttacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaagcttgatttacaatagagcctgcaattcccatggaaactgacccaatagataaataggattttcctcgaatacttgcaacagcaagcccagcacgagcaaaacgcaataatttttcttttacatcttcaggaatgtttgtgtcatcagcttcttgaacttctgtaccgtaaatggaaaaggctggtagtcctaattgagaatgaccagcaagggcagcagctaagtaaaccgcgcctgggcgttctgtgccgttaaatccccaaattgctttaggcatgtgaggatccatatcaatggtttctgatccataacaccaacaaggggtaacggtaatggttaatccaacgttttcgcgtttaaatttatccgcacagacggctgcttcagctacaccaccgatagtgctatctgcaactacacattcaacgaaagtaccatctgtatgacgaatatgtgtttgtaataattgagcaacagattgagccatacgcattgtttgggtttcaagagattctcgaactcccattcgacgaccatcaatagttggacgaataccgatttttatgcgatttaattgagtagcaagagccatagttacactcctttgtttgtgcttaagtaagaatgatgaaatcactgcggaacaaattgtgctttcattgaattagagtgtgaaagaaaaatgatgaggaaaatagtaagaaatgaaattttgttgcaaaactgagaagcagatcacaaaaattgaccatatttaaggaaatatatatgaccgatattttaaatttttaataattttcggtcaaaatggtcatatttttttataaaacggtcattatatcgtgtagctcacaatatttttgtaagttatctggaagtggttgatcagaaaaaatcgtattaattttgcttaaatcggtaagttgaatcaaacttttcttttcaaacttagaagaatcaattaacaaataagcacgttctgaagcctctatcatttttcgtttcaaagaggcattcagctcatttgattcccagatattaccgttttgatcaattcctgaacaagaaaacacggaaaaattaatatgtaatcgttgtaataaatactcagataagggaccgtaaaatgcttcatattttgctgaataaactccgccagtgacaatagttttaacattggatttattaactagggcattaatgttaaacattgagttggttactactgtacaaggaatatcgggcattaaataagcaaaataccaacttgttgagcttgcatctaaacctataacggcattttcatatagcaaatccaaggctttttgggcaatatgtcgtttagctgttgcattaatatgttttcgagtttggaaaaatgaacctaaatctttggttttattactcactgctcctccgtgtgttcggtgcaataagcctttgttcgctaatttgttcaaatcgcgacgaatggtttccaccgaaatatcacaatgctgtgcaagttctattacgctggcttttccttgttgatttacccattgtaaaattaattcatcacgataattcatctcttttccctacacggtggatttagtcgagattctagtttacgcttgagtatgttgaaaatccaagaataaattatattgggggtgacgtatatcttcataaaagtgcggtcaattttttgtgagtttcttttcaagagtatgcgagctacaatacgccccaaaattttatcaatgtaaatcagaaagagaattattatgccctttgctattggtcagcgttggttgagtgaaagtgaaaacgctttaggattaggtgttattaccgcattagatcaacgaaccgtcacgatttatttccccgcagcagatgaaacgaggatatatgctgctgcacaagcacctttaagtcgaattgtgtttagcaaaggcgaaacattatcccatcaagctggctggcaaggcgagattttagacgttcaaaatatgaacggtttgttgttttatttagttaaaaccccacaagatgaagatgtcattgtgcaagaacgtgatatttcgccgattatttcttttagccaagcgaaagatcgtttgttttcagcgcaaattgatcgcagcagtcattttgcattgcgttatcgcacgctttgtcatcagcaagcacaatttaaatcgccattgcgtggtttacgcggaacgcgtgcgggtttaattcctcatcagcttcatattgcagctgaagtcggtaatcgagttaatcctcgcgtgttattggctgatgaggttggtttagggaaaaccattgaagcaggaatgattttgcagaatcaactttttgctgagaaagtgcaacgtgttcttattattgtgccagaaacgttgcaacatcaatggctggtggaaatgcttcgtcgttttaatttgcatttttcactttttgatgaagaacgttgcaatgattttgatcttgatgctgttaatccattcatgactgaaagcttaattatttgttctctaaattggttagaaacgcatccaaaccgagtagaacaggcacttgatgctcaatttgactgtttaattgtggatgaggcacatcatctggtatggtcggaaagcgcgccaagtgcagcttatttattagttgaacagcttgctcgcatcattccctctgtcttgttactcactgcaactccagagcaacttgggcaagaaagtcattttgctcgtttgcgtttactggatccagaacgtttctttgattatcaaacttttgtgaaagagcagaaacgctaccaacctgtggttaatgctattgaatctttgctggcaaataaggcattaagtgcggtagaaaaaaatcatatttctgatttgttgcttgaacaagatgttgagccactttttaaagcgattgcatcaaataatgatgaagaacagcatcgtgcccgtcaggaattgattcaagccttaattgatcgtcacggcacggggcgaatgttattccgcaatacacgtcaaggcgtgaaaggtttcccccaccgtgtttaccaccaaattacactctcggaagagaatgataaaattgattggctgattaatttcctcaaactacatcgcgatgaaaaaatttttgtgatttgccagacagcggcaacagcgattcagttagaacaaattttgcgtgaacgtgaggcgattcgtgccgcagtgttccacgaaaaaatgtcgattatcgaacgggatagagccgccgcttattttgcggatttagaaaacggcgcacaggttttactgagctcgagtattggctcggaagggcgaaatttccaattcgcagcaaatttagtgttatttgatttaccgacaaatcctgatttattggaacaatgtattgggagattagatcgtattggacaaaaacgtgatgtgcaaatttatgtgccttgtgcgaaagattcgcctcaaattcgtttagcgcgttggtacaatgaggggctgaatgcttttgaacaaacctgcccaatgggaatggcattattttcgcagtttgaggacgagttggaaaaagtgcggtcaaattctaccgcactttcagagaatgaattttctgaattattaaaacaaactaaaactgtgcgagaaaaactcaagattgagttagaaaaagggcgagatcgcttgttagaactaaattctaatggtggaaagcaagcacaagcgttagcggatcaaattgctgatgaagataattcgcctgagcttgtgaattttgccttaaaattatttgatattattggcgtagagcaagaagatcttggcgcaaatagtattgtaattagcccaacagggacaatgcttgtgccagatttccctggtttaaaagaagaaggtgtgacggttacctttgatcgagaacttgcccttgctcgcgaagaaatggaatttttgacttgggatcatcctatgattcgtcaaggtattgatcttgttgcttcgggagatattggcaaagccgcaatggcattgcttgtaaataaacaactgcccgctggaaccttattaattgaattgatttatatagtggaaagtcaatcgccaaaagggttacagctcaatcgtttcttgccgccaacgcctattcgtctgctgcttgataacaaaggaaataacattggtgagcaggttgcctttgaaacattgcatagcaaattaaaaccacttggtaaaaatattgctaatcaaatggtaaaaatggcgcggggtaatattgaagccttgattacacgaggcgatcaactcgtaaaatctttagctgaaccgattattaccgaagctaaaaatcaggcagatcaacaattaagcgcagaaattaatcgtttgcaggctttgcgagcggtaaatcaaaatattcgccaaagcgaaattgatattttggaacaacaacgaacacaatcactggatgagctttctaaagcaaattggcgtttagattgtttgcgtgtcattgtgacgaacaaggaataaaaatggcattgattgaatacaatccgccccttgaaccttatttagatattatttatcaagataatcatttgtgcgtagtgaataaacctagtggtttgctttctgtgccgggtaatcaaccacaatattacgatagtgcaatgagccgagtgaaagaaaaattcggcttttgcgagccagctcatcgtttggatatggcaacgagcggtattattgtgtttgctttaagtaaggctgctgatcgtgaattaaaacgtcaatttcgcgaacgtgaaccgaaaaaacattatcaagcgattgtttgggggcatttggagaaagattatggcgaggtaaatttgccaatgatttgtgattgggaaaatcgtcctcgccaacgtttggatttcgttttagggaaaagagcggtcacaaaattcgaagttttagcacgtttgcccaataacagtactcgcgtgaaactgacgcccgtgacaggcagatctcatcaattacgattacatatgttggctttagggcatccaattttaggcgataaattttattcacatcctcaggctaaagctatgtcgccaagattatgcttgcacgcagaagaattgacgattacccaccccattacaggggaaacaatgacttttaatgcgaagtcagatttttaaatttccgtagaaacacgagatcacgaatgaaaaactttttagctcaacaaggaaaaatcacgctaattctcaccgcactttgtgcgcttatttatattgctcaacagctgggttttgaagacgatattatgtatttgatgcactaccccgcttacgaagagcaagatagcgaagcgtggcgttatatttcacatacattggtacatttatctaatttgcatattttgtttaatctgtcttggttttttatttttggtggaatgattgagcgcacttttggttcagtcaaattattgatgttgtatgttgtagcatctgtaataacaggatatgtgcaaaattatgtgtctggccccgctttctttgggctttctggtgttgtatatgcggttctaggttatgtatttatacgtgataaattgaatcatcatttatttgatctgccagaaggttttttcacaatgttattggtggggatcgcattaggttttattagccccttatttggtgttgaaatgggaaatgctgcacatatttcaggcttgattgtcggcttgatttggggatttattgatagcaaattgcgcaaaaattcgctagagtaagtccgtttaatttggataaaggattcgctatgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaggaagttgcaaagttgattcctaacggtgcatcgttgtttattgatattggtacgacgccagaggctgttgccaatgcgttgcttggccacgaaaaactcagaattgtgacgaacaatctgaatgccgctcatcttttacgccaaaatgaaagttttgatattgttatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaaaaatatctttgattttcttattaatttgtcgataaaagaagctattactcttaatttttgatttaattgaaatttatctaaaagtaatctaaatattctctcgctgaattattgtcttttctataattaaacatttccaagcgtaaaagtatcttgcttttttaatcaattaaagaaatttcatatttctgtattatctaattatttttagctaccaatattctttaaaacattccgagcttagataagaaaatcccttgctgggcaagggatttagtaatgggttaaagtgcggtagaaattaccaaccttttacaacgccatctttaaagtgtttttgagcttcttggtaaacttcttctgtttggtaagattttacgaaatcttgaacagctttgctgtctttgttatcggtacgagaaacgataatgttcacatatggcgaatctttatcttctacaaatacaccgtcatcttgagcatttaagcctacttgacccgcataagtattgtttactacagctaaatcaacgtcgtctaatgcgcgtgccgcaacagaagtatctacttcagtgatgtttaattttttcggattttcaacaatatctaatacagttgaaagaaggttatttgcatcttttaatttgattaaaccttgtttttcaagaagaattaatgcacgaccacggtttgttggatcgttaggaacaacaactttagcaccgtcttgtaattcattcacatttttgatttttttagaataacccgctaatggatagacgaaagtattacccacgataactaagttatttaaatttttcgcttttgcatcttcatctaaataaggtttatgttgcattgcgtttgcatctaaatcacctttagatacagcttcatttggtaatgcgtagtcattgaattcaacgaattgaacgtctaaaccgtatttttctttagcgacttttgctgcaatttctgcaacttgatgctcaggaccagacattacaccaactttgattttaagcggtgctgctgcagcttcaggttttttgtcttctttacagcctgttaaaacgagagctgatgcgattgcagtgattgcaaaaagttgttttaatttcataggatttccttcctgtttaagttaagagttgcatttaattaacgatgatccacttttctagccagtgtatcgccgagtttttggctaatcataacgaatagcacaataataatggttgccacccaagtgacataaggcatattgcgatatacgccgtagttgatagcgaggctacctaaaccaccgccgccttgcgtccccgccattgctgagtaaccaactaaagtgactagcgtgagcgtgatgccattaattagcgtaggtagagcttctgacaaatagaatttacgaacaatttgccatttagtagcccccattgcttgagctgcttcggttaaaccatttggaatttccattagtgcattagcagttaagcgagccacgaatggcattgcacaaatactcaatggaataattgctgctgttgtacctaatacggttcccacgatgaaacgagttacaggtaataagattaggagcaaaataataaatggaatggaacgcccaatattaataatcgtgtttaacataaaatgagtgcggttgttttgtaaaatctcattttttccagttaagaaagtccatacacccacaggcacgccgactactacggcaagtaaagtagatgcaaagctgatataaacagtttcataagttgctgttgcgacacaccccacatttgaggtgttaattgctggctgaatgttgccaagaaatcattgaacataaccaagcacctccacgcgcacgttgttttccattaaataaactttggtttgcgtaatggcatcttcatcgccttctacttcagcaatggtataaccaaatttcacgcctccagcataatcaatttgtgaggttaagatactgagctccacgccaaatttttttgatgcttgagaaagtaacggtgcatcgactgagcgacccgtaaactcaaatttgatgattggatacgctttgctgtgtttcggtgtatcagtaagattttccaaatattcatcaggtagactgatgtggaaggtcgaacgaataaactcttgtgctaattctgttttagggtttgcaaaaatttcaccgacagtaccttgttcaactaggcgaccttgatcaatgacagcaacttgatcacaaatctgtttaacaacttccatttcatgggtaatcaacaaaattgtaatacctaaagtgcggttaatttcttttaataattgcagaatagattgcgtcgttgcaggatctaatgcgctcgttgcttcatcacataataagactttaggatcgctcgctaaggcacgtgcaatggctacgcgttgtttttgcccgccagaaagattgcttgggtaagcatcacgtttttcacttaaaccaacaagatctaaaagtgcggtaattttttcttggatttttgcttttgactcactttccaattctaagggtaatgccacgttttcaaatacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagcgcagtcaattttttgttcggtagctcaaaaattttcgtaatattatttagcttaatcatataagccctttttatttattgtttttaaatctgttttggtattctagatgtctagattgctatgtcaatatgtcagattatcttttttagacagattagttatgacttatatttgctaattgcttggattaaatagataattttcgtcaatttgacatgtataaaaggcaagagaatgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaaatattttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaacccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgaggcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttaccaaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaagcgaaaggtgtagtgtaaataaataataactaaaaggtaaataattagttattaaattatgatgaaatggggatatagctcagctgggagagcgcctgccttgcacgcaggaggtcagcggttcgatcccgcttatctccaccacttatcatcgttaaataaattagaaaaagacaaattaataaagtattaaggtagtgatgaagctattttaaatattaggttattgttattttaagtttaattttaaatttaattttgttttagttttagtttatttaacgatgataactgaaaagttttatcaactgttctttaaaaaattggaaacaagctgaaaacaagagattttcgagagaaagtctgagtaggcaagataggaaagtgagaggagggaactgaaaagggaactctaaaaacaaaacctgttttgcataaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcagtatagtgaggagaatgtgttgggaagcacaatcaaagagggtgataatcccgtatctaaaaaccatattgtggtactaagctaacgagaagtagggcgggacacgtgatatcctgtttgaagaaggggggaccatcctccaaggctaaatactcctgattgaccgatagtgaaccagtactgtgaaggaaaggcgaaaagaaccccggtgaggggagtgaaatagaacctgaaaccttgtacgtacaagcagtgggagccccatcacttaatccgattggaaggtgatgaaaagcaaccgcacttaaacaatggtaagaggagcgaagcgagtcaaaccacccaaaagaagcagtgggattaagtgatggggtgactgcgtaccttttgtataatgggtcagcgacttatattttgtagcgaggttaaccgaataggggagccgaagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctaggggtccatcccggattaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcaggcgtatcactaatacgccttacgattaacaagctagaatggcgcgaagcggcatgaaaggttgttcaagcaacccgaacgttgagtcggggtatttttgaagtaaggattattagtgatacgcctgttgggtaggggagcgttgtgtaagcggatgaaggttaatcgagaggttagctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtagtccctagcgggcgaaggttgaaccggtcgaagataccagctggctgcaactgtttattaaaaacacagcactctgcaaacacgaaagtggacgtatagggtgtgatgcctgcccggtgctggaaggttaattgatggtgtcatcgcaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggatgattgattggggctgctcctagtacgagaggaccggagtggacgcatcactggtgttccagttgtctcgccagaggcattgctgggtagctaaatgcggaagagataagtgctgaaagcatctaagcacgaaacttgccaagagatgagtcatccctgactttaagtcagtaagggttgttgtagactacgacgtagataggtcaggtgtgtaagtgtagtgatacattgagctaacagatactaattgcccgagaggcttaactatacaacgctcaagtgtttttgggagctaagtgaagtaagagatgaaaagcgaagcaaataaaagtagagcggaaaccgaagtaaaagactaaacaaagaaaagtaaatatagaagacttaatagagagaaaattgagttcagcttgtggccaataagaacgagtgaaaggtagagtaaagactgagtaacgagagataaaagagacgagagataaaagagaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcgaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttaggtaatctatgatttggatattttttgtcatcgcacttttcttggtaactggattgactctatatgcaatccgtttattaaagcagttaaaagttcaaaaggaattgattgctaaagctaagaataatcgggttatacgattaaaagagagcattgatattattgctcgtgcaatgcagtctggagaatgtaatctttctgaaggcgtaattcgtcttactatgctattaaggccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatttaaatattataattttaaagaaaaatgcgctaagtctctcctagcgcattttttatgattatttttaacgattttgttcaaaaaataataccgttgctgcaacacgagaatgaacatttaatttacgtaataaattacggatatgtacttttacggtttcttctgaaataaacagttgtgctgcaatttgtttgtttgataagccagttgcaatttgacgaagtacgcccatttcacgatccgttaagctgtctaacggattatcttcgtgagtacgttctaataataaatttttaatagaatcactcagaatgacttcgccttgtgctatgcgcttgatttggtctagcaatgtatcaggttcagtatcttttaacaaataaccatctgcacctgcatcaattagagtataaatatcattttttgcatcagacactgttaaaattaaaattcgcgcatcaacgccttctgcacgtaatcctttgagcgtatctaacccagaaagtcctttcatgttgagatctaaaatgatcacatcaggtgatgtttgtaatgccacagaaatcccttctgtgccgctgcttacgtcagccactacttcaaagttatcgtctaattctacaagttgtttaatgccacgacgcattaacggatggtcgtcaatcaataaaacttttagcttatcttgcataatttctcctttagtggttagaagtccactttaaaaagcatgacattttataaagaattcaattctatgccaatctagaatagaaaaaaatttgatttatatcacaaacttactatttgaggtaggtttattgatggataaaaatagaaaaagtgcggtagaaaaatagataattttttaccgctcttttttaagataagaaatattaaatggtcgattctaatgcccaaagttcctgtaaggtttctcgacgacgaattagataggattgatcgccatctactaaaacttctgcagtgcgggctcttgaattatagtttgatgacatacttgctccataggcaccagcagaacattgagcaatataatccccttcagcaattgaaagttcccgttgtttgcctaagaaatcagacgtttcgcaaacaggccctacaacatcataaatggctttttctctttctaaagtgcggtcaatttcgacgatgttcatgtaagcctcatacaatgctggtcggatcatatcgttcattcctgtatcggtaatggcgaaattacggctttcattactttttaagtattgtacttttgctactagaattcctgcatttgcagaaattgctctgccgggttcaagaataatttcaagttcgggataattttttagtttttctaataacgcatttgcgtaatcgcttggatgcggtggtgtttcatccgtataagtcacgcctaaaccaccgcccagatcgagatgttttaatgtaattccatcttcttttaattgttccattaggacaattaatcgatctgttgcatctaagaatggttgtaattcggtgagctgtgagcctatgtggcaatccatccctgttatttttatgtttggtagcgttgaggctaatttatatacctctcgagcttcatttacgcttacaccaaatttattttcttttaatcctgttgaaatataagggtgtgtatgagcatcaacatctggatttacacgtaaagaaataggtgcgattttacccatttctcccgcgatttggttaatgtgcttgagctcagaaactgattccacattaaagcaacggattccaacttctaatgcgcgcataatttcttctcgagatttcgcaacgccagaaaagactacttttgacgcatcgccacctgctgccagtacacgctcaagttcgccttgtgagacaatatcgaaacctgaaccaagttttgccataatatttaacacgccaatatttgagcaagatttcacggcaaagcaaattaagtgaggacgcttaccgaaagctgagtcaaaagcgtgccaatgacgttctagtgtcgcgcgagaatatacataaagaggtgtaccgaattgttcagcaagttgttgaactggcatatcttcggcataaagtttgttatgtttatattggaagaaattcatgttgtgtgcctgttttagttattttgggaatgatattagataatagattattgagtttgttgagcttgatctttttcaggaaaatataaagaaccttttacgccgcatcctgttgtcacaatgcaaattgcactaagcactaaaattgatagtagttttttcatttttctctctctcacttatcggtaaatccgcctttcacaagcttgagaaaggctttataatttgccacattttatcagatttaaacaggaacattttatgaatattgcagaatttcaccaaaatattgaacaagtttggcaaaaaattgaagaagaattggaaaaccaaggtgcagatgtagattgtgaaacgcaaggttcagtatttacaatcacctttgataatcgcacacaaatagtgattaacaagcaagaaccgctgcttgagctttggattgcaagtaaattaggcggtttccattttgcttttaaaaatggcgactgggtttctaatgacggacaacgtttttgggattgtttcgttgaagcctgtgctgcacatggcgagaacgtgcagttctaaaatgctggattctcctttaccatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaaaaagatattctgcggcatcttaatctgaaaaatctgcacaaatatattggtagttttgatcgaccaaatattcgttataccttggaagaaaaatacaaacctatggagcaactgacacgttttgtgttggctcaaaagggtaagagtgggattatttattgcaacagcagaaataaggttgagcgaattgcggaaagtttacgcaataaaggtgtctctgctgctgcttaccacgcaggaatggaaacggcaattcgtgaacgtgtgcaacaggattttcagcgtgataatgttcaagtagtagtcgcaaccattgcttttggaatggggattaataaatccaatgtgcgctttgttgcccattttgatttaccacgtagcattgaatcttactatcaagaaacaggtcgagcaggacgtgatgatttgcctgccgaggcggttttgttttatgaaccagctgattacgcttggttacaaaaaattctcttcgaaaaaccagaaacgccacagcgtcagattgagcagcataaattagaagctattggggaatttgcggaaagccagacttgtcgccgtttagttcttctcaattattttggcgagcatcgacaaacaccatgtaataactgtgatatttgccttgatcctcctaaaaaatatgatggcttagtcgatgcgcaaaaagtaatgtctactatttatcgagtgggacaatgttttggtgcacattatgtgattgcggtgttgcgtggcatgcacaatcagaaaattattgaacgccaacaccataaactttcagtatatggcattggaaaagataaaagcaaagagcattggcagtctgttattcgtcagcttattcatttgggttttgtgcaacaggttattagtgaattaaatccaacgttgcaacttactgaaagtgcgaaagtgattttgaaaggcgaagaaccgttagaattggcaatgcctcgtatttcttcaatcagtaaaattgcccataatccacaacgtcaaggtgttgcaaattacgataaggatttatttgcacgcttgcgtttcctacgcaaacaaattgccgataaagaaaatattccgccgtacattgtctttaatgatgcgacgttgcaagaaatggcacaatatatgccgacaagcaatattgaaatgttgcaaattaatggcgtgggctctatcaaattagagcggtttgggcagccgtttatggcattgattcaagaacataaggcaattttggcgaatgcgcaaaataatgactaagtgttaaaagtgcggttaaaaatgaccgcactttttgttatacttgcgccaattttttcagttcttagaatttaaggttaaacaatgcgtacaagtcaatatttattttccaccctaaaagaaacgccaaatgatgctcaggttgtgagccaccaattaatgttgcgtgcaggtatgattcgcccaatggcatcaggtttatataactggttaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgtggaaaccgtaactttgtacttgggccaactcacgaggaagtgattacagatttagtccgccgagaagtttcttcatacaaacaacttccacttaatttataccaaattcaaactaaattccgtgatgaagtgcgccctcgttttggtgtaatgcgttcgcgtgaatttattatgaaagatgcgtattctttccacacgacacaagaaagtttgcaagcaacctatgatgtgatgtatcaagtatacagtaacatttttagacgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgccaagctccaaccgctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgagatcaaagcacaaaaacacccgttagtggcagatccccttgagtttgcggacgaaactgaaatcaaagcgaaaattggtgcgggcgtgggatcgttaggcgcggtaaatcttaatattcctgcaattattgaccgcactgtggcgttaatgtctgattttagttgtggtgcgaatattgatggaaaacattatttcaatgtgaactgggtacgcgatgtagcaatgcctgaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagcgattgaacagcatcatgatgatcgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggcgtgatgtttgcagacatggaacttatcggtataccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctctaatcagtattttattttgtatattgtgacaaaagagcggttaaaaatagccgctctttttgttgatctaacgtttatattgaacaatgtttaatccaaactaaatgctcgaatataaggtagttttcctttttctaacatctcttgaataccgctttgatggtcattgctgcctaacccccttaattctaaggttatgccaatgctattatcataaacaatttcattacgtgtttggttttggtggtttgtgacattgcgttttacaccaacacttgcagcccaacagcaactgttatattgaacgcctagatattgttctactggtttttgtaaggcgagatcttgataatagcgtcctactacagcccaattattggcaatttcccagcctacaactaatcccacttgttggatatcttgttgataggcgttagccgatttacctaagttttggtcaatatattcttggttcacatatcgataatttaactgaattaaattatttttttcaggattatattctagtgatgtattcgctaatgatgttgaattggtatgagtatcaaattgatagctaccacgccaataccatttattacttattttccaattagattctaatgcccaagcagatgatgaagttggtgttttattcgcagggttttcatcaatacgagaattacttaagtaataaatttgacctgcagataaattaaatcgttcttcgccagcaatatcataaaaacgcgttgtgccacccaaggtaacttgatttgccgatgaaattcgatctaaaccactataacggcgatcacggaatagcgaatagtaatcttgctgtactaatgctgaatcgtaaccaaatcccaaataatcattattaagtgttgaaccaatattgctttgatttcggtaaggacgatataaatactgcacgtgcggttcgaaggtttgtgtatactcttttaagaacgttatatcgcgtgataatacactttgtaaatcaactttaaattgtggaataactcgatttaccgttttttgcacgtcctctgcattttttcctgaaccttttttctgctcgtaacgagtcgcataaagtttcgtttcaatattcaaactgccgtatttatttgacattaaagaatttaggctaggttctgcatggaaacgccatgcagttggcatcaatttactgtcattatcaaaacgaactgcttgtgaatgtaatttgaaatttaaccatccattcgctaaatcatatttgtgatagttgaaatctaattgtggtactgcacggtaagggccgatgtttacaatatcatcaaaaatttggaactgatgtgcagaaagagaaaaattataatttggttgataataagctatgcgagcatattggttcgcataaccatcggtactgcgtccataaatagaatcaaagtcgttgaaataacgtttatcgcttactcgggtgtaattaatatttagacgccaattttgtaaaaagctagaattgtgattccaatagaacaaatgacgttttcgattatcactagcatattcagagtaacgatccttacctaaatattctcctgccactttaccttcgccaatggaggttaaatagcgaaattccccatttgcttgccaaccacggcgagacatatatttcggggtgaaagtaagatcataattaggagcgatattccaataaattggttgtgcataccaaagaccatctcggttagatgttcccgcgcttggaatcaataaaccagaacgacgacgatctccaatgggtaattgtaagtaaggggtataaaagacgggaacaccatgtattttaaagcgagcatgccacatttcagcatattcttctttcacgtattgacgaatttctgacgcatctacagcccaagcattgtcgccgtgcaaacatgacgtaaaggttgcattcttcattacacgataattattatgcagtgttatattatcagctttaccacgtccttgacgaccgacaaattcatattctgaatttgttaaattaccatcgtgactatctaaattaaactctgcatctttacccaacatattgatctgattatctttataatcaaatccattgcggacataagccatgcgtaaaggtgttgattggtttccagattgtttgacctgcacggattgtgctaacaaatggcgattgccttgtttcaaatctacattaccttgataggtcgcatcatttggctgattaatttctgcgttatccgcttcaatatatacaggcagagaattcacatcacccgtcacgacttcaccgctaaattttggcacgcccattaaacattgttcgtgcaaatctgccaaactttgttggctataaagtgcggtcaaaatagcaagtgaaattaaagtgtgttttttattcatcgtcttgttttaatttgtcagaaaattggtcagattatactggaaaaagtgcaaggctagtaatatttttcaagaagtgattattaatagaatatccactgggttatgattaaattttttgtctattgaaccatcaatacgccaagacagcccatatcttctaacattaaattcgataccccaaataagaatgggaagttgccagaagatgcttgatcaaatttcactaaaatttgagttttgttttttacccaaacggtatctttccaagctaattcttcagcttgtaattgatgttctccttggctttccaccacaaatttggcaccttgaatagtaaatccaacaggtaaacttgcatttaaaatccagcgttcaatggtgcctttacgagccataacatcaaccttgcgcgggtcaaaacgtctttgattaattaaaccgtttgtgacatcaatattaaattctcgagtttgtgcaacggcttgttgtaatattgctggtgcatccgtttcgaaagttagattcggttgtttgttaaatgcggatagttgtccttgagcacgtaattcaaggacggtgttattagcgagttcatcgcctgagaacaacatattttttattttttcgtacaagctacgtttacttccgctaatgagagatacgttgtcaatttcattcatattaaccagtatttctgcgcgttctcctggcgagagaaccaaagatttgactgatttcgctttgggtaagaaacttaaatcttgtgcaataagtagcatttcttgatcattatccaagcgtaaatcataagcacgcgctaatgaggcattgagcaaacgtaaacgaatccaaccccgtgcaacatctaaatatggtgcttcaataccattcactaataagcgattgcctacaaagtgcggttgattttgtttgaataattggagaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagacaaggcaacggattgtggcaaattgttatgataattaagtttggcaaagctacctgatttgattttaatggttgggccaagataattaccgttgaatccccataccgtcacattgtgtgagccatctaacggataattcgtttcctgcatggttaatacaatcgggcgaccgcgacgaacttcaattagtggcggcacaactagtttttcacggcttgccgctaacaatggtgctggcacggtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgccgcatggaatgcacccgttttaaagggtaataaaccgcgaccgcgattgcgagtgccttctgggaacatccaaattgataaattatcttcattaattcgtcgtgcaagctgtgacatcgtattatgcgcttttgtgcggttttctctatccaagaaaatattacccgttacccaatataaaatgccgaagaagggtatccaaattaagctttttttacccacacttactgtgcgaggttgcaccatataagagattgttaccatatcataattattttgatgattaccgatataaatggcgcggctaatttgcttctgatcttgaggaatacgatgttctacctttaagccaaaaagtggatataagcgtccaaaccaacgagcaacaatgcctacgttgcttggatttttaaagcggataaaagaataaatcgtacccagtacacaaattagaatacagcagattaatacgaggaaaattcgaagtagttttaacataaggatgccctatacaaaatttcgttaaagtatagcaaattcaatatcaatatgtgttaatctaaacaaaaatcgtggaatttttatgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaagtgcggtaaagcaaaaactcgttattttacttaatgatactagaataatacttatccataaaatcgtacctaaaagctggtggataagcccaacttttagatacagataaaagtgcggttaattttaggattagttttctttcggtaagcgaagcgacgcgtaaattaatcctccccacaataaagtaagggctatgatcatcataataattgcgccagtagtcattttattctcctttagtttcatcaatcgttaatttggtttcgcttttccattttaagcgagaaaggaaaaatgccacgacaagtaagctaatcgacattccccaaccaaaggtatttacaaaccagtttggatagccttcgtaaccttcagagaagacttttgccccttcgctgaaaagcataaatgctaaaacaccactcgttaatacaatgcataaacgccagaagaaacccactttgaaagatgacgtttcatttaagtgattacccaataaaccgagtttttcatttgctacaatcgcaattaaagacgcaaatgctacggcaacaataccgaaatagttcacaaatttatcgaacacatctaacatcggtaagccagttgttgtaccgaataagatgacagaaactagcatcattggtacacccacgatgaatgtcacttttccacggctaatacgaattttatcttgaattgcggaaataattacttcgataactgagatgaatgaagtcaatgcggcaaaggttaatgcaccaaagaataacatgcctagcacttcgccaaatggtgctttgttgatgatggttgggaatgcgaaaaatgctaaaccaattccgccttttgctacttcgctaacttcttgaccttgcgctgttgcaataaaacctaatgctgcaaatacgccgatacctgctaacacttcaaagctactgttagcaaaacctacaaccaagccactacccgtcaaatcggattcttttttaagataagaggcgtaagtcaccataatcccaaagccgattgaaagagagaagaagatttgcccataggcggcaatccacacactcgggttggataattttgtccaatctggtgtaaataatgcatctaaaccttttgccgcacctggtaagaataaggaataaatcacaagcaccataaacatcacgacgagcactggcattaatacggaagagaccttagcaattcctttttgaacacccatagaaagcacgcctaaggcaacaatccacatcgcaattaatggtgcggttaccataccaacaaattcaaagctgataccgtttttaatatcgcccatttttaaaaattcaccgatgaagaaatcaatgggtttatcgccccacgcaccagtgaaagaaaaatatgtgtagcttgctgcccagcctaacactacagcgtaatataatccgatgatgacattcaccatcatttgccaccagccaaacacttcaaagtgcgggctaacacgacgataagaaagtggcgcaccaccacgatgacggtgcccaatggcataatctaggaataaaagaggaatccctgcggttaataatgcaataaggtaagggatgataaatgcgccaccaccgttttcataagtggtgtaaggaaaacgccaaatattaccaagaccaacggcagaaccaattgctgccagaataaatgcgcgacgaccagaaaaagtctcacgcttttgtgctttggagctgagtgcaccataaattatcctatgtaaaaaaatgaaaagagtttcaatataatgaaatctaacaatcagtcaataagcaagcttaaagagcggtaaaaattcactaaattttttaggggaagaacaggaatattcaaaataagccaattttcaccgcactttttttcgtttttttctctccaagccctaccaatgactcgaaatttcgctacaatgctaaacttatcccaaaataaaaataacaggaaacaaacacaatgacaggtgcacaacttatcatggcgtgcttgaaagcacatcatgtcacgactcttttcggctatcccggtggcgcaattatgccaacctacgatgccctttatgacgcaggcttagatcacttactttgtcgtaatgaacaagggactgcaatggctgcgattggctatgctcgctccacgggaaaagtgggcgtctgtattgcagcatcaggctctggtgccactaatttagttattggattaggcgatgccatgatggactccattccagttgtcactattgaaccttggcgtgaacaaatcagaaatttcaaagcaaaattagatttcacttatgttgaaaatcaaggcaatcgcccgattgatccttgggcattactcaacagcctatctaatcgcaaaccaaataatgcgataatttgtactgatgtgggtcagcatcaaatgtggtcagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaattaatcatacaaacgaaccctaaattttactcggagagattatttatgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaattgaaaaagcgggcggcgtagcaaaagaatttaacaccattgcggtggatgatggtatcgcgatgggacacggtgggatgctttattccttaccaagccgtgatttaatcgctgatagcgtggaatatatggtcaatgcgcactgtgctgatgcgatggtgtgtatttccaactgtgacaaaatcactccaggaatgttaatggcggcaatgcgtttaaatattccaactatcttcgtttcaggcggcccgatggaagcaggtaaaactaaactttctgatcaattaatccgcttagatttagtagatgcgatgattgaggcagccgatccaaatgtaagcgatgagcgtattgatgcgattgagcgtagcgcttgcccaacttgtggttcttgctctggcatgtttaccgctaactcaatgaactgcttaactgaagccttaggtttatctttacctggtaatggttctatgttagccactcacgcagaccgcaaagaattattcttaaaagcaggtcgtcaaattgtcgagctttgcaaacgctattatgaacaagatgatgcaagcgtattgcctcgttcaatcggtacttttgatgcctttgaaaatgcaatgagcctcgatatcgcaatgggtggttcaagtaacactgttttacacttattagcggcagcacaagaagcaggcgtggattttaaaatggaagatattgaccgtttatcgcgcaaagtgccttgtttaagcaaaattgcaccaaacaccaataaatatcatatggaagacgtacaccgtgcaggcggtattatgggattgttgggtgaattagatcgcgctggattaattcataaaaatacacacaccgtgcttggaatgagcatgggagagcaactagaccaatacgatattattcgcaatcaagatgaagaattacataaattcttccgtgcaggccctgcaggtatccgcacaactcaagcattctcacaagattgccgctgggataccgttgataatgatcgtgtaaacggttgtattcgcaataaagaaaatgcgatttcacaagaaggtggcttagccgtattattcggtaatctcgctgaagacggatgtatcgttaaaaccgctggtgtagatgaatctatttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccatattgaaggcaaaaatatggcggcaattttgtctggcgcgaacttgaatttccacacattacgttatgtatctgaacgttgtgaaattggtgaaaatcgagaggctttattagccgtgaccatgcctgaacaaccaggtagtttcttaaaatttgcttatgtattaggtaacagagctgtaaccgaattcagttatcgttatgcagatgataaacgtgcttgcgtgtttgttggggtaagaacgacaaatgagcaagaaaaagcagatattattgcagacctcacgaaaaatggttttgatgttgaggatatgtctgatgatgatattgcgaaaacgcatgttcgctatttaatgggtggtcgagcatcaaatgataacgaacgtttatataccttcgaattcccagagcaaaaaggtgccttattaaaattcttggaaaccttgcaaaatcgttggaatatttcattatttcactatcgtgcccacggtgcggactatggaaatatccttgctgggttccaaattgaagaacgcgaacaagcagaatttgaacaggcacttgcccaactcaattatgtttttgaagatgtaacagaaagcaaatcttatcgttatttcttacgttaatcttataaaaaggcgtgatatttttcacgcctttgtcttattcaaactctaattccaccgcactttcgccgagtaaattcaccaattccgtcagaatttcatctgttggaatgatcgaccattgcacgcctaaacgtaacaacgcacgacctttcggactttgataatacacgttaataggcaatgttccaccactcactggctcaagtaatgctttaaattgtttaatgaaacttggtgtaatttgatgctcagaaagactaatagccaaggatttgacataacgagaacgtgcctcatctaaggtcattaactcgcgcaccgtcattttcaagccaccagagaaatcatcaaagctcacctgccctgaagcaacaatcactgtatctttttgtaatttctcaccaaattgttctaggctttcaccaaataatgttaaatctaagcgacctgaacgatcgtccaatgttgcaatacctagacgattgccttttttcgtcatcgcaattctcgatgccacgactagccccgccacagtgctaatttgtccacggcgatttggtgcgagatctttcaaccgcgttgatgtgtaatgagaaagttctttcaaataacggctaacaggatggctacttaaataaagccccaaggtttctcgttcgccatcaaggatttgtttttcagtgtaaggtggtgtattagcataggcattttccacgtcttcatgggtttcagtcagcacaccgaacatatccgtttgtcccattgcttcatctttcgcatgctgatcggaagctctaagtgcatcttccaaattcttagaaagtgcggcgcgatgtgggcctaatttatcaaaggcacccgacataattaggctttcaaaagtacggcggttaatttttttcaaatctacacgagcgcataaatcgaataaatctttgaaaatccccccttcatttcttgccgccacaagtgcttcaatcgggccttcccccacgcctttaatcgcgccaatcccatacacaatttcgccttgttcattgacactaaaatggtgttttccgatattaatatctggtggcgtcacttttaagcccatacgcaaacattcgtcgtacaaacctacgattttatccgtattatccatttcagatgtcatcactgcagccataaattctgcagggaaatgagttttaagccaaagagtttggtaagacaccaaggcataagcagcggagtgagatttattaaaaccatagccagcaaatttttccaccaagtcgaaaatcttcatagatagctcgccatcaacaccgtttttctcagccccctctttaaacactaaacgctgttttgccatttcttctggtttctttttacccattgctcgacgcaataagtcagccccacccagcgtatagccagccaacacctgcgcaatttgcatcacttgttcttgatacaaaataatgccgtaagtcggctcaagaataggtttcaaacttgcatgttgatattctgcgtcagggtaagatacttcttctctcccgtgtttacggtcgataaagttatctaccatacccgattgtaacggacccggacggaacaatgctaccaatgcgataatatcttcaaaacagtcaggttgcaggcgtttgatcaaatctttcatacctcgtgattccaactggaacacagcggtggtttcggaacgtttaagtaattcaaaagattcaggatcatcaagtggaatggcggcaatatctactcgaggcttgccttcacgcaccatacgaacattaattatatccaatgcccatttaatgatagtgagagtacgcaagcctaggaagtcaaatttcacaagccctgcatattccacatcatttttatcaaagtgagtaaccggatgtaagccttcattatcacaatagagtggtgcgaaatcagtaattaaggttggcgaaatgaccacgccacctgcatgtttacctgcattacgtgtcacaccttccagcttgcgcgccatgttaatcaatgctcgcacttcttcatcgctatcgtaggcagtctgtaattgcggctcggtctcaaacgctttggcaagcgtcatacctggatctggcggaatcaatttagaaatacgatcaacgaaaccataaggatgccccagcactcgccctacatctcgaataaccgctttcgccgccattgtgccaaaggtaataatttgtgataccgcgccacgaccataggtttctgcaacgtgctcaatcacgcgatcgcgaccatccatacagaaatccacgtcgaaatcgggcatagacacacgttctggatttaagaaacgttcaaatagcaaatcaaactctaacggatctaaatcagtgatttttaatgcataagccactaatgaacccgcaccagaaccacgacctggccctactggaatatcgttatccttagaccattgaataaattccattacgatcaagaaataacctgggaaccccatttggttaattacatctagctcaacttgcaagcgttcatcatattttggtcgtttttctaaccgcacttttcatcagggaataaaaaaactaaacgttcttccaagccctctttggatttttgcactaagaaatcttctgtacttaaatcgccagttggaaattgaggtaagaaatattgaccaaggcgcaaagtcacactacaacgttgcgcaattaataaggtattttcgagagcggaaggaatgtctgcaaacagcttacacatatcttcttcactacgaaaatattgctgtgaggtataacatttcggacgtttaggatcgtctaaagtatagccatcgtgaatcgctacgcgaatttcgtgggcttcaaaatcctctgcattcaaaaacatcacatcattagttgcgaccaatggtaaatcacaacgttctgctaatttcaacgctgcttgaatgtaacgttcttcatttgggcgacctgtacgacttaatgctaaataaaaatgatcggcaaaaaattcttggtaaaaagcgaccgcactttcaatttcggctacgttttctttcaacaattttttacccacatcgccttgcgttccccctgataaaataatcacgccgtcgcgatgttcaattaaccaatcttgatcaatataaggtaaatcgttataaccgcgttgataagcctttgataacaataaagttcgattctatagccttcattatttttagccagcaaagtaagatcaaagtattcatcgccacataatgggctttttacttttacatctgccccgataatgggcttcatacccgaagaaagcatttcgctataaaaactaaccacaccacaaaaattagtaaaatccgttaatcccatagcaaccatttcattggcagcacaagctttcacaagaggttttactttgacgatactgtcaatcatcgaaaaatctgtgtgtgtgcgaagatggacgaagcgaggttggaatgacattgaaaatccttaaaatgcggttaaattttgccgtaaatattaaagcggtattatagcgaatttttcaaacaaatgcttatgctacaaatagtgttcccaaattggctcggataaccgattgcgtgaataaaaaatgttaattagatcaaaaaattgataattagccgttttcattttgttagattttcgctagtctaacggcgattttttatttatttcaacgaataaggataacgctatgacaacactttttgaggttgcacaacattggttaaaccaagatcctgacacagaaactcgtgcagaattaaccgcacttttagatgcagcaaaaggcggagataaagcggcagaagcagaattacatgcgcgttttgatggtcgcttacaatttggtacggcaggtttacgtggtcgtttacaagctggctcaatagggatgaaccgagttttagtttctcaagctgctggtggtttagcggaatatttaaaaggttacgataaagaaccctcaatcgtcattggttacgatggccgtaaaaactctgacgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttggctgtttcttagggtggtatttggcaaaacaatatcaaggcaaacaaggtacattggcttgctcacttgtttcttccccagctcttgctgaaattgcgaaaaaatacggtttccaatcagaagaaaccttaactggtttcaaatacattggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaatcggaaaattaatgaccgcacttcgtaacaatccaccagcagaaatcgctggcgtgaaagtggcacaatttatcgaccatattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagattgcgtattggcagaatttgatgaaggtgttcgtcacattcttcgccaagatacttatggcaaataagactgctaattgcacaatgggatgtggatacgtcaaacggtgcattgacttgttgtttgcaaagggtgtggtatttggtcataaaaaatctgcaccttagttggttatttagtccagcttttggggtgcagatcatttctagcttgccttttgttttaccatttaattaatgtttagtttgttcttcctcagatttttcttctgcattttctgcttgttggcgattcatatattcaacaaacaatgcatcaaagtttactggagataagtttaatgcagggaacgtaccgcgattgactaggttagacactaattcacgtgcataagggaaaagcatattcgggcattgagaggttaaacaatgcgccatttgaacatcttctaaaccgctaatagtgaatacgcccgcttgttttacttcacaaataaatgcgacatcaccactatcttcaagtgtagtttcaacagaaatgtttaataccacttcatataagtcatcgccaacttgggttgtttcggtgcttaaatcaaaaccaagttttggtttccattcttgttggaaaatatgtggaagatttggagcttcaaaagacacatctttcacataaatacgttgaatttggagaacgggttgttgttcttctgttgctgcaacgtcttgtttttgttctgacattttctattccttattatttatgttttttaactaaaggtaaatttgctgctacccacgcggaaaggccttctttcaacacaaatacagaattaaaaccttgtttggttaaaaatactgcagaagcagaggctgaagtaccatttgtatcgactaatataagagctttctctttatgcgactctaattttccgatattttgatttttaatttcgcttggaagcacattaatactattaatgatatgtccacgttgaaattcttcaagactacgtaaatctaccacaatggcttcatcggaatttattaaccgaataacttcattgtgcgtaattactttaaatttactcgttgcgcctttgtagaaggtataaatcaccatcacgaaaatcgcaaaccaagaaactgctaaaagcgtatgtttttgagcaaactctgttgccattgagataaattcttgcattgttttctctactgattaagtacgtcaaaatagggctcaagtataaccgcacttgggttatctttcaaaaaaatattcaaaatatagaatacattaaattatctttatttcagctgatggaaaataacagaatttttcaacattatttattgatccaagttatggaatctctacctatttgttgctatattacacgccgtttcaacaaataaaataaagtgtttttctattaacttagggggtcagtatgtctgcaatgttcctcctgcaatttggccatcgtattactgtgtatcttagtgggtgcaagtgtagcgtggtatcggtttaggagtatttggtggtttaggtctcaacgttcgtttatttggtaaaggctttaatccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcagtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccactttagtcaaagaagtagaagtgagcaaaacagctaaaatttctgtttctttattcttatttggagctttacttgtcgtgttaatgggtgcagctccttctattcgacctgtttttgatggaaaaccaatgggaatggcacataccattgaaattattatgctttctattggtgcattgattatcttaacttgtaaaccagatggcacagcgattaccaaaggttctgtattccatgcaggtatgcgtgcagtaatcgcaatcttcggtattgcttggttaggtgacactttaatgcaggcacacattactgaagtaaaagaaatggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctttaaaatgtgattcgataacaaagaacggtgctgaaatagcaccgtttttgttattctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaaggggtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttcccgcgttcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaatcgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagctaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcagggaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagtaaacgacctgtacgagaacgaccgccctcaataaaatattcgacggaatagcctcgatggaatagttctgataaatattcgcgaaaaatggcagaatatagtcgatttcccttaaaagtgcggcgaataaagaatgccccccaactacgaaacattctacctataggccagaaatttaagttaatccctgccgcgatatgtggcggaacaagaccttgatgataaagcacataagaaagcaataagtaatcaatatgactacggtggcaaggcacataaacaatttcatgaccttctaacgctaatttacggacacgattcgaattttgtacatcaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccaggagaacgtccccaaagaacagaaacaggaataagttgcacatctaaactttcagaagtgcggtgtaattcaagatatttattgaaaatggtagtggtttcgtcttttgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtggctgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgcaataacgcttggatgtaatctggtaccaagaatgaataaagtgcggtaaaaatttacggtatttttaccgcactttgcttatactagagtgctttatttgccatgatttttgctgctctttataatgcaaaaatcttgaatttatacaaaggatggaaaaatgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcctgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgataatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccacgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggaattatgcaaggcttattaaacaacaatgtccaagtagatttaccgggcggttcgctcatgatcgaatggaatggtgttggtcatccactttatatgacaggcgaggcgacccatatttatgatgggtttataactctttaatattttttccccatttatcttaaaaaaagatggggcgtttttcttaaattagcgtaaacattttgtatctaaatatatttttattgagctgtttgataactttaagtaatcagaacaagcatttttcatacaatctctagattttttacttaaagaaatagattattagcataataaaaaaccgcctctcggcggttcttgttttaaatcttttatctactacgctaacactgccaatgcagcttcatagtttggctcttctttaatttcttcactaactggctgtgtaaaacattgttttgttcatctaacacaataaccgcacgagaagttaaacctgccaacgggccagtttgaatatctacgcctaattgtgagtgtaatgcgtggttacggaaagtcgaaactgttttggcattttcaatcccttcagctccacaaaaacgagcttgagcaaagggcaagtctgctgaaatacaaagcacaacagtattacttaattttaccgcttgttggttaaatttacgtactgaagtcgcacacacacctgtgtcgatgcttggaaaaatatttaggactttgcgtttacctgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattatttccaccaattaaagctatccagaatttgattttcgggaaaatttcagccaccacacaataaccaatagcaaagactaatgaaaacagtatgtgcgttaccccaatccagttaaatccgtgaaatcaatagggctgctcggtggaaaaggatgctccgctccccatttaacgaaagcagagataaaacctgcaaaaaattgcaacgccataacgacgtttagatggttctgaaaataagctcattgttgtatccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaattgattgattttttagcggttgtagagcgagtataagctttgtattacttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaaacgcctgattttgtgctttctgcttataaagataatgctgcagtaatggaaggttcgaaagtcggccgttggtttcctgatcctgatggacaatatcgtgttcatcaagaagatgcgcacattttaatgaaagtggaaacgcataaccatcccacagcaatttcgccatttcctggtgctgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgtgcgttacttttaaaacggaatttacgtatttgtaaaatgaataggtaggggtataattatctaccataactaaacaaatcacatcgtttacgatttgtctttttataaataaatattttatgaaggcggaattatgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgacttaaatagtacatcacaaagcaaacaaattattcttcaagaaataaataaggtaaaagaaaacaatattagaaaaaataataagattgtttactaaacataaaagaattactgctacacaaaataagcagaaatttatcgttccatttaaataactatggagagattatgtttattacacctatcttcattattaatctagaaaaatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccattgataaattgatatagtagacaaagcagttgttaatgtttatttttaaatattagcaactgttttattttggaattccacgcaataatcctacaggctcaaaaggttctatagaagttggcgcgggcacttcgctgaataataaaataaatggcttgtgcggaataactttttcatttcgccataaatttcccattccgactaattgaatatcttcgggtaaattacgaagtcctgcttgtaaaactgcaatcgtattttggcgaggatgacctattgcaatggcggagccgtgttttctagcatagtgaattgctgctttaaattgacgttgaacgtctgcgaattcgttactatcatctaaaaatatatggcgatctaatgaacgcacgccttgttcttttgctattttcccagctacagattttcctattgttcgactatctaaaaagaataaatgtttttcttgaagtgcggtcattaaataagtcattaattggggatctgccgtagctgcactccccatatgattgttcataccgatggcatcacgcacaatatttttagccgtattaacgcgatcatttacttgtgctgcagacattcctaaatgcagcccaccgtcttctattttcactgcacttactggttgcatcggcatatggattaaaatatctctaccttgagattttgcttcttgattacgtgctcgagcatagggcgcagcaggaataattgctacggaaatttcacgtggcatcgcaaaaattgctgcatcttctttggaatgatagcctacatcatcaatcacaatagcaagtttactttgagcaaaagaaaaagaggtataaagtgcggtagaaaaaacaatgaaattttttaccgcactttttatcagaatattcatcaacgaacccaccctgcaggatttactggcgttcctttacggctaataccaaaataaagcgcagaacgtgatatttcccctgtatttcctacttgagcaataacctgccctgctgaaacaagctgaccaactttcactgatacggcttgattgaagccatataaacttaaatcagtttcgccgtgtttaacaataaccatataaccataaccatttaaatatcccgctaaaatgacgcgtccagcagcaattgctttaacaggcgtgcctgctgatgcgccaattaccatacctttccaacgtacttcgcctgcttggatagaaccaaaagtatgcaaaattgaaccagaaactggtaaggaatattgtttttttgccgcccctaaaccgcttgtactattaagtaattggcgttcttgtacagttggttgataaggttttgatgttcgtttttcttcagctttttggcgttgagcaagtgcctctctttcacgtttttcttgttcgcgcgctgcttgttcagctcgttgaatttcttgacgaagtgcttgttcgtttgcttttagtgcattcaatttatcttgatctagggctaaatttttattgagttcattcagcgtagattgatgctcttgctgtgctttttgcaatgcttgttgttgttttttttgtgtggaaagttgatttcggtgattcttttgttgagagaaaatcgcctttttttgtactgcaatttgtgcttgcgttgcttttaaattattaatcatttcaatccgaacttgatttaaatgctgataataaactttcattcgctctgcttttgtcggatcttgggcaaacattcgttcaatcagcgatggattaatgcctgaacgataaattatatctatttgtttggttaatcgtgctttttgctcacgttcctgtttttctaattgtttgagttgcttatctgcatcggcaatttgcttacgaatttcctttaaacttatttctgtttcaagcagttcgccctcaacactgttaattttactctcgtgtttttttaaatttgcttgtaacttagcttgctcacgtttttgcttctctattttagattcttgttgcttaatttgtttttgaatttgattgagatcggaagattggctgacaggcgaaaatattaataaaccgcagcttaaaagtgcggttaataataatgatgttttttgattaacgccaaaacgcaacataattcatcctaaattcgtaaaactcgcaaatcttatcatatttgttaaaaggcgaaaaagtttgatggttattttttgctaaagatcaggaaatcatcccttttaacttttaaagctaaggattttttgctataaaatgcgcgttctttttatttgaaaacattaggagattcttatggaattagtatttatccgtcacggttttagtgaatggaatgcgaaaaacttattcacaggctggcgtgatgtgaatttaactgaacgtggtgtggaagaagcaaaagctgcgggtaaaaaactgttagacaaaggttatgaatttgatatcgcatttacctctgttttaactcgagcaatcaaaacttgtaatatcgtgttagaagaatcccatcaattatggattccgcaagtaaaaaactggcgtttaaatgaacgtcattatggtgctttacaaggtttagataaaaaagcgactgcggagcaatacggtgacgaacaagttcatatttggcgtcgttcttatgacatttctccaccagatttagatccacaagatccaaattctgcacacaatgaccgtcgctacgcaaatattccatctgatgttgtgccaaacgcagaaaatttaaaattaacattagaacgcgcattaccattctgggaagatcaaattgcaccagcaatgctttctggcaaacgtgttttagtagttgctcacggtaattcacttcgtgcgttggcaaaacatattatcggtatttctgatgctgaaattatggattttgaaattccaacaggtcagcctttagttttaaaacttgatgataaattaaattacgtagaacattactatctttaattaagttcaacgtattgttgttctaactgtataaaacaaaaccccgcaaattagcggggtttttaaacaagtccaaattattttgtgcttggaattttgaaacggctgttgaaacgctcgacacgaccaccagtatcaacaacacgttgtttaccagtgtagaatgggtggcagttaccgcacacatcaagattgatgtctttgcctaaagttgaacgtgttttgatcacattaccgcaagaacaagtcgcagtaacttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattggtgcaatggtttgcacgcgaactaagcccaaatgcgatctttgtccgttaaatattgattgtttggcttataaaaatacaaactgggaaaaatttccagctaaaaaacctaaaaaagcgatgccagaaaaaactacctattttttaattttgtcgaaaaatggcaaagtatgtttggaacagcgagaaaactcaggattatggggcggattattttgttttccacaatttgaagataaatcctcgttgcttcattttttagcccaagaaaaagtcacgcattatcaagaatggccgagttttcgacatacatttagccattttcatttagatattcatccaatttatgctgaaatggagagcgctttatgcgtagagcaggctaatttagactggcgaaaagtgatggaaagcacaaaagaataccaatcaaacctatcaagtgcggtcaaatattggtatgatccacaaaatcctgaaccgatcgggctggctcagcctgtgaaaaatcttttaatacaatttgtaaggaatcattatggcaagaacagtattttgtgaatatctcaaaaaagaagcggaaggcttagattttcaactttatcctggagagttggggaagcgtatttttgattcagtaagtaaacaggcttggggtgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaattagttatctatcctacaatgaaaaaatatttattattggcattattgccttttttgtatgcttgtagtaattcatcgaatcaaggtattaactatgatgaagcctttgctaaagacacgcaagggttagatattctcacagggcagttctcgcataatattgaccgaatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttacttctggcgatgtgccgattagctctcgtccatttcttttggggcaggttgtagatcatcaagggcaacaaattgctaatcaagttatcgcaagtaatttcgccacttatttgattcaaaataaattgcaaacacgtcgattacaaaacgggcataccgtgcaatttgtttctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggattaatgcaagttgtgcctcatacagcaggtcgagatgtatttgcaatgaaaggcaaaggtgggcagccatcaacgcgttatttatatgatcctgcgaataatattgatgctggtgtgtcttatttatggattttacaaaatcaatatttagatggaattacgaatccaacctcaaaacgtttcgccatgatttctgcatataatagtggtgcaggcgcagtgttacgtgtttttgataatgataaggatacggcgatttacaaaatcaatcaaatgtatccagaacaagtttatcgcattctaacgacagttcacccatcatcacaagcacgcaattatttgttgaaagttgataaggcacagaaaaaattccgtgttagacgataattgaattttttcagataatcaaaaatgctcgctggctaacaccattgagcattttttattaaaaaagtgcggtaaattttaaaatagtttttattatttcgttgttttaataaacatattgatgattaactattcaaacgaaatgttttttccattttttttgaatttagttattgaccgaaaaccgaaaaaatagtttaatacgccccgttgtcaggcagtagccaataacgataacgcctcgatagctcagtcggtagagcaggggattgaaaatccccgtgtcggtggttcgattccgcctcgaggcaccatttcctccttagttcagtcggtagaacggtggactgttaatccatatgtcgcaggttcgagtcccgcaggaggagccaaatttagaaaggccgctaaagagatttagcggctttttgctttcttatatataaaatatataatcttctctagtcttgtaactataactaggcatcaaaattcaaaatggtgtatcaatgagcgagagccttcttatttttgatgttagcaagcgacctaagtcgcttgcgtttaacttaaagaagaaaaatgaatcggcttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccacggaatacaccgcctaatcccgcaatgcgagttccttgaatatcaactatgcgattgtgtaaattgcgtgattgccacttagaaccccaaattgcattaaaagcactaatggttttgctatcatgatttccatgaataaaccaaatatcacaatgttgcgcaagtttatccaactcatctgctgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggagattcaatctctatataaggaactttatatttatctaacagttttttgagtagttgttgaaattgttggcgttgtttttgtgagcctaagctgcgcaagccatcatccacccattcagtattatttttaagtaaaatagtgacatcgaagggatattctttaatcattgagtctaaaaatggatgagcttttccttcatattgaatgcagaacgcttgcgtggtaatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggttgcggacacattaaagaaagtgcggtcaggatcgactaacgatacttctaaacctaagtatttctcgtaaggcgctttatcttgaggctcgctactaaatacgattgaaggttcaaaatgtttttcatgaaatagggttttaactgcttcactccaagattgccagccgtttggataacttggaataccgtcttcaatcaaatgatgaataaaaatctgatttttttgatatttgaaaatttgctgcatccaacgcaaacgatcttgcacggttggcatgcgtttcattttactatcgtaaaataatttcaaatcgcgcaccgtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatgaaaatatttttcacgttctgatttagtgcctaggtattttgcgttatacttagctcgcattctcagggcagggtgaaattccctaccggtggtaaagcccacgagcgtttaaaagtgcggtcaatttttggcaaatttttcctgcgaaattgtcctgattttcacttttaaagtcagcagatttggtgaaattccaaagccgacagtaaagtctggatgaaagagaataaaacgagttgggttcccaaatcgttcattttatttgcatttctcagccctgattctggtatttaattgaaatctcaaattaggaaattactatgaatcagtcaattttatctccattcggcaacaccgctgaagaacgcgtacttaatgcaattaatgctttcaaacatggaactggcgtattagttttagatgatgaagatcgtgaaaatgaaggcgatttaattttcccagcagaaacaatcacgtcagaacaaatggcaaaattaattcgttatggcagtggtatagtttgtttatgcattactgatgaacgttgccaacaactcgatttaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatttaaaacgaagaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaataataaaagtgcggttaaaaatcttattaaattttaaccgcacttttttgtttattctacttctggtaaatttaccgcacctttatagcctaattgtcgccacgcttcataaaccgttactgcgacagaattggacaagttcatactgcggctattggctgtcattggaatgcggattttttgttccatcggcatttcatttaaaattgacatcggaatgccacgagtttctgggccaaacattaaataatccccaagttcaaatttcacttggctatgggctggactgccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctaggggttcaattaagtgcaagcgaaatcctgtattggcacaaaggcgaataatgttccccgtattttgtgggatttctggttcatataaaacaatatctaacataatttttctctaattctgatataaacgatagctcaccattcccgtcgttttttctttcaataacgtccagttttcaggagtaataagcggtttatctttctctgtttctacgtaaattaacgcattgggttttagccagttattttcacaaagcaaactaattgcttgttctgccaaattaaaatgaaagggtggatctaaaaacaccacatcaaagtgcggttgattttgtggctgttttagaaaatccaaactactttgattaattacttcagcctgttctgatgagcatttgagtgtttgtaaattcttttttaattgattggcaacggttttatccaattctaaaaaagtcacctttttcgcttggcgagaaagtgcttcaaaacctaacgacccactccccgcaaagccatctaaacattcagattgatagatataaggcattaaccaattaaaaagcgtttctttcactctatcgccagttgggcgtaagccttcagaatttaatacaggaagttttcgccctcgccatagtccagcaataatgcgaacttcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacggagttagccggtgcttcttctgtatttaacgtcaatttgatgtgctattaacacatcaacctccctcaatggggatnccntagaagtngaacctgcagggcatgcaagtcataggc

SEQ ID NO: 683 - DNA, 191996 bp, H. influenzae
ccaaatagagtgttattatgaaaaaaacagccgtgttaagtaccgtcgctttcgctattgcattaggttcagcatctgcaagttttgctgcagataatcgtattggggtaacgatttataaatatgatgataactttatgtctttaatgcgcaaagaaattgataaagaagctaaagtagtcggtggcattaaactcttaatgaatgactctcaaaatgcacaatctattcaaaatgaccaagttgatatcttactctctaaaggcgtgaaagcacttgcgattaacttggtggacccagcggcagctccaactattattggcaaggcaaaatcagataatattcctgtcgtattctttaacaaagaccctggtgcaaaagctatcggttcttatgaacaggcttactatgtaggtactgatccaaaagaatcaggcttaattcaaggggatttaattgcaaaacaatggaaagcgaatccagctcttgacttaaataaagatggcaaaatccaatttgtattattaaaaggcgaacctggtcatccagatgcggaagtgcgtacaaaatatgttgtagaagaacttaatgcgaaaggtatccaaactgaacaattatttattgatactggtatgtgggatgctgcaatggcgaaagataaagtagatgcttggttatctagctctaaagcgaacgacattgaagtcattatttctaacaacgatggtatggcattaggtgcgttagaagcaacaaaagcgcacggtaaaaaattacctatctttggtgtggatgcgttaccagaagcattacaattgattagtaaaggcgaacttgcgggtacagtattaaacgatagtgtaaaccaaggtaaagcagttgttcaattatctaacaatttagcacaaggtaaatctgcaactgaaggcacaaaatgggaattaaaagaccgtgttgtacgcattccttatgttggtgtggataaagacaacttaggtgactttttaaaataattttccatcaatttttgttgtagtctaaggggaagtggatcttcccctttttaaagaggttggatatgacagctcaaactcaatgtcaagacagccaagtgctgctcacaatgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataaacataaggaatgaattatgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttgtctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctattgggggtaacccagaagcagctaaagtttcaggcgtgaatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaactatccacgttaaacgaacaacaaacatcagcaacttcagataatgctaaagaaaataacagggttcaaaaagaacaaaatcaagtagaaaatcctaaacaacttgctgaaattgtaagaaaaagtgatcctaacactttagataaaaccgtattaattgatgctttcccacgttatcttaaaacgctacctgaacaaatgaataacctaagttttgaatcctatcaaaaatgggcaaatacttggcagctctcagaagatgaaatcaaacagtggaaaatcgcctttttaaatcgcttttttgataatgaaaacactgattttcaaaaatggcgtgatgaacaaatccgacaattacagactgataatttaaccgaacgccgtttacgaatggctatttggcaaaaaactgaattaacctcttggctaaatttgctttctgccgaatcaaaaagtaagcaagaatggcgttattgggaagctaaacaagatatattaaaaaataccaaaaaactgaccgcactttcaaaagagcgtggcttttatccaatgttagcggctacacaattaaaacaagcatatcaactgaatgtccctattgcgtcaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgtagcaaaagcgtggggttacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgcgaggggcttaatgcaacttttgccaagtacggcaaaattgacagcagagaataatcaactaccttatcaaggcgaacaagatttattcaaaccattgaataatattttgctaggtaccgcacatctgaatgaactcaatggaaaatatcctaataatcgaatattgattgcagccgcttataatgcaggagcaaatcgagtagaaaaatggttaagtcgcgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatactaaatgcactagtttaatagtgtgaaatgggagcataattatgtatatcagccgtaatttagagcaatggaatgcatttcttcaaatgctaaaaatcgcctttgaagaaaacaaagcacaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaactaagcgaatttttaccgcactttctcacttatttagtcctaaatggtggaaaaaaaactggcagcgagttgtcttttgtttttttttcgccgtttttgctttgttgctgatttttcgctttgtacctattccattttccgcttatatggtacaacaaaaaatcgctaatcttttacaaggcgattttcgatatcaaatccaatataactgggtcagcctagaaaatatctctccaaacattcaattagctgtgatttcatcagaagatcagcgtttttttgaacatttaggctttgattttgaggctatccaacgagcaattcggtataacgaaaaatctaacaaaggaatccgaggggcatcaactatttcccagcaaactgctaaaaacttaatgctttggcacggacaaaattggctacgaaaaggtttagaagttccagcgactatgttgcttgagctgacttggtcgaaaaaacgtattttagaagtgtatttaaatattgcggaatttggaaacggcatttttggtgtggaagcggcaagtcgctattactttaaaaaatcagctaaaaatttatctcaaaatgaagccgcacttttagctgctgtgttgcccaatccaatcatttataaagtaaataagccaagcttattagttcgtaaaaaacaaacttggattttgagacaaatgggaaatttaggcactgaatacttgagcgatttataaaaaatgcaatcgaatttctaaagtaaaacaaactaaaaaatatttacttaatatataaaataaaaaacgagtctaagactcgtttttttatttataacatttttattacaggtttattaccgcaaataatacccaaacggtataaattgtggctaaaccgtaaaagataaatccaccagctggcacatgtactttaagatcgtgcataccgtgatgaatacggtgtaaaccacaccacattgggaaaatagtaagcactaaaataactaatttaccaatccaagaataagcaaaagtaattaaattatgcgcatcgactaaaccaaatggtaataacaaaccgatgattagaataacgacaggaagaaaaattgcactcactgtgccacctgcaccgaacattaaccatactggcggttcgccggagcgttttggattttgatcaaccattttttctctcccttaaatataaactaaaactaacgcaatcacgctaactaatgtggttaccgcccaaagtgcatttcttacaacagtgtgtggtaagcgttcatttttcacaatgatattcatcacttttggtgtcattaagaaatatgtcaccgtatgataaagcgttgcgataagcgtaataatatttaagaacaccacaatagggtttcttaaaaactcaataaagctcaatatgcctaagcctggcattggattgcttgcaagacaaagaacaccataaagcaatacaatacaaaaccatacagcaaagactgaagtcgcttcacgtagcatataagctttgtagaagtccaatttttgccaccaagtcgctgtcattggacgaacatattttttacgtttactcactgttactgacattccttcccccttagccttttggttttagcatagagataacataatctttggcactttccactttgccttggttaattgcagaagcaggatccacatgttttggacaaacttctgagcaatagccaacgaaagtacaactccaaaccccgtttttaccatttaataatgacatacgttttgctttaccatggtcacggttatcaagattataacggtgagccatcgtaatagctgcagggcctaagaattcaggatttaaaccaaattgagggcaagcggcatagcataaaccacagttgatacacattgagaattgacgatatttctcaagctgtgctggcgtttgtttagtacggctaacttgcaattctttcgatggatgtggtttaccatctaatgctggtgcttcgttaccaataatataaggcttaattgcctctaaactttcgataaagtggcttaaatcaaccactaagtcacgttcaattgggaagtttgctaacggctcaatacgcatatggccgctgtaatcacgtaagaacgttttacaagccaattttggtttgttatttaccatcatcccgcaagaaccgcagatcgccatacggcaagaccaacgataagaaagagatggttcaagtttatccttaatatagcctaacgcatcaagcaatgaagtttgattatcataaggtacttgataggtgcttaaatgtggctcttgatcgatttcaggattgtagcgtaatacttcaacattcattactggtgaattagccatttgcttgctccttagctttcgcagctgcttcttgagcttctgcttccgcaccgtaaacacgttttgcaggttgagatttagtaattttcaccggactgtattcaatgcgcggcgcaccattctcattgtagaaagcaagtgtgtgttttaaataattgacatcgtcacgttctgtgtaatctaagcgttggtgagcaccacgagattctttacgttcaatcgctgaatttgcaatagattgtgcaacatctagaatgtaacccaactcaacggtgtaaagtacatctgtattgaacacgcttgaattatctgatacgcgaatacgtttgtaacgttcttttaactctgcaattttatctactgctttttgcatacttgcttggtcacggtaaataccacagccttcttccatcacggtacccatttcatcacggatttcagaccaagattcattaccttcttgtttgtgaagagcttctaggcgagcaacaacatcttttgcttgagcatcaaccgcactttgatttaccgattgagcttcaactgcacgttgtgccgcatattcccctgcaacgcgacctaacacaacaagttcagctaaagagttagatcctaaacgatttgcaccatgtaaacctgaagatgcgcattctcctacagcaaataaacctttgatacgtgtttcgctattgaaatcgacttcaataccgcccatggtgtagtgaacaactggacgaactggaattggttcatttactggatttacaccttcataagcacttgctaattcacaaatgaatggcagacgctcatgtaaatatttttcaccaagatgacgtaaatctaaatgcaccacatctacgcctttcgcagtttttaaggtattaccttttttccattcttgccagaatgcttgagaaaccttatcacgagggccaagttccatatatttattttgcggtttgccaattggcgtttcaggacctagaccgtaatcttgaagatagcgatagccatctttattcactaagataccgccttcgccacgacaaccttcggtcattaaaatacccgtattaggtaagcctgttggatgatattgaacaaactccatatcacgaagtggtacaccgtgacgatatgccatagataagccgtcacctgttacaatgccgccattggtattaaatttaaatgcacgacaaccaccaccagttgcaataacaaccgcattggcattaatttgcacaagcgaaccttccatcatgttcattgcaaccataccacgagcatggtcatcatcaacaagaatatctaatacgaagtgttcatcaaaacgttggatttgtggatattgaatagaagtttggaaaagcgtgtgtaataagtggaaacctgttttatctgcagcgaaccaagtgcgctcaattttcattccaccgaaacggcgtacgtttacatcgccatcagctttacggctccaaggacatccccaacgttctaattgagtcatttctacaggggaatgttgcacgaaatattccactacatcttgctcacaaagccagtccccaccagcaacggtatcttggaagtgtttatcgtaagaatcttcttctttgataactgccgctgcaccaccttctgctgctacagtatggctacgcatcgggtatactttagaaactaatgcaatttttaagttaggatttgcttctgctgcggcaatcgctgcacgtaaaccaccgccaccagcaccaacaatcgcaatatcgacattaactgtttgcacgatatcctccaatcaatagaaagtaaaaataaatcccctaaaagggtaatattgtgtgggcattgtgccattttttgttacaaattaataacgttttttatgtctaaagatggaaaagatcgtattttgtgatctacctcaaaaaagctaagattgagttgagagtagctctcgtttacaatgtgcaaaatttttaaaacaggattaaaaatgaccgcacttaatcattggcaaccttctgccgatataaaaaatcttcttaaacgggcaaaaattattgctgaaattcgtcaattttttacagaacgcggtttgcttgaagtagagacccctgttctaagtgaatttggcgtcactgatttacatctctccacctttagcacggaatttcttgcgcctttcggtgaacaatccaaaacactttggctttctacaagccctgaatatcatatgaaacgcttgcttgcagcagggagtgggccgatattccaaatcagtaaagtgtttcgcaatgaagaagctggaaatcgccataatccagaatttactatgttggaatggtatcgaccgcactttcatatgcatcgtttaattaatgaagtagatgatttgctccaacaaattttagattgtccacctgcagaaagtttaagctaccaatttgttttccaagaatatgtaggcttagatcccttgtcagcagaacgttcagaattaattgaagcagcacgtaaacataattttatggctgaagataatgaagatcgcgatacgttattacagtctttatttattgaagcccttgagccttcaattggaaaagaacgacctattgcacggtatcattccctttcaacacaagcagctctagcacaagtaagcccagaagatcagcgggtagcagaacgctttgagttctattataaaggtttagaattagccaatggttttcacgaacttgccgatgcgcaagaacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgcttaaaggtaaaagtgcggtaaaaattgttatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtgactaaagcgtatccttttccgcgtaaagttttaaaccaagagggcttgttttttcgttctggtaatttgcgtcttaaattagagatgtgcatatcaagagaacggtcaaatggagtgagtggtttttccatcacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgcggtattatttgaaggagatacactacgacgcaaaatcgccttaattcttgcaataagctcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgcggtgaaaataaaaagattatttccagaatttccaccagcttgattttggtttctcacctgtttcaataatggtgttattttcgccttgttgtgaaacctgtggtaaaggtttatcaagatgggtttctgtcacaatcccacgttgatcaaattttactgtgaaagtatgttgaactggcgtttcataggcacgttgttgtaagaatacgtagtaccaagtgtagttattataagggtcgattaatattggtgttcccaacaaatattgtacttgttgagaagtcatgccttctttaacttgcgcaacggtagtcgcctctaaatagttgccttgcggtacatcaattcgatatacaactttttcaacggtggaacaagaagcgaggcttaatgctaaaaaggttgcgcctaaaagtgttttaacttgcattttctttaccttaatttgtgcaaaagttctgtcaaataatatccaaaattgggtgtatttccaaattaattctctgattgtaaagccttttgtaattgatcttttaaatttggtggtaagcctttgatggttagggtatctgtcataggatcccattgaatacgtgtattcaataattccgcatcaaaacttagggtaacgccctttcctgacccagagaattttgttagcgatttcaatgttgaacgtattggtggaatactctcttccaaaccataattctgttcttccgtaaagacgacaaaaggctgttcgtttagagtgggtaatgaatcagaaagttcccttaattcaatattgttaccatttgaaagctgacctttacaatattcaaacacttgtttttttaccgcttgagtttgctctttgttgagttcgccttgatcgcagtaatcactcacagcttgcaataaacattgattttgaacttgtggatttaatccttcttcggcacctaaaaaatccataaaaaaatcactaattttgcgaccaacacggccttttataaaggttaaataacgattagagttcgcgtttacttgcaaatccgtcaaatttatccgtgccgcaatatcaaactgagtaatatccaaatattctgtacggcgaatatctaaatgctcatcgactaacatactatgacggctatcaagcaatgcaataaacaaataatctgtcgctaagaaattatattgacataaaatcaaggtgccactttcagcaaagttatatttacctagctcatctgcaagcaattttgttgaatattgactaaaacctaaaaattcaatttcttgctctaataaacgatttaaatgttgtgcaaatatagacttttcctgaaacacgccaaaagccttagctttattttgatagccttgatgcaattgcaacatcatttgttctacttctggtgtaatggacagcaactcgtcgcgtaatacgctttccatttttatactgtcgccatccacatttttgactaactgatgcaaaacaatttgattaacggtaatactcatttttgtcacctttgaaaaatttgccgcaaattataaccgcactttttaagcaagaaaaaagaaattatttaggttctaccaaataatcgggtatcataagccaaattttttttatttttaacattatggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgttaatatgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaaattacgtagtcttgaacgccaaaaatggctaaaaggcactggtatattcttaaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaaccaaataatgaaagtgcggtaaaaaatctcaatgattttattaaagcacaaaaaactgactcaccttggtttgcttatttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagcgtattaaaattctcgaagttaccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcactttttgtcttttctagagctgttagcatgccacttaatggcccttgaaaatcgggcagttcatcggagaaaacaggaaagccaaattttgcatattctgtttgatttcggttagtgttaattgaaatctgatgaatttgtggttgtaagcgattaataacatgttcaattaaagattgtttacctaaaatctgtaatcctttatcttgcccgcccattctgcgtgctttgccacctgccaaaattaccgcacttattgtaattgtcatattttaatctatcattatttcaagtatcatttgcctattttttacgattaaaacggaaatagcaatgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctttggattaaccgcactttctttcatttttgtaaaatcttatagcagaaaattagggcaacaaacagaatttcagcctgttttattgcgcatattatcttaagttttttattcgctttttattatttctgcgatctagatcgcaaactataaagctagttatttaaattacccattgaaaaaagctctttagaggcttggtcaaacttagtgatgatgtggcaaaagttgctattctagcaatgcctgttatactctatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgtagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcactttttatgcaaagcctcgatgcgaccattctaaatacagctttacccgcgatatcttccgatttacataaacccgcctttgaaatgcaaatggcgatcatcgcttattctttagctgttgcattatttattcctcttaccgcttgggctgcggcaaaatttgggacattgactgtttttcgtggtgcagttttcacgtttattttaggttcagttgcttgtgccgcggcctctaatttagagagccttattttagcccgagtgattcaggggataggcggtgcctttatgatgcccgttgcgcgtttagctattattcaagctgtccccaaacaacaattagtgaatgcttggaatttaatggcaactgcaggtttgattgggccaattctagggcctattttaggtggatggttagtcattcacgccagttggcactggatttttttaattaatattccaattggtgtgctaggaattttggcatcgggcagcgtgatgaacaatatcaagggcaaggcagagaaattagattggacaggttttttactctttgcattggggttagttggtattacgcttggtttggatttactcggagaaagtcagcataattcaagtgtaacttatagcatattagttgttggtattctgttactcgtaacttattgtggctatgctaaaaacaatgaaaatgccattttacctttatcccttttccgaactcgtacattcagattaggtattattgctaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttaacgcaagtgattgcttacaacaggcattcagctatacttttttaacttcatcactttttgtaatcgcccttgtttggtcgcttatgaaattacacaaaaatgatggcgatcatttacgaaaaatgccttagattaatttgttataatccatagaatttttttatttgaaaaaagggaaatttgcttatatcttattgatatttcttgttggtggagatagctccatcgtttaaccataaatggtagggcattccctgcctaacattgaggtatgcttatgaaactaaaagcaacattaactctcgccgctgcaactcttgttttggcagcttgtgatcaatctagcttcggcaaataaatctactgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagctgggaaattagcgatgatggtttaagttatacttttcatttaagaaagggtgttaaattccatacaacaaaagaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataattcatattgatttacttattttaagcccttatttataagggctttttatttatcaaggattattctgtaaaaaatatgttaaataactttaacttgagtataatgctctgcattatttctatcggatatgattccgtagaataataaaaattaattgttaatataaggaacaaaaatggatttcaatcgaattatcactcatatgaatgatcatcatcaagatgatatggctgccctttgtaaaaaatttggtggcgaaaaggaaatcacagatgtgacgttagttaatgtagattttgctggtttagattttaaatataatggtggcaaaacattacgtgtggaatttccacaacaagctgacgcaggttcaattaagcaagctatcatcaatctttgtgtagaaaataaaccagtagcaaattacgatcgtattaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggtcgttttgtaagaggttttggccaagcttatttgattgatgctaatggggaaatttctcatattggtgtcaaaggcaatccacatgaaaaagaaagtgataaataatattgtctcttaatgaagataaagggttgagtgtaaatttatactcaccccttttgtttacgataagttcgagtgaaattgaaatttctttatttttttaccgcactttattttcattaaggacaaggcttgcttactataatttcgataacctgtctgtcgatatgctgcatactttttgatgcaatagcgcagagattatcaatagttcgatcaagatcgtgttcgacaataccttcattgccgcagcaataggcaatccaaccatacctgttcctggcactgcaacgcccaatccatttttcatcagattaggcgaaacttttacttcaatgcgttcaggtgttttgcctaaatatttcgccgctgtagcagatgcgagtgcaagagaaatgggttcggtacagcctagggctggcacaacatcgtgtttaacgatgtggagtaatggtttttcaatttcgttaagtctttctaaattcattcttacttatccaattaatgcgcttcatcccaattttgacctacaccgacttctacgatcaacggaacaactaattccgatgcatcttccatttgttgtttaatttgttcacggaaaaactcgactttttctgaccgcacttcaaacactaattcatcgtgtacttgcataatcatttcaatgtcgggatcgtgatagattacttcatcaagtttaatcatcgctcgtttaataatatccgcagctgtgccttgcatcggtgcatttatcgctacgcgttctgcccctttacgacgcattgcgttgctagaattgatatcaggtaaatataaacggcgaccaaataacgtttccacatagccttgtgctttcgctttttcacggatatcggtcataaattgctgtacactcggatagcgttggaaatataaatccatgtatttttttgcatcaggacgagaaatatcaagttggcgtgaaagtccaaacgcggacatcccataaattaagccgaaattaatcgctttagcattgcgacgttgctcgctggtgacttcatctaatgatacaccgaagatttcagcagccgtggagcgatgaatatccttgccttgagagaaggcgttaattaagccttgatcgccagaaagatgtgccataatgcgtagctcaatttgagaatagtcagcagcgacaatagaataaccttcacgtgcgataaatgcttgtcgaatacgacgaccttcttcattccgaatcgggatattttgtaagtttggatcacttgatgataaacgtcctgtcgctgtcaccgcttgatgataagaggtatgcactcgtcccgtttgtgagttgaccatttgaggcagtttatccgtgtaagtggatttaagtttgctcaacccacgatgttcgaccaaaattttgggtaattcgtggctataggctaattcttccaatacttcttcattcgttgatggcgcaccttttggcgttttttgtaaaataggtaggccaagtttatcgaacaaaatttcttgtaattgtttggtggaagccaaattaaatggctgacctgctaattcgtaagcttgttcttcaagtgcggttaatcttgtggcaatttcgttagattgcataaagagggcattactatcaatcaaaacgcctgtacgttccatgcgagaaagcacatgaagtaatggtaattccattgttttatacaattcaacaagcgttggttcttgttgcaatttcaaccacagtgcttgttgtaatttcattgtcacatccgcatcttctgctgcgtattcagtggcttgttctaatggaatttgattaaacgtaagctgattttttccttttccagcgatgctttcaaatgcgatagtttcatgacctaaataacgtttggctaaatcgtccatattatgacgacccgtactatttagcgtataagaaagcaacatcgtatcaaattcaacaccttgtaattcaatgccatgacgggcaaaaatgctttcatcaaatttaatattttgtccaattttgtgaatgtcaggattttctaaaatgggtttgatagccgcaagtgcggtcgatttttcgagtgtttttggcgcatccaaataatccaattgcaatggtaaataagcggcttcgccattttcaagagcaaaagatatacccactaaattagcagacatataatcgaggctatctgtttcagtatccactgcaatgagttttgctgtattgagtttttcaatccagcgcgttaaatccgcttgagtgagtaaggtttcatattttgtacgatcgatttgaattttaggcgtattttccaccgcactttgatcttgtgaggtcgcctgatactggttcattttcactggctgttcagtggtttgggttatggagtcagcaccattcatcacttcattaagccagcgtttaaattcgtagcgagcaaaatattcaatgagttgatccttttggctttctccaagcaacaattgatctgttgtcacgttaagttcaacatccgttttgatggttgctaatgtataagaaagatcggcattgggtttttcagccaataatttttcacctagttttttcgccccacgaattggcagttccgctactttttcaagattggcataaatttcagccatgcttcctatgccttgtagtaaaccaagtgcggttttttcgcccacgccagcaacgccaggaatgttatctgcactatcgcccataagtgcgagataatcaataatgagttcaggtggaataccgtatttttcaatcacaccctcacgatccaataggctattattcatggtgttgatgagcataatattgtcatccaccaactgtgccatatctttatcgccagtactaatgagcacttttttacccaaacttgatgcttgtagtgcgagagtaccgatcacatcatctgcctcaatcccttccaccactaaaagcggaatgcccaatgcacgaatcatatcgtgcaaaggctgaatttgtttgcgtaaatcatcaggcattggcgggcgatgagatttatactgttcaaacatttcattgcgaaatgttttcccttttgcatcaaaaacaacggctatatgagtgggctgtacttgtgagatgaggcgttttaacatatttaacacgccgtacatcgcgtttgttggctcacctgcggcattagttaaagaaggaaaggcatgaaatgcacgatataaataagaagaaccatccactagcacaagcggatttgttgcaatttgggccataaaaatctcgttttaaactgaaaaatgtgggcattatagcgtaatttatggtgatgagcgaatggcgggtttaatgtaaaatttatgacgaatattttttgctatggcataatatcagccattcaaatatttaatttaaggaaatcaaatgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctctctattgtggcactcaatttgagttttgaattaagccaagaaaaaaataaaacggctaaaattgaagaggtattgagaacgggtatccaacaattagatcattcattagaaaatattcgtgttacaaaagaaccgcattaaattaatgatcaaattagagtcattttgtcgttttataagcaactcgttaaatttgacaaataaatgctagtcaatactgggaatttgggctagtataaacccataagaattacctggagtgttcgtcagtaggctatgtccctgagccgatactttaaatcttataaattggtttcctatcgttggtgtgtaggcttaacctttgactcgttcattgggctaagaaacctgaaaacggtatcaactgatttccttgaaccgtcgggttcaaggactactgcccgcagcggcactctgggtcctatcttctcctttcatttctatgaatactcaaaaacgccagcaaatccgcgctgaaattcgaaaaatacgcgcaaatttaaccgcacttcaacagcaacaagcagcacaatcagtgacccaacaggcgttaaatcttatcgagcaacgacaagccaaaaatattgcattatatttttcttttgatggtgaaatttcaacaaaagccttaatccaatccctgtggatgcaaaataaaaatgtgtatttgcctgttttacatccttttactaaacactatttattgtttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataagtcttttattccagttggtttagcgcaccaatgtcagcaagtagaaaatcttcccactgagcattgggatgtgccactgtttgatattttggtggattaaaacctatcatcaaaatcttattgatagataaaatcaaaatatttcattttttctcttgaaatttattcaaccgagcttacttagtttatgcgaatggcgaaagccgaaatcaaattgaggaaagcgtatgaacattgaaaaatttacgacaaaattccaagaagcgttaagcgaagcacaatcacttgctatcggaaaagacaatcaatttattgaacccgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggtggagatgtacaactttcacgccagcttattaatttacttaatctatgcgataaattcgcacagcaaaaccaagataaatttatttcgagcgaattgtttttgcttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagctcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgtatcgtaaacggcgaagtgccagaaggtttgaaaaataaacgtgtgctttcattagatatgggcgcattgattgctggtgcaaaatatcgcggagaatttgaagaacgtttaaaagcggtgctcaatgaactttctaaagaagaaggtcgcgtgatcctctttattgatgaaattcatactatggtcggcgcgggtaaaaccgatggtgcgatggatgcgggtaacttattaaaaccaagtttagcgcgcggtgaattacattgcgtgggtgcaacaacgttagacgaatatcgtcaatatatcgaaaaagatgccgcacttgagcgccgtttccaaaaagtatttgtggacgaaccaagtgtagaagataccattgctatcttacgtggtttgaaagaacgctatgaaattcatcatcacgtggatattactgaccctgcgattgtcgctgccgcaacgctttcacatcgttatatttccgatcgtcaattgccggataaagccattgatttgatcgatgaagcggcgtctagcattcgtatggaaatagattctaaacctgaaccgcttgatcgccttgaacgtcgaattatccaattaaaattggaacaacaggcattacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagaattagatactgcaaaaaccgaactagaacaagctcgtcgcgcgggtgatttagcgaaaatgtcagagttgcaatatggacgcatccctgctcttgaaaagcaactcgagcaagctgaaaccagcgaaggaaaagaaatgacgcttttacgctatcgtgtcacggatgaagaaatcgcagaagtgctttctaaagccacaggtattcctgtatccaaaatgatggaaggcgagaaagaaaaactcttgcgcatggaagatgaactacataaacgagtgattggtcaagaagaagcagttgatgcggtagcaaacgcgattcgtcgtagtcgtgctggtctttccgatcctaatcgcccaattggttcattcttgttcctagggccaacaggtgtgggtaaaacagagctttgcaaaactttggctaaattcttgtttgatagtgaagatgcgatggtgcgcattgatatgtcagagtttatggaaaagcacagtgtctctcgtttagtgggtgcgcctccaggctatgtcggctatgaagaaggcggttatttaactgaggctgttcgtcgtcgtccatattcagtgatcttattagatgaagttgaaaaagcccatgcggatgtattcaatatcttattacaagtattggatgatggtcgtttaactgacgggcaaggtcgtactgtggacttccgtaatacggtggtaattatgacctctaacttgggttctgatttaatccaaggtaacaaagacgaaagctatagcgaaatgaaagccttagtgatgtcagtggtaagccaacatttccgtcccgaattcatcaaccgtattgacgaaactgtggtattccatccgcttggtaaagagaatattcgtgcgattgcaagtatccaattagaacgcttagcaaaacgtatggaaactcgtggctatgaattagtgtttaccgacgctttattagatttcattggtgaagtggggtatgacccaatttatggtgcacgtccattgaaacgtgctattcaacaagagatcgaaaacagcttggcacaacaaattctatctggtgcgttattacctggtaaggttgttaccattgattacgccaacgcagaagttcaagctagacaataggtattaaaaaaagtgcggtaaatttaccgcacttttcttatgaacctaaacgctgacgtgcaatttcaaataaacatacccctgttgcgacagatacatttaatgatgaaactgaaccagccattggaatactaatcagttgatcgcaatgttcacgcgttaaacgacgcattccttcgccttcggctcccataacaagtgctagtggtcctgtcagtttgctttgataaatggtttcagtggcttcgccagcagtgccaaccacccaaatattatggttttgctgtaaatcgcgcagtgtgcgagaaagattggttacacgaattaacggcacggtttctgccgcgccacaagcaactttacgtgcgatagatgttaattgtgcggatttatctttcggtacgatcactgccactgcgcccgctgcatccgctgttcgcaggcaggcacccaagttgtgtggatccgtcacgccatccaaaactaataaaagcggattttgtttattcgcaagaatttcatcaagatcattttcattaagttcttttgccgcttgtactcgagcaatgacaccctgatgaacctcaccatcggcttttttatcaagtgtttgtcgattaacaaattgcacaccaattcccagggaataaagctcatttaagagtggctgtaggcgtttatcttcacgtcttttaagtacgaagacttcaattagacgctctggcgaatgggttaaaatactattaaccgcgtgaataccgtagatttgttctgacataaatttctctttttcttatttgaatttttaattcatttttacaataggaagtgaattattttcgttttctagatgctttcttcaaaacatctttcttttttaccgcactttttcgtttctgggatgttttagacggtagttctttaaagactttcttggctttttctttcgccgtttttccagcacgacgaggtttacgttcactccccatcagcgagaaatcgaccattttattttctaaatgtactgcttcaactttgatacgaactttatcgcctaagcgatattgcattccgctattttcgccaattaaacgctgttttgctgcatcgaattggtaataatcgttttctaaggtggaaatatggactaaaccatcgatgaataaatcatctaagcgtacaaataaaccaaatccagtcacagatgaaataacaccgctaaattcaccgccaacatgatcttgcatatattcgcatttcagccaatctgccacttcacgagtggcgtcgtcggcacggcgttccgtcattgaacagtgattgccaagtaaatccatttcatcaaaagagtaatgataaccgcctgtatcggtggttttacgttttgcgccttgttctttagcgagtaaatacttgatacctcgatgaagtgttaagtctggataacggcgaattggcgaagtaaagtgtgcatattcttccaaagccaaaccaaaatgcccaatattatcagcatgatagacggcttgacttaatgaacgtagcaacattgtttgaataagttcatgatcatgtcgttctttaactttttctaagagagcagcatagtcttttgtggttggcttcaatccaccttctaaggttaaaccaaactcacttaagaaagtgcggaacgatgttaatttttcttcgctcggggtggcatgaatgcgatataatgcaggttctttatgtttttccataaaattagctgctgcgatattcgcaagaatcatacattcctcaatgattttgtgggcatcattgcgaacaacgggttcaatacgctcaattctccccattgcattaaaaataaacttagtttcaatggtttcaaaatcgatcgcaccacgttgatgacgtgcaccaagcaacgcttgatagagtttataaagatcttctaaatgaggcacaagcgtagaataacgagcgcgtaattcttcatcgccttcaagcatttttgctacttttgtataagtgaggcgggcgtgagaattcatcactgcttcataaaagcgataatctatgagcttacctttggcagaaatttgcatctcacacaccatacacaaacgatccacttgtgggtttagagagcataagccgttcgataaaatttcgggtagcataggtacaactcggttcggaaaatagaccgagttaccacgattatgcgcttccacatccaaagcggaacgtaaacgtacgtaataactaacatccgcaatcgccacccaaagtttccagcctttgccgtgtttttcacaataaacggcatcgtcaaaatcccgcgcatcttcaccatcaatggtcacaagcggtaaatttcgtaaatccacacggcctttttttgcttcttcaggcacttcttcagtgaatttttttacgtatttttccaccgcacttggaaacttatggggaatatcgtggttacgcaaggcgatttccacttccatttctttcgccatattatcgcctaggatctctgtgattacgccaattggctggttaaaactggcagaacgttcttgcaactcgacaaccacaacttgtcccatgcgagcaccattacgatgttcatttggcacgagaatatctcgaccaattctgctgtcatcaggcaccacatagctaaaaccgttttctaagaaaaaacgacccacaatttgttttttacggctttctaatacgcgcacaattcgcacttcacggcgaccacgacgatctaatccagcaagttgcgctaagacaaaatctccatgcatgactctttgcatttgatggtttggaatgaataaatcatcctttttgccatcgacctgtaaaaaaccaaaaccttcgcgatgaccaattaccgtgcctttaaataaatctaatttttctggtaaggcatagcgtttacgtttggtgaacactaattggccatcattttccatcgcgcgtaatcggcgacgcatcgcttctatttgctcttcatttcgaatggaaagtgcggtcaaaatttcatcccgattcatcggtgcattattgtctcgaataacgcttaaaataaattcacggctcgggattggattgccgtatttttccaattctcgtttgtaatgaggatcttggctgattaagtttttacgtttttttgtcattattttttacagttttaaaaagtgcggagagtttgacactgtaaggaggataatgcaagacggggataaaattatcactgtatattttaaggatattttaaaattgaagaacttaacgatctttccccagcactataacagtgatgactttttatagatatttttaaagtatgaaaagcgcggtaaaaattttatgcaggaacgcgttctgttacgagcatttgtagttttcgtaaaataacatttaatactacgccataggctggtacgaataatataatgccgacaaatagcttaaataggtaatctacaaaaccgagttgtgcccagtgttcagccatgaacggatctgcactttgatagaaggctacactgaagaaaacgaatgtatccgccattgagccaaatgtcattgagctagttggcgccacccaccaagtttttaactggcgtaagcggttaaatacgatcacatcaagcaattgtcctaccacgtaagcggcaaagctcgcaatagcaatacggaatacaaacagatcaaaatgcgttaatgattcgaaaccttggaatttgctttcagagaataaaacagatatgacgtaacttacaataagtgcaggaaacatcaccacgaagatgatttttctcgcatcttccgcaccgaaaatgcgtacggttaaatcggtagctaaaaagataaatgggaatgtgagcgttccccaagtgctgtggaaagaaaaatcgtttgctgcaccaagtgcggttaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggctgaatatagggagctagatgatacgcatatttctaataattgcaagagtcgattgcatttgagttttatattttatgaaaattgacgaatgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctccttagtaaattgagcataaaataaccgcactttagttgtatcccaaaagtgcggttaattttttctaaattttagcgtttagctttatttattaatgcgtgctagtacttgttgttgtacgatttgcacgtttacgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgcccttcataaacttctacgtttgcatcaatcattaacttaccacgttcttgtaagccaaataatgcatagccaagtgctttgcctgtcgcattagaaattaatacgccgtttttacgttggccgatatccccacctttgatctcatcgtagtggctaaagcttgagtaaagtaagcctgtaccagaagtcattgtcataaagtctccacggaagccaatcaatccacgactagggataatgtattccaaacgcacacgacctttaccgtcaggcaacatatcacgaacttcacctttacggatacccaatgcttccatcacagaaccttggtgttgttcttccacatcaatagttacttgttcgtatggctcttgttttttaccatcaatatcacgatagattactttagggcgagaaacggcaagctcataaccttcacgacgcatattttcgattaacacggaaagatgtaattcgccacgaccagatacacggaattcatctgggtttggggtttcttctacgcgtaatgccacgttgtgaaccaattctttatttaaacgttcaagaatttgacgtgatgtgacatattttccttcttgtcccgcaaatggagaggtatttacacagaagaacatggttactgttggttcatcaaccgttaatgatggcagtgcttcaactgcgttgatatcacaaatcgtatcagaaatatttaattctcctaaaccagtgatagcaacaatatcgccagcataagcaacgtcttcttcataacgttgtaaaccaagatgtccaagtacttgaccgatacgaccttgacgagtttttccttcactattgatgatagtaacaggttggtttggtttaatcgaaccgcgcttaatacgaccaataccaataacgcctacatagttgttgtagtctaattgtgaaatttgcatttggaatggcgcatcaagttctactttgggcgattctacatatttcacaatggcttcaaataatggcgtcatatcttccgctaaatcttcgtgttcaagacctgcaacaccatttagcgctgaagcatagataattgggaagtctaattgttcatcgcttgcaccaagattgacaaataagtcaaatacttgatccacaacccagtctggacgcgcaccagggcgatcaactttattaattacgacaataggttttaaaccatgagcgaatgctttttgtgtcacgaaacgcgtttgtggcattgggccatcaaacgcatcaacaactaatagaacagaatccaccatagaaagtacacgttcaacttcgccaccgaagtctgcgtgccctggagtatctacgatgttaatgcggtagtcattccagttaatcgcggtattttttgcaagaatggtaatgccacgttctttttcaagatcgtttgagtccataactcgttcatccacatcaccacgagcagattcaaaagtaccagattgttgaagaagtttatctacaagagtggttttaccatggtctacgtgcgcaataatggcgatgttacggagttttttaatatcaatttcgtttttcattatctaatgcttcgagtagggtgcaattttgcacggtatatgattttataaaaaaggtgcaatttacagcacctaattataggttgttgtcttatgttgaagaaaacgagacattatacctcagatttatttacgtagtctcattttctttgctttcaaagcgtgttttatatcattaggtaaacgtaatatatcccagatcaaccgaaaaatcagattttggtaaattcttggtttggaatatataccaatttttttatatacaaacttcggcggaattaaaatatcttgtgtgtaatttttcttttcttcgagaataaaagtaattgggttattcagtggtgataaagggaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctgtttgatgatgaaatgcgtaaggattccctttttcttgataaaaatcaatgcctgtcaaataaagatctttataacccattgcagttgccactgcacacatatagacgcctgatgtaatcctcttattctcatatagttcgtgatattgtaaatgagcatcaaaagctcgtagtttttttaaatagctatgaccaagatcgatttgtggtagtaatttttctaaacgctggattttctttaattctgaatcccctaaatttagaaaagatgataaaataatatcagcatattcatattcattatttttaattaattgcataaacgtatagtattgttcaaaaattacagaacaattaaaaaataccttttttattttcttaccaagaaaataatgatcctcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattggacatattgtaccgttcattgaataaaatataacttatctttaatactaaaaaatagtagctattatacaggctttctgtgctttttactataacgccacaacaaatctaatgaaagtcagatttgattagactataatacttccttaattttttatatagaaagaggatctactatgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggttcgggtatgcactgtaatatgtcgttaagtaaagacggaaaaaatattttccaaggcgataaatatgcaggcctttctgaaaccgcactttactacatcggcggtatcattaagcacgctaaagccttaaatgcgttcactaatccaagtactaattcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaaacaaaatccacccaggcgatgcgatggataaaaatctttacgatcttcctccagaagaattaaaagatattccagctgttgcaagctctttagaagaagcattgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcgtaatgtcattgacgtaatcatttttaaaagtgcggtagaatttaccgcacttttcgtttgaaattgtttataacgagactcgggtaaaaatgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaataaggtcaaataattaactattagaaataaagctggtatagtttctaaatttattttgtttatacatgggggaataaatatgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcggctgaatttatcttaaaccaagctgatatttataatgaaaaaagtgcggtaagttttaagattatttctggtgaggaacttgagcaacaaggttatcacggaatttggactgtgggtaaaggctctgctaacttgcccgctatgttgcaacttgattttaatccaacacaagatccgaatgcgcccgtgttagcttgtttagttggcaaggggattacctttgacagtggcggctacagcattaaaccaagtgacggaatgagtacaatgcgaactgatatgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaagtaaggagatatgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgttaattgatagcaaaaagcacctaaaagttttaggtgcttttaaagttttaatgcttacaaaattagactttcttaaggtttatagatgaactcaattccttcatcatcttcttcagtccaatcgtcatcccaatcttcgtcatcatcaaattgataccccgctagttgttcctgatgataatcttcccatttgaattttacttcttcaggtgcaacttgttgtgtttcagcttcgcgtggatttgctatgataaagtccataatatcacgacaaagtggtggaacatttttccttgttgcagctgaaatcaggtaatagtcttcttcccaacctaattgttcagtgatttctcgaacccgctcttcagcttcttcatcgctcatcgtatcaattttattgaacactaaccaacgtggcttttctgataatttttcactgtattggaaaagttcagattcaataatagcgacattatctgctggattagatccatcaattggagcaatatcgactaaatgaataagcactctacaacgttctaaatgttttaaaaagcgaattcctagcccagcaccatctgcagccccttcaattaatcctggaatatcagcgactacgaaactgtgtgaatcgtctactttcacaacaccgagacttggtactaaagtagtaaatggataatctgcaacttttggtttggctgctgaaacggcacgaataaaagtggatttaccagcattaggtaaaccgagcattcccacatcagcaagtagcattaattccaataataaatcgcgtttttcgcccggcgtacccattgttttttgacgcggtgcacggtttactgatgatttgaaacgagtattccctaaaccgtgataaccacctttggctaccaacattttttgaccatgttgggttaaatcccccaaggtttctttggtgtcgttatcaatagcacgagttcccacgggaacaggtaaaataatatctttaccgcgacgtcctgtacaatctgaactccgtccattctctccacgctctgcggcaaagcgtttattaaagcgataatcgattaaggtattgaggttttcatcggcttgtaaatagacatcgccaccatcgccaccgtcgccaccatcagggccgcctttcggaataaatttctctcgacggaaacttacgcaaccgttaccaccatccccagcctcaattcgaataagggattcatcaataaatttcattaaaacttctccaaaataaaccgcactttaatgatttttatgcggtaataatttatgtccaatcgcggataaaattgccccgcatactacaacaaatgcgccaatatagctaatattattcaattctggtgctgcaaaatctactgggctaaaataatgggcaatatgtgaaaataggatcgtgaaaagaggtacaagtgtgataacaacactgacttttgatacatcccaacgattaagtgcctccgcataagagccgtatccaattaaggtatttaaacagcagtaaataaaacaaatcagagctaaaggtgtgagttcttgcacttgcgagaattcagccatcggcataaagactatggcacaacctaaatacatcattagcaagatttgttgtgaattaaatttacgtaacattaatttttgcgccattccataagcgacccaaataagagcgccccctatacttaaaatgacacctgttgaatactgatttagtccagaaaatacagcaaaacgattattaaagaataaacttagaccaattaacaataagaaaagcccgatcttttggtgcaaccctaatttttctttgaaaatcagtacaccacagatgagcattccaaaagaggataaatgaataaaaatttgtgcaactgacggttcaatgtaattcagcgagctactaaataatagaaaattgccagtaagaccaattactccaataagcataatccacgcatattggcgaactttcattaattcaggtaattgttttttataagcaagtaaagccaataatgaaactgcagcaataatgaaacgataccatacgatagtttgcgcattcattacagacaaaacttgtttcaaggcaataggcaatgacccccaagccatagcggtaataagcgcaaaggtaaagcctaataaaggttgttgtttcattgcttgctcgcttatgtgaaattaaaaagacaaaacgccccacaaaattgtagggcgtttcaatggaatagattttaaattattcagtaacaatacttacgtatttacggcttttctcgccttttacttcaaatttaactttaccatctgcagttgcgaataaggtgtgatctcttcccattcctacgttgttacctgcgtggaatttagtaccacgttggcgaacaataatgctacctgctaatacagattcgccaccgaaacgtttaacaccaaggcgtttagcttcagaatcgcgaccgttacgagttgaaccaccagcttttttagttgccatctacttgatctcctctgaaattatgcttgaatcccagtgattttcacttctgtgaaccactgacgatgaccttgttgtttacggctgtgtttgcgacgacggaatttaacgattttaactttctcgccacgaccttgtgcaattacttcagccactacttttgcgccagcaactactggtgcaccaattttaacatcttcaccattaacgaccatcaacacagaatcgaactcaactgttgcgccagttgcaagttcaagtttttctaaacgaacaacttgaccttcgctcacacggtgttgtttaccgccactttggaaaactgcgtacataaatactccgcttaattgtgttttcctgctttttagcagtccacacttaaaaattcacataaataggtcgcaaattctacggaaaaatcctacctatggcaagaatttatttataataaaataaaaaaattcccttcatttgcggattgatttcagaaagtctgaaaattcgggtaaaatgcaccgcacttttgactgataaatgatgaaaaatgaagaaacaagatcttatgagcatagacgagatccagaaactagcagatccagatatgcaaaaagttaatcaaaatattcttgctcagcttaattcagatgtaccgctaataggacagttaggtttttatattgttcaaggtggtggtaagcggatccgcccgttgatcgcagttctcgcagcacgctctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcccgaaacgagcgaagctaattatatgcgtgtaatttatagcaaaactgcccgtttgtttgaagtggctggtcaggctgcggcaattgttgcgggcggaacagaagctcaagaaaaggcgttacaagattatgggcgttatcttggcactgcatttcagctcgtggatgatgtattggattatagtgcaaatgcgcaagctctaggcaaaaatgtaggcgatgatttagctgaaggaaaaccaacccttcctctgctacacgctatgcgtcatggaaatgctcaacaggcggctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattagtccataatttagcttatatacttgatacccattaattttaattaaactttatgaatacagaacttcaacctaaactagaaaaaagtgcggtcaattttcaagctaaaccgcgaaaacaaaaaatccgtaaggatcctaacgcaccttttattcgtgaaaaacttgagttgccagatggacacaataagctccttttgcattcttgttgtgcgccttgctctggcgaagtgatggaagcaattcttgcatcaggcattgaatttacgatttatttttacaatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgagagaggtattcgctgcacaatgtgttttgatatgcgctttgaaaaagctgctgaatatgctcatgaacatggtttccctgtatttactagttgcttgggaatttctcgctggaaggatatgaatcaaatcaatggctgtgggcatcgagctgcggaaaaatatgatgatgtagtttattgggattataactggcgcaaggaaggtggttcacagcgtatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgattaaaaaatagaaaaataaaggtgttgtttcacagaatttgctgaacagcaccttttatttcactattttatcacttcatcttgatcataatgattaatttttaaacgttgaaaataatcttttgtttcttcaatgatcacttttcgcaatccaataagcgcaataagatttgggaaagccatcaaaccatttacaatatcggcgataatccatattaaatttaagtgtaagaatgcccctaaaccaaccaacataatataagctagacgatatagttttacgccacgaataccgacgagataaacaaagcaacgttccccgtagtaacaccaacctaaaatagtcgtgaatgcaaaaaataataaaccaactgttacaatcgttgcaccaattgatgtgcctaaaccttgtgcaaaggcatagtttgtgacggtagcacccgctaattcaggattgttccacgctcccgttaataccaatacaatacctgtcattgtacagacgatgatggtatctaagaatgtacctgtcatggaaattaagccttgtcgcacaggttcacgagtttgtgccgctgcagctgcaattggtgcgcttcctaaaccagattcattggagaaaatgccgcgcgcaacgcctgattgaatcgctttcatcacagtaagccctacggcaccgcctaatgctgcttgcggatcaaaagcactatcaataattaataaaatcgcatctggtactttttctatatttaaaaggataataaccagtgaagtcgtgacgtataaaatcgccataaacggcacaattaccgatgatgcggttgcaatacgttttacaccgccaagaataattaagccgactaaaagcgtcacaataattgcagtaactaaaactggaatattaaaagtatcttgcattgcatgggtaatcgcattgacctgtgggaatgtgccgatcccgaaaaaggccaccatcacaccaaataatgcaaataattttgctagccatttgatacctagtccgcgttcaatgtaatacatcgggccgccagccataaagccatttttatcgcgaacacggtatttaacagcgagtaaacattcagcatattttgttgccattcctaacaaagcaaccagccacatccaaaaaatagcccctggcccacctgcttgtaccgcagttgcaacgcccacaatattacccgttccaattgttgctgctaatgcagtacaaagtgcagcaaaagaggaaacgtctccttttccacctttatcttttttaaataaataacctagcgcacgcggtaagtagcgaatttgaataaagcctaagcgtaacgttaaatagagtcctgtaccagataataatataagtagaggtgcgccccaaataaagctatcaatagctgaaagaattgactcaattgtcattgtgattcctcgtcgtttaaatcaaaaataaacacgacaagaagacgaaaagatacaatggaaaagaaagtgcggtaaaaaaatgaataatttccacacttacaatagattgtcttttgcccctgtccttttgcctgagcgtttgaaaaacgattgaaaaattaaccgctcttttgcgccttcggcgtccatttctaaaatggatctctccaagggttcgtccagtaacagtccctgccatcgcacctgaaagattttacatcgtcggtgtggggtcaattccccgctctccagctaccttcatccgaactcactttccattagatattgaaaagtgtgcgaattctaacaaaacaggaaatgaatttcaaaaaggaatttttatgtagaaaaatcacttcattcaatatctccgcaaaagcgatagccttctccatgtatagtcataatgatatttggagtatttggatgatcttcaaaatgttttctgatacgtcgaattgtgacatctacggtacgatcctgaggttttaactctcgtcccgtcatttttttcagcaattcttcgcgcgtttgcaattttcctggattttcacagaaatgtaacattgcacgaaattcactgcgaggaagtttgaattcttgtccttctggtgtaattaaactgtggctatttaggtctaatttccaaccattaaaacgatagaattctcgaccaaatgtattttctttttcttgatgcgacattgtgcgatgcaatagattacgtgcgcggatagtcagttctctagggttaaaaggtttggttaaataatcgtcggcaccaatttccagacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcggtgattttttacctgattttcctttttgtgatctaaatcatagttttaggtattcaaatttctttgtgatagaatttcgagcatctatatttttatactcaattctatgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcattaagttagaattatttacaataagtaaaaactctttttctgttatacatcttgtttaacaaatagctaatcattactatagctgggttttaatttatctttaaacgaaaggaaagcaaaatgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaagtagtttagttgtagtttcataattttatccttatttttgcccacatttatgtgggcttttttatgcctgaaatttatcgcattttttaccgcactttaagaaattatatttaatcttttctatatttaagcaaacgtttgcgttataatccaactcgcttatttttaaccatttaatgaaaggaaaatacaatgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaatttcgtgcgtaaacaaactatgcgttatggcgaaaattcccatcaaaatgccgccttctatgttgatttaaatgtgaaagaagcgagcgtggctacggctaatcaactgcaaggtaaggcattatcttacaataatattgccgacaccgatgctgcacttgaatgtgtgaaagaatttgatgagccagcttgtgttatcgttaaacacgctaatccgtgtggtgtggctttaggtaaggatattttagatgcttataatcgcgcttaccaaaccgatccaacgtctgcttttggcggcattattgcttttaaccgtgaattagacgaaaaaacggcgaatgaaattgtggaacgccaattcgttgaagtgattatcgcaccgaaagtttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgtgtgtattcggccaaaattgcaggtatcaaagcacaggatgaaggcttgaccgtggcaggttgtgtgatggcatctgatgcgttcttcccattccgtgatggcattgatgctgcagcgaaagtgggaattcaatgtgtgatccatccaggtggttcaatgcgcgatcaagaagtcatcgatgcggcggatgaacataatatggtaatggtattgactggaatgcgacattttagacattaatttatctaactatccccctctttacaaaagagggggaattgcaggtaaaaaatagccgtactttttttaaattaggcatacgcaaggactacaacatgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggctactagccaagatcataaacgcgtgggcgaaaatgatacggggttaaatacaggcggtatgggcgcgtattcgcctgcaccagtaataacacccgaaattcatagtcgcattatgaaggaagtgatttacccaaccgttaatggcatggcagcggaaggcagtgtttacacgggtttcctatatgcaggattaatgattatgccaaatgggcagccgaaagtgatcgaatttaattgtcgttttggtgatccagaaacgcagccaataatgctacgtctcaaatcagaccttgttgaactctgtcttaaagcatgtgacggcaaattagatgaagtaatatcacaatgggatccacgagcttctttaggtatcgtattggctgcagagggatatccaaaggattatcgcaaaggcgatgaaatcagcggattgcctaaaagtgcggtcaaaaacgagaaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagaacaagcaaaatagttagaaatcttgttgaatttaattagataaaaaatattgtacagggtagaattgtattttcctaggatttaggattttgttagggcaacgtttacgattgctctgacaataaattagaattattattttgttactttatgaggttatatcaacttatgcgacaatttgtcatcgtagtattatattctgcaattcttctttcattagaagttatttatagaaaattatttaatatttctagtattgagagatacactgaaagttatttgtctgtctgtttgtctgtttgtttgttttttcaaaatatagaattacaagaatattagttggcgctttatttgcaataagtattgttgttaataatgtacattatgcagtataccaatcttggattggacctgttaattactcacttgcatttaaagaaattaatgagataacaaatgctggcttaacaatgatagataaattcatatatccattgttatttggtttatttgaagttgctgtgtttttaagtttaagtttcataaaaagaaaagtatataaactttcttggatttttgactttattttttatgctgtgatgatgtatgtttttgttcgagcgtatacaacaaaatcccatgagcgttttatttcacctaacactgtttattctcgattaaaatccaattatttatcgttgggttattttataggacgaattgttccttatgagatattttctttatctaatattcctctttatcataaatctaagcctatgaaatcgggctctccgaaaattaagaatataattttaattatgggggaaagtgcgacctcaagtcattttagtgcttttggttacgggagaaaaacatctccttttttagatagcttaaaatataaatcaggagctcttgttggtaaaacttattcaggaggaaagctaacagcaatttctttaccaatgttttttaatgcaattccttatccaaatggaatacaacagatagctaaaggagatacgaatttatttaatttagcgaaagagcaaggctttcagacatatttttattcagctcaagctagggatgatatgcatatgatcaattttttaggaggagcttggattgatgatattcgttttccagataatgaagggtattctttaagagattcaatgcctgataataaattacttcctgcttttaaaaatattaatttagataatggttatcattttgttgttttacatcatagagggagtcatattccctatggggcattattagatgaaaaagagaaggtgtttggaaaaaataacgcaacagataattatgataatactattctaaatactgataactttatctcagaggtttaccattacttatctaataaatcttctaaagattggataattgcctatacatcagatcatggtcaatatgtaaaaggcgacacttataagcaagggacatttgatgaagataattatattgtgccattagttctatatagtccaaatgaagaaatacagaaactagtgttggacaattttgaatcatgtaagatttcatttcataatcagttatctagctttattattaatataatgggatataactattcagttagcacttgcgataagggggttgttaatggaaatattctcacaggtgatgctggatacctaaaaatagaatctaatggtaaacaagagtatgttcattaaattagacgctatgatgaattaatttcatttaagtaatgaaaatttaggaatgaaattttaattaagtttttatccataaacagttaaactatctgccataaattacataacaggagaacacaatgtttacaagaaatatgactatcgctgattacgatccagtattgtggcaagcgatccaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgcggacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatctaaatccactccctcatgcacatgttgtgacaacaacaacccataaaacgttgggcggtccgcgtggtggtttaattctttcatcttgtggcgatgaagaaatctacaaaaaattacaatcatccgtattccctgcaaatcaaggtggtccattagttcatattattgcggcaaaagcagtttgctttaaagaagcattagagcctcaatataaagaataccaagcaaatgtaatcaaaaatgcgaaagcaatggttgaggtatttaaacaacgtggttatgacgttgtgtcaaatggcactgaaaaccacttgttcttagtaagttttattaaacaaggattaacaggtaaagcagctgatgcggcattaggcaaagcaaatattacagtgaataaaaatgctgtaccaaacgatccgcaaaaaccattcgtcacttctggcatccgtgtaggtacaccatctgtgactcgccgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatgatttattttctttcgttgattatatgtttagcggcgattaatatcgccgcttattttttatgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcatcacaacgagataacaataattttgagcaaattcaacgaattatgaattctcaagtttctcaacaagagcgtttaaaatgggcagatgatgtgattaacaatgattctgaactggcccaaaacttaccgcacttgcagcaaaaggtgctagaattgcaccagttttatttacaacaagcggaaaataaaaatgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacggatggagcattaaatagagattaaccgataggaaaccctatcggttaatttttataagtgcggtgctttttttgaggatttttcctaaaaatgctatgctaaacgtgattttattattctaaaatgtgatttttatgcaacaagattatttaagccaacaacgattctccgctcttcctctacatccgattgtgcgaggtgctttggcaaaaaaaggctttgatttttgtaccccaattcaggctttatccttgcctatcagtttaaatggacgagatgttgcaggacaagctcaaacgggtacaggcaagacaatggcttttttaacggctacttttcaccatcttttaactcaccaagatcctaatcttgaatatcctcacccaagaactttgattttagcacctactcgagaattagcggtacagattagtaatgacgcagaatttcttgcaaaagcgagtggattaaagaccgcacttgcctatggtggcgatggttatgataaacaactacaagtgattgagcgtggcgtagatattttgattggtacgacggggcgagtcattgattatgtaaaacaaggcgtaattggtttagatgaaatccaagttgtcgtgctagatgaagcggatcgaatgtttgatcttgggtttatccgtgatattcgttatttattgcgtaaatgccccgctccgcaagcgcgtttaacgatgttattttcagcgacgctttcttataaagtgcgtgaattagcatttgaggatatgaatgatcctgaatatattgaaatagaaccggaacaaaaaacaggtcatcgtattaaagaagaacttttttatccatctaatcaggataaaatggcacttctcttaaccttaatggaagatgaatggcctgagcgctgtattgtgtttgcgaatacaaaacatcgttgtgaagaaatttggggttatttggcggctgatggacatcgtgttggtttactgactggcgatgtagcccagaaaaaacgtttatcgttattaaaacaatttaccgacggtgatttagatattttagtagcaacagatgtggctgctcgtggcttgcatatttctgatgtgacgcatgttttcaattatgatttacctgatgatagggaagattacgttcaccgaattggccgtactggacgagcaggggaaagtggcgtttcgattagttttgcttgcgaagaatatgcgatgaatttaccaggaattgaagaatatattggccattctatcccagtgagccaatatgaaacagaagccttgcttgaactgccgaaaccgtatcggttaaaacgtgcagtaccaccgcaagggcatacaagacatcgttcttatcacacaaaataaggtagcctcattctacaccttgatttgatgatgaaaagtgcggttaattttgactgcattttatattcctattttttatatcctcctttgtttatcattcatcttatgggtttacggattacctacagataagtattgttacgctttttgttttttaacttgccaaaaaataaaaaataaataaaatgaacgtccattcatttttgagcaattattgctccttattttactcaaggatcttatgcgacaagctaaaactgatttagccgaacaaatttttcttgctaccgatcgtttaatggcaaaagaaggtttagatcggctttctatgcataaaatcgcaaaagaggcaaatgtagcagcaggaacgatttacctttatttcaaaaacaaagatgagttgcttgaacaatttgcacatagagtgttttcaatgtttatggcaacacttgaaaaagattttgatgaatctaagccttttttcgaacagtatcgacaaatgtggaaaaatatttggtatttcttacaagaaaatcccaccattctatccaatttaaagcaatatgaatctttgcctaatttcaaggatatttgtaaaaacgttaaaaattgtcgttgggatttattttgtgaccaagccaaaaaagctggcttattagcggaattatctgaagatattctctttttattaagtttgaaaacggcgataaatttagcctctgatgcaaaatttatcgatttcgatcttaagcctgaaattttagaatctgtgattgaacgctcttggcgtgcgattcagaaataattgttgttatttttataacggagctttaaacatgagtcaaactcaacatcaaagaccaaaacgctcacatattttcttgatgaaaataattttagtggtatttgtcttaatttttgtcggtgtcatcggttttaatataataaaaggcgtaatgataagccgagccattgcagaaatgccagaatcttcaagcccagtaaccgcacttgaagttcaaccgcgtgaatggacgccagttattaacacaacaggtcttgtgcgtccaaatcaaggcgcattgctcagtacacaaaatgcaggtacgatttctcaagtacttgtgcaaaatggacaaaatgtgaaaaaaggtgaggtgcttgtggaacttgatagttctgttgaacgagctaatctacaagctgctcaggcacaattatcagcacttcgtcaaacttaccagcgttatgtgggtttattaaacagcaatgctgtatcacgtcaagaaatggataacgcaaaagcggcttatgacgctcaactagccaatatcgaatctttaaaagcagtaattgagcgccgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaattacggctattgaacctgccattaattcatcaacaggtttagttgatgttcaagctacatttaatcctgaagatgggcataaattgctttcaggtatgttctctcgtttacgcattgcgctaccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagcgggagataaaattattacaggcggtcagcaaggtattggtaatggaagtcttgtggaatggattaaaaaagacattgtgggtgcagtagagcctgcacataaaacaccactttaatgtatgaggaaatccgaatgaaatttaccgatatatttattcgccgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaacctcaattctttacgattgaaggcgtggcagaagtacaagtatttggtgcggctgagtatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgaccttgcttgctttaattcttgccataggtttagttgtagatgatgctattgtggtgctggagaatattgatcgtcatattaaagcgggagaaacgccattccgagcggcgattattggtacgcgtgaaattgccgtgcctgtaatttctatgactatcgcattgatcgcagtttactcaccaatggctttaatgggggggattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaatgcgccatctagcgtaaatgtggattacattcaaaatgcaatgcaaccatatatgaaaaatgtaatggaaacacccgaagtctcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggcgctccagtctctattgtattgaaaactgcgcaagattataaatctttggcaaacaccgcagagaaattcctcagtgcgatgaaagcctctggcaaatttatttatacaaatttagatttgacctatgacacggcgcaaatgacaatttcagtagataaagagaaagctggtacttacggcatcacgatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagccaattaaattcggctgaaatcagtgctgtaccaatgccgggtatatcaagtggtgatgccattgcttggcttcaacaacaggcaaatgataatttgccacaaggatacacttatgatttcaaatccgaagctcgtcaattagtacaagagggtaatgcacttacgacgactttcattcttgctgttgtaattattttcttggtgcttgccattcagtttgaatctatacgtgacccaatggtaattatgatttccgtaccattagccgtaagtggtgcattggtgagcttaaatattttatccttctttagcatcgcaggaacaacattaaatatctactctcaagttgggttgattactctcgtgggattaatcactaaacacggtatcttaatgtgtgaagtggcaaaagaagaacagctaaactatggtaaaactcgaattgaggcaatcactcacgcggcaaaagtgcgtttgcgtccaattctaatgacaacggcggcaatggtagctggcttaattccattactctatgcaacaggtgcgggagcggtatctcgctttagtattgggatagtgattgtagcgggattatccattggtactattttcaccttgttcgtcttgcctgtggtatatagctatatcgcaactgaacacaaaccattaccggtttttgatgaaaataaaacaacccactaattaaaacatagaaaaaacaaaccgcacttaggttatcttacgtaatttgtacttataaatagttgttttatccaacttttttgagcataacctgtataagtgcggtatttttttattctgttaattatataaataatccacttatgttagtctttatttaaagactatttttcagtaaacttagcgaattttgttgaattattaaaattatcacttcaaatctaggaatttattgtggcacatcgagattttgctgcgcgtcgtagctcaaataataagaaaaaaaataagaaaaagaatacaaatgtcttgatttttcttgctttatttattgttctagtttttgttgttggactttatttgttgaaaaatcagaacagtaaggtaagcgtgcagcaagctataacacaacaggaaaaagctcaacctaaaagtgtgttacctaatcgtccagaggaagtgtggagttatattaaagccttagaaacgcgtactgtacctgtagataataatccagcgagtgtagaacaaaatatgcgtttaacagaagaacaacgtcaagttttaattcaaatagaaagagatcaaaaagcggctgatgaagctagaaaactggctgagcaacagagaatagaagatgcaacgagaactcaatccaaaaaaacggaagatatgaaaaatacagagtcagaaatcgtaaaattggaatcaattaaaaagcaagactcacagaaaattgaaagcgcaaaaaaagtagaacaaataaaaacggttaataatgtacgggatagcaagaaatttggtttacaatgcggtgcttttaaaaatcgagcgcaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagctaaaactgttaccgattgtgttgtgattggtatgtaatatatatttattttaatgctgagtactaaaaggtggttttgcaaaccaaatcacaataagcaatcctaagaatcccatagctgataaccaaaatatttcatttgcgccaataataaatccttgcgatgttatttgttgagcgaggtaagctgaagtttgcgtatcacttaaaccaaattgattcatttgatggtaaaaactttgggaaatcgggttataaggattaatgtgttctgttaattgagtgtggtgaacagcttcacggttataccacataaatgtggtcaaagatgttcctacagaacccgctaaagttctcaaaaagttaaataagctagaggctgaagccattttatgcgcaggcaagccagacagcgttattgtagtaagtggcataaagaaacaggacaccgctaaaccttgcactaattgtggtaaagctacatcaacaaatgtcattgatggctcgaaagttaccgctcgccaataaaatgttattgcatatacaataaagcttatcgtcactaaaattcgcatatcgatcttataaccgaaacgcccaataatcggtgaaagcaaaattgggaataatccaactggggaagccgcaagccctgcccacgtcgcggtgtaatggaagacttgttgtagcaagagcggaattaataccacagaacctagataaatcaaaaaggctaaactagtacataaacaccctacgctaaaattacgagaatggaaaagtgaaatatccactacaggattgtcatctgtcaattcccaaataaccaaggcaatcagacaaacgacagcaacaacggctaatataatgatttcattagaattaaaccaatcttgctcacgaccctgatcaagcattaattgcaaacatcccactcctaagacaagtaaaactaaaccgactttatcaataggttgatgaacaatttcactttctctgcttcccaaaatcttccagctgattagcacaactaacaaaccgatcggaacattgataaaaaagatccatccccaatggatattatcgctaatccatccgcctaaaattgggccaaaaataggcgcaaccacaatagtcattgaccaaaatgccaatgccattccgcgtttttctggtggataattatttaataataaactttgcgaaagagggatcactggacctgcgacagcaccttgaatgacgcgaaaaataattaacgcctcaagactatctgcaatcccacagagccaagaagagacaacaaataaaaaagttgagactaaaaataaccgcacttcgccaaaacgttttgctaaccaacccgttattggaatagaaatcgcatttgctaccccaaaagaagtgattacccacgtaccttgactaaaagatgcgccaagatcgcccgcaatagtaggaatcgccacatttgcaatggtagaatctaatacctgcataaaggtggcgagagataaagccagtgttaataaaatcagcacaccaccttgaataggcgggaatttttttgcggaattgtccataacgccgccttaatggctgttttgctgaatgatagattcaatcaaattttctaccgcactttcatcatatttaagtgtatcagtagaaaataacgttttcggttctgttttttctcgtagcattgcgcctgatgaatctgaaattcttacttttgccgttgcagaaagaccaattctcaatggcgtttctgtaaattgttgtggatctaatttaattcgcacaggtacacgttgtaccactttaatccagttacccgtagcattttgcgaaggtaaaagagaaaacgcattgccagtccccatttcaatgccatttatcacgccatcaaattctttatttttaccgtataaatcaaaatggatttttactggctgaccaatgcgcatattcgttaattgggtttctttgaagttagcttctaaccacatttgttcattagataccaccgccattaacgcgccacccactgaaacggcttgcccaacttgaacattacgacgcgccacatagccatcaattggacttctaatttttgtacgttgcaaatttaaccaagcctgtttaagcgagtttatcgcattctgtatttgcggttgttcacgtaatggaacgttacgcaataaagcctgattagcagccaattgatttttagaggcatttaaatttgctttggcaagctcgacagcttcttttgcgtgttggaaagattctttatcaatcgcacccattttttcaagttgaactcggcgcgccaaattgccttgagcttgagctaaagaaatttcattggcgtgcacagctgattgcaattgctgcacagtgaaacccagttgttctacctgacgtacagcattggcgagattgcttttggcctgttcaaaactaagtttcgcattggtatcatccaattcaactagaatatcacctgcatggactttatccatattgtctgcattaatcttcgctacattacctgcaacttgtgatgataccattacttgatttccacccacataagcatcttctgtttcttcaaaatccttcaagaagaaaaaccaatacaaagcacaagcaataccaataataagcaggagaagaataaaaatgcttaagccttttttacggttagttttatttgatacagatttatttgatggagtttcaattgcagttttcgtcataatgtcttccctgatttgggataatgtttaaaaatgggatatttaaaactatcaaaaataaaatgaaaggtcattatgaaactttaaaaaggggaactcaaggggaaattatcatctctttgtttttgctagattaatgaatgttctagaagtattgtttcatttatttgatttattttcgggtaagaattaaaaatcggcaatcatagcgattttgtgcatctgccttacgatattcatcaaattcaatttcccactcctcccaattcaattgagggaaaaaagtatcgccatctagttctgtttgaatttgagtaaggtataacttatctgctttgggtaaatattgtttgaataactcgcccccaccaatcaacataatttcatcaaaatctctgacaaaattgaccgcactttcaaagctatctttccatatcacaccttcgtgttcaaaaagctggcgagaaagtacgatattggtacgtttaggtagtggacgaccaatactttcaaaggttttacgccccataatgacaggtttaccagtggttttctgacgaaaccaagctaaatctgcaggcaagtgccaaggcatttgattatctttaccaatcacattatttaatgttatcgccacaattaaactaaatgtcatagatccccctaaaatttgccgttactatacctgatattaagtgatttttcattgatttagtgataacgttaatgtcaattttaagaacgttggaaaggactatgaacaaaaaaacaatcgttgtgaaattcggtactagcacgctaactcagggttcgccaaaattgaattcgccacatatgatggaaatcgttcgtcaaattgcacaactgcataatgatggatttcgtatagtaatcgtgacttctggtgctattgcagcgggtcgccattatttaaatcatcctcaattaccacccactattgcctcaaagcaactgcttgcagcggttggtcagagccaattaattcaggcttgggaaaaattatttgctatttatgatattcatatcgggcaacttttattaactcgtgctgatattgaagatcgcgaacgttttttaaatgcacgagatactttacatgcacttttagataaccacattattcctgtgattaatgaaaatgatgcggtggcgactgcggaaataaaagtaggagacaatgacaatttatctgcactagtcgctattcttgtgcaagcggaacaactttatttattgactgatcaacaaggtttatttgatagtgatccgcgtaaaaatcctgaagcaaaattaattccagttgtagaacaaatcactgatcacattcgatcaattgcaggaggaagtggtacaaatcttggcacaggtggaatgatgactaaaatcattgctgccgatgttgccactcgctctggaattgaaacaattattgcaccaggtaatcgtccaaatgtaattgcagatcttgcttatgaacaaaatattggtacaaaatttattgcacaccaatctgatcgattagaaagtcgcaaacaatggcttttcgccgcgccatcggcaggcattatcactattgatgatggagcgaaaaatgccattcttgaacaaaataaatctttattacccgctggtattattaacgtggaagggcgtttttcgcgtggtgaagtagtcaaaatatgcactcaatctggtaaagacattgtactaggtatgccacgctataacagcgatgctctacaattaattaagggcagaaaatcagcagatattgaaaatgttttaggctatgaatatggtgcggtggcaatgcatcgtgatgatatgattattttgtcataatgccctttggttgataaaagcactgatttatgaaacaatcttgagctatttttataggaaaaatgtaaggtaaaacgatagtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtttgttatatgtttctaaacattggttgcgttataaattgccaaagcgtttattgcgttatgatagcaagccgatgtgtattgggcagaaacaacgctggtttttgctacagcttgttggcgatgaaaaaaatatcaatatgaaaacgaccaaatcgccagaatttgatgggtggcgttgggtaagtttttggtatcctgttcgtcaagttgtgtcttttaagcgagatgtttatcgaaaggtaatgaaagagtttgcttcggtattatttacggataatccaccaatattttccgcatctcgtgaagcaaattcacagtctaattcggcaaataaaaaatattctcagacaaaatacacaaaacgccatttttacaaatcaaaaggtcaataatgttcacttttattcttctttgtttacttgttggtgcattagcgggttttcttgcaggattatttggtatcggcggagggttagtaattgtgccaaccttagtgtatttactgcccattgtagatgtaccagaatctttgttgatgtctaccgcacttggcacatcatttgctaccattgtgattactggcattggatcggcacaacgtcatcataaattaggtaacatagtctggcaggcagttcgcattttagctccggttattatgctttctgtctttatttgtggtttatttattggaagacttgatcgtgaaatttctgccaaaatttttgcttgcttagtggtatatttagccacaaaaatggtactttcgattaaaaaagatcaagtgacaacaaaaccacttaccccccttgcttccgtaattggcggtattttgattggtatggcatctagtgctgcgggaattggcggtggtggatttattgtgccgtttttaactgctcgtggcattaatatcaaacaagctatcggttcttccgcattttgtgggatgttattgggcgtatcagggatgtttagttttatagtgagtggttggggaaatccattaatgcctgaatattcgctcggttacatttatcttcccgcagtgttaggtattactgccacttcattttttacttccaaattaggcgcaagtgcaaccgctaaattgcctgtttcaaccttaaaaaaaggtttcgcccttttcttaattgtggttgcgatcaatatgtttctgaaataaggaaaattatgaattcaaattatttacttcttccccactttgatccgagtatttttacgcttggcgatagtaatatcggcttacgttggtatggtttgatgtaccttttaggttttgtttttgcacgttggcttgcggttcgccgtgctaatcgcccaaatagcggttggacagtagatcaagttgataccttacttttcaatggttttatgggggtgtttattggcggacgtgttggcgatgtatttttctataatctcgatcatttcttacaagaaccactttatttattccgcgtttgggaaggtggaatgtcgttccacggtggcttaattggtgtaattgttgctatgatttggacatcctattcacaaaaacgtaatttttggcaaacggctgattttgttgcgcctttgattccgtttggtttaggtttaggcagaattggtaatttcattaatcttgaactatggggacgcgaaacgaatgtgccttgggcaatgattttcccgaatgatcctcttttactgcctcgtcatccatcacaactttatgaagcctttttagaaggcctggtgttgtttgcgattctgaatatttttattaaaaagccacgtccaatggcttctgttgcaggtttattcttaattggttatggtgtcttccgttttattgtggaatatgtgcgtgaacctgaagttgaaaatttctttgggattattacacgagggcaagccctttgcttaccaatgattattggtggtgctttcattatggcttgggcttattcacgcaaaagtgcggtcataaaataggagatttttatgaagcaatatcttgatctttgtcgccgcattgttagtgaaggggagtgggttgctaatgaacgtacaggtaagcattgcctcacggtcattaatgcagatttagaatatgatgtggcgaataatcaatttccgctgattactacccgtaaaagttattggaaagcggccattgctgaatttctaggttatattcgtggatatgacaatgccgctgatttccgcgcacttggcacgaaaacttgggatgctaatgcgaatgtaaatgcagcttggcttgcaaatccgcatcgtagaggcgttgatgatatggggcgcgtatatggtgtgcaaggcagagcatggcgtaagcctaatggagaaaccatagatcagctacgtaaaattgttaataacttaacgaaaggtattgatgatagaggagagattttaactttttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaatggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataattaattctttatttttccttatatttgaaacttaaaatccaggattgatcgttatctcaaaccctgttacttgcggaaattcttcttgaattagtgttaataattcaatttgtttaaatagaatcccctgccgaacaatagcattagacacttcaataaaaattaaatgatctgttatgttgccaatacgaaatttgccgtgaaattcctgtggaaaaatgcggttaaatttttgattaagttcattgatggcaagaccttttttgattattttggcaaagggcgattgctcaagcacatccataatattgactgctttttgataacgatcagccttgttttccataaagtcagcccccagtaaatgacatcagtttagatttccgctacaatacacgcaattttcataataaacaatgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgattttttaccgcacttttttcatacctctacattagatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaactttacgtttctgcagctgcagcagcggttaaagaaggtcgtggtaacgaagctcaagttgctgaagaattagcagctgacgcagaataatttaagttttgcaataaggcgaagcccttaataatcaagcgattaattggcataggggctaaaatttagcccctatatttttatctaaaagtgcggtcaaaataaaccgcattttcgacagaggattttaaaaatggctgaaatcacagcatcattagtaaaagaacttcgtgaccgtactggcgcaggtatgatggaatgtaaaaaagcattagttgaagcaaacggtgatattgagttagcaatcgacaatatgcgtaaatctggtcaagctaaagcagctaaaaaagcaggccgtgttgcagctgaaggtgttatccttgctcgtgtagaaaatggtttcggtgtattagttgaaatgaactgtgaaactgacttcgtagcaaaagatgcaggtttcttaggtttagcaaacgaagtagctgatttcgcagcagcaaacaaaggtaccactatcgaagcattacaagcgcaatttgaagaaaaacgtgctgcattagttgctaaaatcggtgagaacatgaatattcgtcgtgttgcttacctagatggtcaagtaattgcacaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaacgcgtaattctttaaagataacgatatgttaataagcccaacttaagttgggcttatttgttttataggataagctgcttaattaacgggcttaaacttttttagttacgtttagtaaaataaaaaatccacactttaatagtaaacttttaaagtgtggattttgtaataaaacctcagaagaaattaagaaattttcttttctaacgcttttaaacgtttatttattccatcaatacctaacgttagtgctgctgttttacgccattctttattcgtttgcaatggaataccagaggaatatacgccaggctctgtaattgggcgcataaccattcccattccagtaatggttactttatcgcaaatttccatatgaccattaatcacacttgcaccaccaattaagcaatagcgaccaacagttaagctacctgccataataacgccacccgcaaccgctgtaccagtgccaatatgaacattatgtgcaatttgacaaaggttatcgataataacgttatcttcaataatcgtggcatctaatgcgcctctatcaatacaggtattcgcaccaatctcaacgttattaccaattattacttgccctacttgtggaattttaatccaacgaccacgatcatttgcataaccaaaaccatcactaccgataactgttcctgattgaattaagcaattagctccaatctcaacgttatggtaaacagtgacattagcccagagctgagtgcctgaacctatcttagtatttttaccaacaaagcaatttgcaccaatgatcacgttatcacctagtacaacaccttcttcaatcactgcgttcgcaccaatagatacattttcgcccaataaaacaccatcaaaaatgaccgcactttttgcgattccttgtgccgcttttggcgtgctatccatatattgcgctaaaattgcgtaagccacataaggatctttaacaataagtagattgctttctggagaacagtgttcaacatcctcttcagagacaaccaaaatccctgctttagaatctttcaataatgcacgaaattttacgttagaaataaaagtgagttgatttgattgggctttatcgagaggcgcgatattctcaacaacaacatcggcgttaccgcgaacggtagcgccgatttgagttgccaattcttgtaaagaataggatttttgcattatgagaacctattattttttctcttgtgctttttcagaagcagggatagattttaatacttcttcagtaatatctttaccctctaccgcaaatacaactgaatttgcatcaagcacataagtataaccttttgcttttgctaaattatttgtcgcagtttgaatgctatctaataatttaccacgttcttcagcttgacgtttttcattttgagcttggaattcttgaacttttttatcttgttcttgcattagtttttgtaattcagcatcttcagccgcacctaatttattaatttcctgttggcgtttttgaatatcagcttgacgtaagcgaggtgcatctttttctaaagccgcaacttttgcttctacttttttacgagcagcagcaattttatcatcaacttcttttttgcttgctgctaatttctcagctacaggtttaaattcagcatcaagtttatctgctactgcttggcgatctgggtgatgttgaaaaatataacctgcattaatgaaagcaattttttcttcagcggaagcatagcctgaagcaagtgcaatacctaaagcaagtgcggttacttttgcgatgtttttcatttgataaatatccttaattaaatgatgggtttaatattttctctgcccaattaaattaggcagagaacgttgtttttgagttctgatgaagaaaaaagttcaatttattagaaagaacctccaatactaaattggaactgttcgacatcatcattttcatattttttaattggtttggcataagagaataccaatggcccaataggagattgccattggaatccgacacctgtagaggcgcgaatacggcttgatttgccataatcgggtaagctttttaatacattgttatctaacccactcttatccgatttccacttagtattccaaacacttgccgcatcaacaaatagggaagttcggaccgtattttggctcttatcgctcacaaacggtgttggtacaataagttctgcactcgcagttgtgattgcattaccaccaatcacatcagaacttatcttattaaaagtaccattactattactattactattaccattttgagcggcataaattgcgttaggtccaatactaccataagcaaaaccacgtaatgaaccgatgccacccgctgtataagtttgatagaacggtaaacgcttgtttccaaaaccatttgcatatcctgcagatgcttttgcagatacaacccagaggtgatctctgtctaatgggtagaaaccctgtacatctgcacttagtttgtagtatttgttatcagaacctggaatagtaactcgtccaccaagacttgctttaacccctttagttgggaaatagcctctattaaggctgttatagttccaaccaaaagaaaaatcaaagtcatttgttttaatgccattacctttaaatttcattgattgaatatataaattacggttatattctagagcaaagttactaattttattataggtatggcctaatcctacataataggagttattttcatttacagggaaacctaaagtaacattacttccataagtcgtacgcttatagttagaggatgtatcacttttagagttatcgtagttttcaaagaaaacatttccaccaagacttacaccatctttagtaaaatagggctcggtataacccaaattgacactcgtaccataatcatttttcgtaccagctatacttactgcagcccctgttcctaagaaattatcttgtttaacacttgcttgataactaataccactctctgtaccgtaaccaataccaaagttgatactacccgtgttacgttctttgactttatatacgacatccacttcatcattgctaccattgataggatcaattcggttttcgactgtttcgaagaaacctgtacgatctaagcgaatttttcctaactcaactaattgtgaattataccaagttccttcttgttggcgcatttcctgacgtaaagtgctatcagcagaaacggtatttccttcaaagcgaagttggcgaacagttaaacgtcgtccagcatcaacaacaagggttatcgctaatgttttatttgcatcatcaaaatcaggtactgaatttaccgttgcgctaccgtaaccgcgttctccaagttttgctttaattgcattttctacatctgcaatatcactacggcggaaagtatcatttaaatgtaatgctgaaagtaaaggttcaagctcggcagacatacctcccagattacctataatgcgtgcactacgaaggtcatactgtaaaccttcatttacatcaatgtgtaacattaacttttgttttttcatcatttagctgaacatccgttttagtaatttgtgctttggcatagccattatttaaataataatcacgaattgactgcaaatctttctcgaattgcgcaccttcaaatttatttccccataatttccaccaagaatcaggttgtaattccatttgttcttgtaatgtactgctactaacagattcgttccccttgaaagttaatgatgccaattttgctttatcatcttcattgatttgaattaaaatttcagcgcgattatttggtagcgtattgacaataggttcaacggttgcgttatagcgacctacacttgcatagtgttcttttacacttttggcaaattcatttaatttttctcgaattaaaacatcgccaactttaaacccgttagcatctaagttttgttttagtgcttcagtgggaataatagagttacctttgattttaacatctgaaatgatcgatttagccacaacgctaacaacaagcacatcgccttcttgatgcgctttcacatcatcgaatcgaccacttacgaataaagagcggacaatattagccacatcattgtcagtcacacgctgaccggcacgaacaggtaaacttgctcggatttgttgttttaagtcaccttgaacaccatccacacgaatatcttttgccacaaaaggtgcggcaaacacagtcgttgtcgtaccgaataataaacttgcgattagaagttttttcatcgattgtatcctatataaattatagacgtaaaaaatcattaaataatgcaaacaccgttaagcttaataacagtgctgcgccaattcgataacagatgctttgcacccgctcagaaacaggttttcctttaacagcttccattgttaaaaaaactaaatgaccgccatctaatactggtaatggaaataaattcataatccctaaatttacactaatcaatgccataaaacttaaaaaatacaccaatccaatatttgctgatgcaccagcaccttttgcaatagaaattggcccacttaaattatttaatgacaaatcgccagtaagtaatttccctaatattttcaaggttaaaagggaaagctgccctgttttttcaatgcctttttgtaaagattcaagaataccatattttaattcagtacggtattcatccgctaattttgtcaaggttgggctaaccccaacaaaccatttgccattttgattacgcactggagttaggactttgtcaaatgtttctccattacgttcaactttaatagaaaaagattcgccttgttcgacctgttttataaaatcttgccaaggaagtgcggttaaattttcttttaaaattttatcaccgatttgtaaaccagctttctcagcgggagaattttgaacaactttagaaagcaccatttcaattttagggcgcataggcataatccctaatgcctcaaaagcactttctttttcaggatcgaatatccaatttgtaagatttaaagtccgttgttgttcaatattagaattgaaaggagaaagggtaatttcaacattaggctcacccatttttgtggcaagtagcatattgatggtttcccaatcttgagtttcttcgccatcaaccgctagaatttgtgtattaggttcaatgtgagcttgtgctgcgatggaacttggtgttattgattgaatcactggtttaaccgttggcattccataaaggtagatgatccaataagcaaaaattgcaaaaataaaattagctaaagggcctgcaataattacaaatgcgcgttgtaatacgcttttactgtcaaatgcttgtgatttttgctcagcaggaactacttcattacgtccatcaagcatttttacatagccgcctaaaggaatcattgaaaccgcaaattctgtaccatatttgtcaatgcgtttccaaattacttttccaaaaccaatggaaaaacgatggacttttataccgcactttctcgctgcccaaaagtgaccatattcgtgaacggatactaatacagcaatcgcaatgataaaagaacctagtgaccacaaaaatgacattaaaaatccttataagacaaagaaatagaaatagctgaaaaaaggtactgcggcagtcaagctatcaatgcgatctaacacaccgccgtgaccaggaatcaattggctactgtctttaactcctgactcacgtttaaacatactttcagttaaatcgcccaatactgaaattgcaactgtcgctacagaaagaatgataaatccagtaatatttcgatcgcctactaaagtattgttagagaaatgaataaagataaaagaaagcactaatgctgtaattaatccaccaatgaccccttcccaacttttacctggcgatactttaggggcaagtttacgtttgccaaaggcgcgtccgctaaaataagcaccagaatcagccgcccaaacaagtataaatacgtaaagtaataaaaataagccgtgataaggatcatgggtatagtgttctaaacgtaaacgtaatacacctgcgacaaatggaatcaacgtagaaaaggcaaataaaagttgtaaaagtggatttttagaccaaaatttagctgatttaggataactgatcacaagcaacaaagctaaaccccaccagctaacagcatttatcaataaaagctgaagatgttgttcaaacacacgccctgcatctaaatagttgccctcagtatagagccataagaagataaatacgcctaaaaaggtagccacaaaaaaacgtatcaaaggttgtttaaggcgagcaaattgagtccattcccaaatgcctaaaatcgctaccgcccctaaagcgagggcaaaataaaaaggcgtgaataaaaatagcgcacataaaactgcagcaattaacacaatagcagataaaactcgttgtttaagcataattttaatccgtttaactattcagtcccgccaaaacggcgatgacgttgttgataacttgcaatcgcgtgattaaattctaattgattaaaatcaggccaaagcacatcggaaaaatataattccgcataggcaatttgccataataaaaagttgcttatgcgctgttctccactggtgcgaattaataaatccacaggtggtgcattttgggttgcaagatgatgttgaaaagtcgagttattaatatctgaaactgacatttcttcttttttaactttttctgcaatttgtttagcggcttgaataatatcccaacaaccgccgtaatttgccgcaatattgagtgtaagtgcggtatttttttctgttaaattttccgcttttttgattttttcttgtaaagtttcactaaaacgagatacatcgcctataattttcagacaaatattatttttatgtaattttttcacttcgcgatccaaggcttgcataaaaagcgacattaacgcgctgatttcttgttctgggcgactccaattttcgctactaaaggcataaagtgtgagtacttccacaccgatttgtcgtgcataagccactgctttgcgtaccgcagtaacgccattggcgtgtccgaaaattcgcattttatttttctgttttgcccaacggccattaccatccataataatggcaacgtgttttggtatatttgtttgatccaactctatcattatttttattattgagagacctctataaatttggtggtaaactatatcataagttatattggcttgccatggattcctttgttctaatctgttctgtaaaaattgaaaatttattgtaaaaaacaactaaaaaaccaccgcactttttatttctctccctattaatttttgccattttacggtattctatgccacattttctattgtcaaaatgctgcaaaagtgcggttaaaatttaaggtgattttatgcaagaacaatatcgccccgatatgatcgaaccaaaggttcaacaatattgggcagaaaataaagttttcaaagcaatcaaagacgaatctaaagaaaaatattactgtctttctatgttcccatatccttctggtcgcctgcatatggggcacgtgcgtaactacactattggtgatgtcatttctcgttatcaacgcatgctaggcaaaaacgtattgcaaccatttggttgggatgctttcggcttacctgcggaaggggcagcaattaaaaataaaaccgcaccagcaaaatggacttacgaaaatatcgcctacatgaagaaacaacttcaacttttaggctttggttttgactgggatcgtgaaatcgcaacctgtaaaccagaatactacaaatgggaacaatggttcttcactgagctttacaaaaaaggcttagtgtacaaaaaaacctcaaccgtaaactggtgtccgaatgatgaaacagtactcgcaaacgagcaagtacacgaaggttgttgctggcgttgtgatacaccagtggaacaaaaagaaatcccacaatggtttatcaaaattactgactatgccgagcaattattaggtggtttagatgcccttccacaatggcctgacatggtaaaaaccatgcaacgtaactggattggtcgctctgaaggggtagaaattacctttgatgttgcaaataccaacgaaaaagtagcagtttacaccacgcgtccagataccttttacggcgtgagttatttaggcattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggcttatttgctattcatccattgacgggcgaaaaattaccgatttgggtcgctaatttcgtgttaatgcactacggtactggcgcagtaatggcagttcctgctcacgaccaacgtgactttgaatttgctcaaaaatacagtttacaaatcaagcaagttattgaacccattgcagatgaagaaattgatttaactaaacaagctttcgttgagcacggtaaattagtgaactcagctgaatttgatggtaaagactttgatggtgcattcaacggtatcgcggataaattagaaaaattaggtgttggaaaacgtcaagttaattaccgtttacgtgactggggcgtttctcgccaacgttattggggtgcgccaattccgatgctaacccttgaaaatggcgatgtagtacctgcaccaatggaagatttacctattattctgcctgaagatgtggtaatggatggcgtaaaaaacccaattaaagcagatcctaactgggcaaaaacaacccttaacggcgcaccagcgttaaaagaaacggatacctttgatacctttatggaatcctcttggtattacgcgcgctacacttgtccacaatatcaaaatggcatgcttgatgcggaagaagcaaactattggttaccagtggatcaatatatcggtggtattgaacacgcaacaatgcacttactctacttccgcttcttccacaaattattgcgtgatgcaggatttgtaaccagtgacgaaccagccgataaattattatgtcaaggtatggtgcttgcagatgccttctactacacaagtccaaccaatgagcgtatttgggtaagtccaacactggtgactcttgaacgtgatgaaaaaggcagaattattaaagccaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatctggcgtagaaggggcgaaacgtttcttagggcgtgtttggaatttggtatatcaatatcaacaaaatccagcaaaaactagcctagatatcaccgcactttccgcagaacaaaaagtgcttcgtcgtgaagttcataaaaccattgcgaaagtgagcgatgatattggtcgtcgtcaaacatttaatactgcgattgctgcagtgatggaattgatgaataaactgactaaggcatcgcttgatagcgagcaagatcgtgcagttatggcggaggcattaagtgcagttgttcgtatgctttatccaattacgccacatatctgttttgaattatggcaagctcttggcaatgaaagtgctattgatactgcagaatgggtaaaagccgatgaagccgcaatggtagaagatgaaaaactgattgttgtgcaagtaaatggcaaggttcgtggcaaagttactgttgcggcagatgcagatgaagacacagtcaaaacgattgcttttgcggatgaaaatgtgaagaaatttattgataatcaacacattgtcaaagtgatttatgtcgtaggtaaattattaaacgtggtagtgaaaccataatacatagggtgtgtggatttaaaattcacgcaccattttttataggtatgtgaaatatttacattttacacgtcctacaataaaggtaatttttatgatcaactcaatcaagactttactgcttatcgcaacattagcaattctttctgcttgcggttggcattttcagcagtcggttactatgccaaatgaatggcgaacattagcccttgaaagtgatgactcttataatgattttactgttattatgcgtcgcaaattgcaggaaaatcaggttaatgtcgtcaatttagaacaaaatattcccattttacgtattaataaacagattacttcagatcaagttgcgtctatttttaagcacggacgtgaggcagaaaaacttttaatgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaataatgaaccgcatttttccagagcaactaaatcatcatcttgcgcaaagcttggctagagtttatctcttgcaagggcaagatcctttattacttagtgaaactgaggatacactttgtcaagtggcaaaccagcaaggttttgatgaaaaaaatactattcaggttgatagccaaactgattgggcgcaacttatagaatcttgtcaatctatagggttgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaattgtcaaacaccgacggtagaaaacttaccacgttgggtaaaaaatcgtaccaaagcaatgggattagacgctgacaatgaagcaattcagcaactttgttatagttatgaaaataacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttgtagtcacaaggcaaataaaatagacaatattgaaataagatttttgataaaaaagaaattttttgctggaaaaatggtcccccctaccggacttgaaccagtgaccaagcgattatgagtcgcctgctctaaccgactgagctaaggggggagagtgcggtaattatagagaaataatcacttgaagtctataaaagaagggatgattgacgaaaaatcaaccatccctttttacattattgaagcactgaaatatcagctacttgtaagaataacccttgtaacgtatttaaaatcgctaatcggttttggcgtagtgctggatcttcagcatttaccatcacgttatcaaagaaactgtctactggcgcacgtaagtttgctaatttatccaatactgcggtgtaatcgccttgtgcgataagcggttgtacttcagtgcgtaatgccagtaccgcttcagcaagggctttttctgctggctctacgcaagcggttaaattgatctcgccaattgccgcacctgctttcgctaagatgttgctaacacgtttatttgctgctgctaacgcttccgctgaatctaaagtacggaagtgtgaaaccgcacgcacgcgcgcatcaaaatcagcagggcgagttggacgacgtgccaataccgcttgaattacatccaccgcaatgccttcatcttgataccatgcacggaaacgaccgagcatgaagtctactacctcatcaaggattttttgttttggaactaaatcatcaccacgtgtaaagaatgaaacataaccttctgggtattcactaaatccacctcttgttttggcaataggtgcattacgtagtctttcgttatcaagttctttatataaatcaaatgctttgctaataatgtcattcagatcaagaggcaaatttttctcaacgataatacgtaatgcacctaatgccgcacgacgtaatgcaaatgggtctgcgctaccttttggtgcttggccgatgccgaagatacccgttaaggtgtcaaatttatccgctaaagcgaccgcacttgccactaaagacttaggtaattcatcacccgcaaagcgtggcatatattgttcgtttaacgccactgccacttcttcatcttcaccgtcgtgacgagcataatgcatacccattacgccttgcgtatcagtgaattcgaataccatgttggtcatcaaatcacattttgacagtaaacccgcacgttttgctttcgcttcatctgcgccgatttgttttgcaatttcgcctgcaagttgttcaatgcggtcagttttgtctttcaatgtgccaagttgttgttggaacaacacggtttctaaacgtggtaaacgatcaaccagtttttgttttaagtcggttttgaagaagaattccgcatcggttaaacgtggacgaaccactttttcgttcccttcgataatcgcggttggatcttctgggttgatgttcgagacaaagataaagtgcggtaataatctgccgtctttatcataaatcgggaaatatttttggtctcctttcatggtgtaaaccaaggcttccgcaggcaccgctaagaagcgttcttcaaattttgccgctaaaacatttggatattccaccaaggaagtgacttcttcaagcaggctttcttcaatgtcagccacgccaccaagtgcggtcgcttttgcttgagattttgccaaaatttctgctttacgctcattgaaatctgccaccacagaacctttatcacgcaataattgcggatattggtctgcatgttgaatgtcaaattctttctcgcctaagaagcggtgaccgcgaatggtgcgagcacttgccacacctaaaatttcgccttcgattaactcatcacctaacaacatagtcacagtgtgaactgggcggataaattgcacggttttatctgcccaacgcattggttttggaattggcaatttcgctaacgcatttgccacaatatcgttaagtaagtttttggtcggctgacctttaatttttgtacggtgaacgagccattcgcctttatcagttgcaatgcgttctgcttgctcaacagtaatgccacaaccacgcgcccagccttctgccgctttagttggtttaccttccgcatcaaaggcggctgatactgcaggccctcgtttttcgatttctttgctcggttgttgggttgctaagttcaacacttttacggctaaacgacgcggtgccgcaaaccattcgattttatcgaatgataaacctgcttgattcaattccgcctcaacgttatccgcaaaagaggtcgctaatgttttgagagcttttggtggcagctcttctgtgccgatttctacaaggaagttttgggttgtcattttgttttctctggtaaggtgcaacttgctgcattgattacttatttacattttatctatcacatcattaatattttcaataatatattcatgattttctaaaatccaaagaagagatttaattcttgtctgattatcatacttattagttgtgaatttaccataaaagttaccttcattatcaacaatcactggcccacttgtagaatacttattccaaggactttcactgttatacttagagccataagttccgtatttattccaaatactatcgctattatatttagagccgaattcaccatatttattccaaattgatgagttatcatgtttactacagttcaaacagcctaaaaatttatcatgattatctccaccaaaaagcaaatatgctggtgctgcaaaggtatttattgataaaaataataatgggggtaacaaaaatttctgtaatgtcatagcattttccttagattaatataattgattcaatgtggagtgagaattttaatagctcacacacgatttaattgttttcttcgtttaacttctgccacaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataggcttccgccacgcctttggttaaggcacgaatgcgtaaaatatagcgctggcgttcggtgaccgaaattgctttacgcgcatctaataagttaaagctgtgtgctgctttcaaaatacgttcataagctggcaatggtaacggtttttctaaggctaataactcttgtgcttctttttcgtattgatcgaagcagtagaataagaaatcggtgtttgcgtgttcaaagttataggttgattgctcaacttcattttgatggaaaacatcgccataagtggttttgcctaatggaccgtcagaccaaactaagtcatacacagaatctacgccttgaatgtacatcgctaaacgctctaaaccgtaagtcacttcacctgttacgggtttacattctaagccacccacttgttggaaataggtaaactgggttacttccataccgtttagccatacttcccaacccaagccccatgcacctaatgttgggttttcccagttatcttccacgaaacggatgtcgttttgtgttggatcgaaaccgagcatttcaagcgagcctaaataaagttcttgaatattatctggagaaggtttgatcactacttggaattgatagtagtgttgtaaacggtttgggttttcaccgtagcgaccgtccgttgggcggcgtgaaggttgaacataagcaaatgccattggctctgggcctaatgcgcgcaatgcggtcattgggtgagaagtacctgcgcccacttccatatcaaaaggttgcacaatggtgcagccttggtttgcccaatattcttgcagggctaaaatcataccttggaatgtttttacgttaaattttgtactcataatcgttgatctaatgtgattaaaaatgttggtattatacttgaatccgtaaaagggataaaggcgaaaaatgcggttgaaaatcaggctttataaagatatcaagtaagtaatttggaatatttaggtagattttaagtttttttaattatagttttttttgattaatttaatagatttcgattgtttaaacctttctatatgatacgcaagaaattcatttcaacctaactaaatttattaacttcacaaggagtctacaatgagttctcaatgtcctttctcgcacttagctgcaacaaacttaacaatgggtaacggtgcacccgttgctgataaccaaaacagcttaacagctggtccgcgtggtccattacttgcacaagatttatggcttaatgaaaaattagctgatttcgtacgtgaagtgatcccagagcgtcgtatgcacgctaaaggttctggtgcatttggtacttttactgtcacacacgatattactaaatatactcgtgcaaaaatttttagtgaagtgggtaaaaaaacggaaatgttcgcacgttttactaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccatacacaacaaggcatcaaaaacttaactgatgcagaagcggctgcagtcatcgcaagtgatcgtgaaagccatcaacgtgatttatatgaagcgattgaacgtggtgatttccctaaatggacattatttgtacaaattatgccagaagcagatgcggaaaaagtgccttaccacccgttcgacctaaccaaagtgtggccgaaaaaagattatccgttaattgaagtcggcgagtttgaattaaaccgtaacccagaaaacttcttcgctgatgtagaacaatctgcatttgcaccaagtaacttggttccgggtattggcgcaagccctgacagaatgttacaagctcgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagatcaaaaacaatcattattcaacaacacggcagcagcaatgggcgatgcgcctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataatctttcgagttaattattttaaataaataatagtagtaatgaatctgcacccaaaagttaggctaaggtttaactgattagggtgcagatttttttcaatgaaatattactaattcattacataatacttgaacgattttgtaatcgttcaaaaatttgaatgtaaaaataacctataatagcttccattttttatggtaaatattgtatttaagtaatgctaaatatatatcatggcacaaaataatgaggtataaaatggctatcattccccgtcactgcagtaaaatcttcgcgtaatcccataccgcaagccacatcccccacaacccaagagccgataattggatacattccatcaaaacttggcaattcaaatttttgttgataaacataacctgaattagcataaaacgttgagtgttcgcttcctttcgctgcaaattctacaccattatttttctcataatagaaaacattggcaccttctcgacctaacaatggttttttcacccacatcaataaatcttttggtaattcaaaaggcgtaaaataagcaggcaataaattcggatgattaggataacgcgcccaaagttttgccaatagtgctttattacttaacaacattttccacgctggttcaataaatcgtgtttcagccgttgtaatatggcgagcaaactcagcgtggcttagccattctagcggatacaatttaaataacatttcaataggttgatcatttaaatctacaaatttttttgtttcgctgttatagccaatatcttccaccgctaattgatgaatattccaacctgcgttataagccacatcagctaaataatccacattgccccaatcttcacggccagcatcctgcatggcactcaaatggaaatctgttttgccactttgttgtttcaaaaattggaaatgttttattaattcttcatgaatccagttaaattgatcacgatgtttcaagccctcaatttgctccaaccactgccattggacaatcgctgcctccaacaaagatgttggtgtatcggcgttatattcaaacatttttaggttgttgccatcatagccaaaatcaaagcgtccatataaataaggatcttgattacgccaagaggtttcaacaagctgtttttgcaactccgtaaaatgataattttcataatcgccttttttaatttcatccgccgcaaaatctaaacatattgaatgcaattcattagttgtatcctcaatgcgatcaatttccgctaaggtaaattcataggcaacattatcagaccaataatgagatccatcactggaaggcaagttataataatcaaatccaacattaagtagctgttgcaccatatttggtcgagtaggaaacccagttacacgtttcatttagcccccactgctacgatgagtattatttgggctactaaaaccaccacgagatacaggtttgctattcatgcttcctgcatttcctttcacgagcattggttttccaacagaacgattcgtttgaggttgcacaacttgccctgttggtgtggtgacagctcgatttccaggatgatagcttgggccaaggaaactactaattgcacgagccgccatataccctataacgccaccagcaattgcggctcctaaagaaggatcggtactttcagcttttgcagttgattcagcattgttctcgctttgattagcttgtacattattttcagctggattttttaccgcactttctgcattaccattatcacgaatatttaaaccaagcccctgctgtggtgtagtttcagttttctgagtactttcagtatttttatctgcctcacaaagctcaatttttttccaatccgctaaacaatcgtctaaagactgatacacatcacgttgtacttgctcttctgaacagcctcctaataaggccacaatagataaactaactaaaatctgatttttctttttcattgttctcaatttttatcgaatggttttcacgcctagccattgctcagcctgtttattagtaatttcttcacgagtccacatactcattaaatctggttgtggatatttattgctgttatagccgactaaacgggcaaaatcaaatacagcatgaggatagccattaataagcaacaaggctaaataaccactctcatcccaacaaatttcaagtttgcgtgcttcatgatgattagaggttgaatcaacattatacacgtgcaacatatccactatcggttgagcattttgacgcatatcgagcgcataaaaatagccagtttcgccgtcatcttcaaacattacggcaaaatgctcaaatactgtcgaatgtgttcccacttgctttggcgttcctaaaaagagttcgtcctctaaagttaaatgtaacattctctttcctttaaatattagatataaaaacaccgcacttttatacaaagtgcggtgagattttacagtaaattcagcgtgaattacgcttgacctttaaccgcttttaagcctgggaatgctgctggagtaccagcgcgttctaatgcttcttcgatacggattaattggttgtatttcgcaatacggtcagaacggctcatagaaccagttttgatttgacctgctgctgtacccaccgctaaatcagcgatagttgcatcttcagtttcgcctgaacggtgagagattacagcggtgtaacctgcatctttcgccattttaattgctgctaaagtttcagttaaagaaccgatttgattgaatttgattaagatagagtttgcgatacctttttcgataccttcttttaagattttggtgttagttacgaataaatcatcgcccactaattgaacacggtcgcctaacactttagtttggtatgcaaaaccttcccagtcagattcatcttgaccatcttcgatagacacgattgggtattgtttagttaattcttcaagatagtgtgtgaactcttgagaagtgaatgatttaccttcacctttcatttcgtacataccattttctttgttatagaactcagaagatgcgcagtccatcgctaaagtaacgtctttacctaatacataacctgctttttctactgcttctttgatacaggctaaagcgtctgcgttagaggctaagtttggtgcgaaaccaccttcgtcaccaactgcagtgctcatgcctttagattttaatacttttgcaaggttgtggaatacttcagcaccgatacgaagtgcttcacgtaatgttttcgcaccaactggttgaatcatgaattcttggatatcaacgttgttatctgcatgttcgccaccgttaatgatgttcatcattggtaatggcatagaataaacaccagcagtgccatttaattctgcaatgtaagcgtaaagtggtaaacctttagatgctgcagctgcttttgcgtttgctaaagataccgccaagattgcatttgcaccaaagttagatttgttttcggttccgtctaaatcgatcatgatttggtcgatttcagcttggtttgttgcatctttaccaacgatagcttgtgcaatttcgttgttcactgccgccacagcttttaatacgcctttacctaagaaacgagatttgtcgccgtcacgtaattctaatgcttcacgagaaccagttgatgcaccagatggagctgctgctaaaccaacaaaaccaccttcaagatgaacttcagcttcaacagttggattaccgcgtgagtcgatgatttcgcgaccaatcactttaacgatttttgccatttttattttcctcaattaagttaattaaaacgggttaggcgagcctaaaacaggcgatatgataaagctattttgagattttgtcttgtaaaaaatgcgtatgctttgatctttatctatttattgtcttgagatacttagagcgcaggcataagccgagctccacgcccactggaagttataaccaccgagccagcccgtcacatccaatacttcaccaataaaatataaaccgctgacttggttgctttccattgttttagaagaaattactttagtatccaccccacccattgtgacttcagctgtacgatagccctctgtgccatttggagtaaattcccagtgatgaataaaatccaccagattttttacccgcactttgctgatgttagcgctaacttcatcttgcacaatgccttgttcaatccaaagttcgaccaattttttcggcaataatcgaaccaagatggttttcaacatttgttttggtgaatgttgttttgcttgattaatttcctcttccacattgtggttcggtaataaatcgatttccactgactcagtgggctgccaataattagaaatttgtaacaccgcagggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagataatgagctggcgtaacctctaaattggtgaaattacaaaacccaccgcccgacatcaaaatcttacgtccgatttttttgccgttgtcgaaaactgttaccgacttgcctagcttagccaattgtgcggcacaaaataatcctgccgcacccgcaccaataataatattttcagaatattggctcacggattttgtcctttttcaccacgttgtaaaaaatccaacatcttcattcgttgaataactgaacgacgatccactgccgcattacctgaatctaataactgctgtaaatacataccggcttgttgatattggcgattttctaaggcaattgtcgccaacaaagaaagactagatacttcatttttatcttttgccaaagcttcattcaaaagttgctcgacttttggggtcacttgctgacctgcttgataataaagtgcggtggctgccaagcctaaaatattaggtttacttcccgacaatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctagaattaaaagggcgactggcaataaccataacaacgccgtattccatttgaatggcggtttgtaattcacaaaatcaccaaatctagccgtcattttatcgataatttgctgattgcttttgccctcatccaccattttgtacacttcaagacgcaagtcataagcaattggagaattagattccaccaaattttggttttgacattgtgggcagcgtaaagattttgccaactctacggcacgagtacgatcatcttgattttggaattgataggtatccaccatttccgcttgagtaaacaaggaaaatgcgaataaaagtgcggttgcaaaaacaaatgttttttgaactcgagtaaaaatatctaataggcttttcatttattcttcaatgcttcaatttttggcaaaaataccgtttgccaagtttctttatccaataaaccagaatggcgataacgaatcacaccattttcatccacaagataagtttctggcgcaccatccacgcctaatttgagggcaagttctccctgactatcatcaatagttaagatgaacggattgcccattctcttaagtatttcaataccattttgcggattgtcgcgataatctacacccacaataggcaacgtttttgcaatctcaattaacaacggatgttcttctttgcaataaccacaccaactgccccacacatttaataaaaatggctgtttaggaaaatctttcgggcttacgatttgtgatggatcatgtaaattagcctgataaaactctggaacgggtttatcaattaaagccgacgcaatttttttcggatcttgatttaacccagcaattaataatacacacacgcctaaaagcacaaagagcggtgcaaaaaagagaagttttttgttcattatttttcctgttttctgcgtaatccgaagacgctaaaaagtgcgccaaaggccattaaaataccgcccgcccaaagccaacgaatcagtggtttataatgtaagcggaaagtaaattcccctttgccgagagaatcgcccatcacaatatataaatcgccccaaaaaccgccattaagccccacttcactcattgtcattgtacgaacatcgtaataacggcgttcggggataatttctgcataaggtttaccattttcagttacgtcaaaaaaggcgacttctgccgtaaagtttggtccgatttcattagaaaattggcgatagtgaaattcatattgtcccagcgtttgactttgttgcggtgctaaacgcacaccaatttcactgccaaaataaccactcattaccgcaccaatagttacaatcgccacgccacaatgcgctaaaatcataccaaattgagacaaacgaatttgtcgccaattttgccataaagtgaccaacaaaagccaaatcgcaagagttaataacacaaaagcgaaagcgtgaaaattcaacgcagaattatggcgtagctgttgccaaatcattaggcctgcaagaattaaagacggaataagcaaccacccacaacgtatcaataatgtgcgatcaaattgccccttacgtatgctaagcacaattaccattaggattaaaatcgccgtaataatggggaagaaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaggcgtgcacagaagtgagcgcgccagaacgaacaataaacgtgcctaatacgctaaaggcaaaagcaagcagagaaaaaagcgttgtccaataactaaatacgccttgtttttccgtcgccattaaactgtgtaataacgctaacccaagcaaccaaggcattaaagacgcattttctacgggatcccagaaccaccaaccgccccagccaagttcgtaatatgcccaccaagcaccaagcacaatgccaatggttaaaaacaaccaagaaaccaacacccatccacgcattgagcgggcaatttgtcgtgcagattggttataaatcaacgcactcaaactcattgcaaaatttaccgcaaagcccacatagccaacatataataaaggcggatggaaaattaatcccacatcttgcaacattggattgagatcgcgcccttctgcgggagcagggaaaatgcgtccaaatggattggaataaaataaaataaacaccgcaaaaccaaagcaaatcaatcccaataaagataaagattgagcggaaaaagtgcggtcattttttcgattaaaaaaagcaaaagcagcaagccataaactcaatgaaaataaccaaaacaacattgaaccttcatgtcctccccaagtggcagccactttaaaaaatgtaggtaattgagagttggaatgtgccgctacatattcaagggtgaaatcatccaccgcaaaagaataagtaagcaaaccaattgagaacgtcgtcgcaagggtaaaaatataactaagcggccaagcagcattaattaaagtcgaattttttttgaacaacccaaattgaggcactaacgcaagaaaaaacgcgctagctgttgcgagtaaaagaaggaaaaagccaagttctggaagcataatgtcgtcgtttttttcgttgatgcgcagataaagtcgctaatcaagtatgtttcattaataaaattaaaaatagcaccttgataggtgctattgtgcttataaaaattaatgattaaattcagcacctaaacaagggcgaattttatttaacatttctttaattacgcgtgatggtgcagcaatgatattgccactgcgtaagtagccgttaccagcatcaaaatcgcaaactaaaccacctgcttcacgcacgattaaatcgccagcagcacaatcccatgcttttaagcccatttcaaaataaccatcaatacggtttgacgccacatagcataaatctaatgcggcagaacccgtacgacggaaatcagcggcatcttcaattaaggcattcatcattgcaaattgagctggcattaattttggttgtttgaatggaaaaccagtggctaaaattgaaccttgaagttcacgtttactatctacacgtaaacgtacttcatttaattttgcaccttcgccacgcacagcagtaaataattcattgcggattggatcgtaaacaaccccgacttcagtgcgattttttacacgaactgcgatagacacagaaaagtggggaagccctgtcataaaattacgagtaccatctagcggatcaataatccattgtacatcgctatctttgccttctttgccttcaattgcgcctgtttcttccgtaataattgtgtgatcaggataagatttacgaataatttcaatgatttctgcttctgccgctttatcaacgtttgttacataatcattaatacctttttgtgtgctttcgatagcatcacggcgttcataatttttagcaatcacattacccgcttttcgtgccgcacgaatagcgatatttaacattggattcatatttccaccagattttaaagaacagaaaaattccgcaccattatagcgagatttgccaaaataaccagttgaaaatcataaaacaatggtttttatagattttcagaaaaactttgcgatatagatcgcaaaaatcacatcaagtgatttttctacccattatttatggttaaagtgcggtagaaaattggagcgttttatgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaattaatgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaatgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaataaaggaatgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcagtaaaatggcgttgttttttctaggttaaatcatcaaaaggtcgccattgtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgcgcagagtttggaaaggtttatgctgaaaatattcgcgataatgttttagaatttaaagagaaaatagccgatcttggcgagcctaaacaggcttctatagattttaatattgccgtagattggcaaaacgaaaatcaaaaaatccgtttatttggttatatggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggattaattatgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaagaggggatttcagccagagaaatgatgcaaattatcgcaaatacaaaacctaattcaaaagttctcgtcaccattctacgattaggcaaaatcttacaaattccagttgttattgaagaatttccagtaaattaaaaatagcggtctattttgaccgctgttttcattatatttaatactttcttttcaatttgaaaatttatttgttctaaccccttttctgacatttcgggcaaaagaaactattacgctgtccaataattaaactttcaatttttccaccgcactttggacaaggtttatctttattgccatataccaataattcttgtgcaaaataacctgggcgaccatcgggctgtaaaaaatctttaagtgttgttccaccttgaataatggcttttctcaaaacatctttaatcgtgttcactaaagagaaacattgattgcgcgtcaaatttttagcgagtttaaggggatgaatgccacaaataaacaaactttcattcgcataaatatttccaacgcccactaccacagcgttatccatcaagaaagttttaagtgcggtagatttttgacgagattttttgaataaatattctgcattaaattcatcagaaagtggttcagggcctaactttaagaaaagatgaaagtcatctagattctccgtccacaaccaagcaccgaaacggcgaggatcgttatagcgtaataacttgccattattcactacaatatcaatatgatcatgtttatctattgcactatcctgtggcacgattcgaacagatccagacatacctaaatgcccgatgatatagcctttttccgtgtgaataatcaaatattttgctcgacgagtgagatcgacaatttttacattttttagcgttattaattcttctgatacagcccagcgcaatttaggcttgcgcacgacaactttctcaatcgtaaaattcttaagataagggctaataccacgtagtgcagtttcgacttcaggaagttctggcatgattttcaacttagtaagtggatagaataatgatataaagtgcggttagttttaccatttttttatattctttgaaaattaaaatgatgaatatttcaaaaatataggtagttatctaatggataaaatttatatatctcgtttgatctatgctaaaagatttttattttacagaatagccgcctgttttcagatacaagcggttattttttgtgttaattgactaactaattaatcaatgggtggtgtgtaagtgccatttttgatgtcatctttaatgcgatttgcttctgttagtacttgagttaataacgctttaacattttccaatgttgcaatcgggcttagggtagtcattttcagtgattgtttgtcgcctactttagtcacgccaatattcgcttctcctcgagcaaagagttcatctgccacgttttggtttagtgcatcaataaattcagctggatagtcttttggtacgacacggaataacaccgatgcaaactgacttggcacaagcatttctaaggcaggagtatcgttgatgtattgctcgacttctttggtcagttttacgccgtgatcgatcattgaagcgtaaagatcttcgcccaatgcttcaagggtaaaccataattttaatgcgtcgaaacgacgagttgtttgtagcgattttgccactaagtttggcacgccgtgagcttcatcatattccgaattgagataatccgctttgtaattgataaagcgatagttctcaggatctttcaacaagaacgccccacacgagatcgtttggaagaagtgtttgtggaaatcaagcgtgatggaatcagttaattcaataccatctaagaaatagcgataatctttggaaagcaataatgcgccaccccaagcggcatcaacgtgtaaccacgcttgatattcatcggcaagtttgcggattgcttttaaatcatcaattgcgccagcatctgttgtgcctgcggtagcgacaatacaggcagtaattttgccatcagctttaagctgtgcaagtgtttgtttaagtgcaataagatccatttgtgcattggcatttgatggcacggtcacgaccgattggaaccccatgcccatcattgccatatttttttgtacagagaaatgtgcgttttctgaacaaatcactttcactttttgcattgcttctgctggaataccatcacgttgtactgaccattcagagccgtcttcgtttttccagtggtttgcaatcgcccaatcgcgtgccaacaatacgcccattaagttagattgagtaccaccagaagtgaacacgcctgatgtgccttcgccatagcctgctttttggcgtagccagttgatcaaatgctcctccataattgaacctgctgggctttgatcccatgaatccattgattggttggtcgcattaatcagtacttccgcaatttggcttgttaccatcgttgggcaatgtaaatgggcaagtgagtgtggatgatgtactttaaggcttggattaaggaaaatttttaccaaatgatcgagtgatttctgtacacccataccctctttcgtcggattaaaaccgcttattaaggctcgcatttgtttgattgaaccgcctgtgtacattttttcatttttcagccaagcagagactgcttgcaccgcattatacatcgctgtttcataatcgttaatggcttcgttatcgttgcaaaacaaagcttgtttgtgttgtttgaggtttgacataattattcctagatatgaattacacccaattttctgtacgtaatgctataactcgctcaaattctcttaaattgttactaaccagaattaacccttcactacgagcatgagcagctatatgaatatcattttcgccaatcaatttcccttgtttagagagttcagctttaatattgccgaaatgagctgcatgctttggttggtaatctaaaatggtgaggcgtgataagaaatcttcaataaccgcaatgtttctttcgggatattcgcttttttcagctccataatagagttcagccacagtaatgctactcacgcacatttttcctgcattttgattaaagcgagaaagaatttccaatggcctacgcttaatcacgtaaatcacaatgttagtatcaagcatatatttcaacactataaagcctcacgctctggttgaaatgcaatttctcgttcattcataaaatcatcgctaactgcttgatcattcaagaaaaaactatcccaagattggttgagaggcgataaaatccgatcactgcccgatacacgaaccgataattttttgatttcttcagaaaagcgaacttcagcgggcaaacgcacagcttgacttcgattagtcataaaaacagaggcttcaatcatagttattccttatgcttaattgtatatagcataagtatatcccagttttatacagttgagtagaaaaaaggtgggatttccctaccattttgaatttacaagcggtcaaaattcgcaaaacatttgcaaaatcagaccgcttttaattaactacgcaccactttcaatgcgtctacaacagattgtttgaagcgtttgatgaactcttcacattcactttggttgatgtttaccgcacaaagcacgcgaaccacgttgccaccgcgtccgccacgttcgagcaagagtttgtttttgaagcaagctttttggattgctgccgctaattcacaatcgcgcgggtaagcccctatcgcatctttcgcttggcgttcgtctacaatatcgatccccatcattaagccacgaccacgtacgttgccgatgcacggatattctttgcttaattcacgtaatgcgttggttaagtattcaccacgctcttgggcattttgtgcgaggttttcatcacgcataattttaagtgaagcgtaacctgtcgccatcgctaattgattgccacgaaatgtacctgtatgtcctgcaggttgccaagcatcaaattctttacgaatagctaatacagctaatggtaagctgccaccaactgcttttgacatcacaataatatcaggctcaatgcctgcgtgttcaaaggcgaacattcttccagaacggcagaaacccgcttgcacttcatcgacgatcattaaaatgccgtgtttttgggttacttcacgtactttttgtaagaagcttattggtgctggaacaacgccgccttctccttggattgcttctaaaattactgcagctggttttactacgccactttctacatcttcgatgaagttctcaaagtaatgttcaactgctttcgcgcctgcttcgccaccaatgccaaatgggcagcggtattcgtgtggatatggcataaattgtacgccaggcattaaattttcaacggcattttttgcaccaagattacccgttaaggctaatgccccttgggtcataccgtgaaaaccgccagagaaagcaatgatattgccacgccctgtgtaagttttggctaatttgatggctgcttcatttgcatctgcaccagaagggcctgtgaattgtaagatatatttatctttcgggaagaatgacaataattcttcactaaacgcatctttaagtggagtggttaaatctaaagtgtgtaacggcaatccgctatctaatacgtctttaatggcttgcattaatataggatgattatgtcctaatgcaagggttcctgcgcctgctaaaaagtctaggtattcattaccttcaacatcagtaacccaacagccttgtgcttttgcataggcaaaaggtaatttgcgaggataactacgtacgttggattccattacatcttggcgatctaaaaaatgttggtttgaagcaagaattgcttgtacaggggtaatcattgtcatttttgattaaaaccttctaaaagaggtgaaaaaaataagtcgggtgccttgcgataaatttactgtttataaaacagacacatagggcatttgactcgctacttattaaaaaaagcgtttcagcttttttgtttttaccctagtttgcccattggacgggctaggttggaaacaggttttgatgtagggttacgtcaaaacggggacaattgtatattctttttgcaatatgaaaagcaaatttagcttcttacgagtcaaacggctaaataaaaagcaaacgtttctaataagaacaaataaaaaacccgagtttctactcgggtttaaaataattaaatcaatattatttgatttttgcttctttatagataacgtgtttacgcactactggatcaaattttttgatttccattttttcaggcatattacgtttgtttttatcagttgtgtagaagtgacctgtctctgcagtagaaactaaacggattttctcacgagcacctttagctgccattttttagctccttagattttttcgccacgagcacggatttcagctaatactgcatcaatgccttttttatcaataatacgcatacctttcgcagttaaacgtaaggttacgaaacggttttcactttcaacccagaaacggtgagtgtgaaggtttggaagaaaacgacgacgtgtcgcattcattgcgtgtgagcggttattacccacagctggacgcttgcctgttacttgacaaactctagacataataatctccaataattaaatataagctcgagcttacggttcggattgtttaaagctggttaaacctagcttgctacctcgtcaggtcgcgctaatccgacccgcttactatattaaaggtcgcaaattatactgactttgttttcatttctcaagtgtaaatgcgattttcctgaatgtaatcggtaaaaaaatggtcaatattataaaaatttataataaacaattctccgcgaaagaataacaatcgcttttccctacaattaaatgatcaagcacgcgaatttccattagttcagccgcatcttgaatttttttagtaataagttgatccgaataactcggctccgttatacctgaaggatgattatgtgccaaaattaaagctgccgcattacaatagagtgcttctttaataatttctcgcggataaaccgctgatacattaattgtacctaaaaataaccgctcttttttaatcaaacgatgttgattatctaaaaataaaaccataaatacttctctttcctcgtgttgcaattcagtgagtaaaaaaagttttaccgtttcaagatcattaataatcggcgtacttaacatctcttgctttaaataacgcttggtcatttccgtaatcgcttgcagttgaataaattgcgtaatacctaagccttttacagaacagaaagcttttttatctgcggaaagtaaagcgtgcaaggagccaaaatgcgttaatacatttttagaaagtgacataacaggacaatctttgataccagtacgtaaaaaaatcgcaagtagttcataatcacttaatgcttttgctccgaatgccagcaatttttcccgtggcattaattcatcattgttttccatatatttataaaagaaaaataagaaagattttgaccgcactttttaggtttgacgagcaagtgattcaaaatctgcgatgcatatcgtaaaaatagcgttgggcattcaataaaattaaagtaaaataacgaaattgtggttaagtactaacaagggaagaaaatgaatttaaacggaaaacgtgttgtcgtcggtattacgggcggcattgcagcctataaaacaatagagttgattcgtttattacgcaaagcagaagctgaagtacgtgtagtattaaccccagctgcagcagaatttgttactcctttgacacttcaagccatttctggcaatgctgtatcgcaatctttacttgatccacaagcagagctggcaatggggcatattgaacttgccaaatgggctgatgccattattattgcgccagctagtgcagactttattgcccgtcttactgtaggcatggcgaatgatttactttcaacaatttgtcttgcaactgatgcgccaatttttcttgtgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtcgccattacagcaggcccaacgcgtgaggcaatcgatcccgttcgttatatttctaaccatagttcagggaaaatgggatttgcgattgctgaagcatttgccaaacgtggggcaaacgtcacactgatttcaggcccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtagctgaagttgcagaacaaaaaatcaaaaaatctggcgatgaaatatctatcaagttaattaaaaatcccgatattatctcagatgtaggacatttaaaaacacatcgtccttttactgttggatttgcagccgaaacccaaaatattgatgattatgcaaaagataaacttgaacgcaaaaatcttgatatgatttgtgccaacgatgtatctggcggacaagtttttaacgcggatgaaaatgccttgcagcttttttggaaaaatggtcataaaaaattatcgctaaaatcaaaagtagaacttgccgctgatttagtcaatgaaatcatcgaacgctatcaaaaaaccttataattccaaccgcacttttacctaaaaatgaatttcaaacggagtattaaatgaaaaaaattgacgtaaaaattttagattctcgcattggaaatgaatttcctctgccaacttacgcaactgaaggttcagcaggtcttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataatttatggtagaagaacaattatctttatcaggcgtagaagaaattgcgcctaaaattgaaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattgtaaataatattcaaaacattaattgacaattaatataaaggattttatcattgctccacttcttgcggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgttgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttggcacaatgtaagccaaatccacctacaccacaaaatagatcccataggttataaataggtaattcagatacccattgttgagctgttgcatataatccctccgccactttaggattagtttgaaagaagccttgtggacgaataaaaagcggaatactattgaaattttctggcaaaaattgttgttctgtcagaaaaatttcttgttctccctccaaaatagcagcgtgcagtggttgcaaattaacgctaaccacttctaagtgcggtagtttttctaataattttggtaattctcgacggattaacggcaatttattttctgtacgtaacacaaaacgcaacattaattttcctgttgcgatactttctgtcagtaaaatatatttaagctcgcctttttgtttagcaatgttataaggtactaaacctgcgcgaccaataaaatctttgaggattgaaaaaattattgagaaacgtgcaggataaagaggacaatcacacaaatcaatcgcactttgtggatcattaggattttttaaaataccaagtattgggcgttccacactaccactaacaagcattttagctttattacgaaagcattgttcattagattgaaaaggagctaaccattgagctttatcgcaattaatagaaatcagttgctgttttaaatgatgttgtttttcagcaagctgctgactataaggtatttcaagccattgacaagaacgacattcattttgttgatagtatcgacaatcaatcattttttgcggcctgaatatctagccaacggctttgaatatctgcgagatttcgatgattcagtttccaacgttgatctaaaaccaagtcattccattcgattacgctacgcttaaataaattttttaagcgagcttgacgagccataaagtgcggttcattttcagtaagttttagattatctaatacttgaatgacaccttcacgttcattgcacagtaacaaaagatcacaacctgcattcagtgcttttttgctacgctctacaaaattccccattactcccgcgcctttcattcctagatcatcggaaaaaattgtaccttggaaatttaatttcttgcgtaaaatttctttcaaccaatattctgaaccacttgcaggctgactatcacattgtccataaatcacgtgagcaggcataatcgcatcgagtttattttgtgaaatcaactgttggaaaggttggagatcgtaaccaaaaatttcgtcttttgcgcgatcatcataaggtgtttctaaatgggaatcggctaatacatgaccatgaccgggaaaatgtttacccgtagatgccatacctgcttgatgcataccatcaataaaattgatggctaaatttaccgcactttttacatcagatgaaaaactgcgatcaccaatcgctcgacattcatgccccaaatccagcactggtgcaaaactcaagtcaatatccaaagcaatcatttctgctgccatttgccaacctgcttctttagcaaaacttacttgttcagttgctgatagtgtttcttgaaaagcctgcattgaaggcaacattgtaaatccatcacgaaaacgttgaactcgtccaccttcttgatccactgtaattaataaaggcttttttactcgttggcgaacagaacgaattaattcttgaatttgttctctgtcttcaaaatttcgagtaaataaaatcaatcctgcaacaagagggtgcgaaagtaactcaacttcctcttgttccaactcttttccttttaaatcaattaacaaggtgctcataaattattttaaataaaggcggtaatttttactttctacagtaggtttaattaaatcgattgatttctcttcttgtggttttagcgaaaattgagcggaatagctttcttgctgattttcccaaatttgggtaactcctaaatgatcataccaatacaaatggtaacttacattcaaaagttgctgacttttattttttataaccgctgatttttgagtcgtttcaacttgaattaaaggcgaaagagacgacgtaatattcaaaatcggctttgttgaataagttaagttttgctctgaaattgaacaagctgcgagcataaagctcgccaaaattagaaaatattttttcattatttcgctaacattttacctaaaggttctccaccaactaaatgcatatgtaaatggaatacttcttgcccaccatatttattgcaattcacaattaggcgataaccatcttccgcaatgccttcttctttagcgagtttagccgctacgctaaataatcgacctagcgctacttcatcttgctccgtcacatcattcactgtgggaatgactttatttggaataatcaaaatatgtgttttagcttgaggggaaatatcacgaaatgcagtgactaattcatcttgatagacgatatttgccggaatttctttacggataattttactaaaaattgtttcttctgccattgtttgctccctataaaaagtgcggcgaattaacctgtccataattgttgcttatttagtctaacttttaaggacagagcaaatcaatcgcactttttgttttacaatgaatttaattatgcaaagtatcgaacttctccattgcccactacattttctacacaacgtgcacaaagtgttggatgtcctgggcttaccccaatttcgtcagaataatgccagcaacgagggcatttttctgcgttagaacgtgttacgcttaccgcaataccctctaattcgctgtccgctaaatcagcaggtttttccgataaagattttacatctacttttgaggtaattaatacgaaacgtaattcattacctaattgtgctaacaatgcacgatattcgtcattagcataaacggtcacttctgcttctaaaccgccgcctatttctttattgttacgagaaatttctaatacacggtttacttctgaacgaactttaatcagttgttgccagtaagcatcatctaatttttcatcctcgcctaaaccaaataagccttgatagaattcttcagtaaatacgaattccgcacgagcactttcagtttgtggcaagtgttgccaaatttcatcggcagtgaaagataagatcggtgccatccaacgaactaatgcttcagcaatatgccataacgcagtttgacagctacgacgcgcaaggctgtctgctttggttgtatattgacgatctttgataatatctaaatagaatgaccccatttctaccgaacagaaacgcattaaacgttgtaccacagtgtggaattgatagttatcgtatgcatctttaatttcattttgtgcatctaatgcacaagctaccgcccaacgatctaggctaatcatttcttctggtttgactaaatcacgttttggatcaaaaccattcaagtttgctaataagaaacgagcggtgttacgaatacgacgatagctgtccgctgcacgttttaagatctcatcagaaacggtcatttcgcctgtatagtctgttgaagcaacccataaacgtaaaatatcaccaccgaatttatccatgacttcttgtggcgtcactatgttaccgatagattttgacatcttacggccttgaccatccacagtgaaaccgtgagttaatacttgcttgtatggtgctttgctgtttgttgcagtagaaagcattaaagaagacataaaccagccacggtgttggtcggaaccttctaaatacatatcaatatcttgaccattaaattctaggcgatttgcaacaacagaagaataggttgatcctgagtcaaaccatacgtcaagggtatctggcactttgcgataggtttctgcatccgcccctaataattctttttcgtctaaatcccaccacgcttgaatacccgctctttctacacgtttcgccacttcttcaagtagctctaaggtacgcggatgaagttcttcggtttctttatgcacgaacaaggtcatcggcacaccccaagtacgttggcgtgaaatacaccagtctgggcggttttcaaccattttctcgatacgtgcttgaccccaatctggaatccagcgaacttgtttgatttcgcctaatgcttgttggcgtaaaccttgcgtttccatgccgataaaccattgcggtgttgcacggaaaataattggcgttttgtgacgccagcagtgtggatagctgtgtttgattttctcaacttttaataagttacctacttcttgtaatttttctatcacaagcggatttgcttcaaatacgcctttgcctgcaaagaattcggtcgttgaaataaatttaccatcattcgatacaagacccgccattggtaaatcatattgtttacccacgataaagtcgtctaaaccgtgatcaggtgcggtatgtactaaacccgtgccgccatcagtggttacgtgatcgcctaaaattactggtacagtaaaatcatagaatggatgatggaaacggcttaattcaagatcagcaccttttacagaacccagaatttcaacttgttctacgcccaccgcttttgccactgactcaactaattcagcagctaaaatcacgcgctcatcgccaagttggactaagttgtattctaagtctgcattcaccgcaatcgcacggttagacggcatcgtccaaggtgtggtagtccaaatgatggctgataatttaccttgtcctctaccttgtgcagaaaatttagcttcaatttcaaccgcactttccgcagggaaacgaacgtaaattgacggagaaactttgtcttcatattccacttctgcttctgctaaagaagaaccgcaatccaaacaccagtgaactggttttgagcctttatacaaatgaccattttcaatcactttacctaaagtgcggataatattcgcttcggtatcgaaattcatcgtgagatatggattatcccaatcgcccaacacacctaaacggataaagtcttttttctgaccttctacttgttccgaggcatattcacgacatttttgacgaaattcagccgcagaaattttctcgtttggtttgcccactaaaccttctacttttaattcaattggcaagccgtggcagtcccaacccgggatataaggcgaatcaaaacctaacgccgttttggatttaataataatatctttcagaatcttgtttacagcgtgaccaatatgaatgttaccattcgcatacggagggccatcgtgcagaataaaagattttttgcccttactcgctttacgaattttttggtaaagatttttctcgtaccaatttttcaacatatcaggttcgcgcttagctaaatcaccgcgcattggaaagctggtttccggtaggttaagagtgtttttgtaatcgactgtcattttattttccaatttttacattttaaaattaactgttaaaaaacgctttcgcagtttctacgtctttctcaatttgcactttcaaatcatcaaaagaggggaatttaatctcgtttctaatcttgtggcagaattccacttccaccatttggccataaatattctgagaaaaatcaaataaatggacttctaataattgcattaatccatttatagttgggcgttttcccatgtttgccacgccgttaaaaatctcccccgattttaaccgcacttttacggcataaacgcctttgattggatttacttgtctatgcaaacgaatatttgccgttggaaatcctattgttctacctaatttattcccatgaatcacacgcccgaaaatacgataaggtttaccgagtaaattttctgcaagttgtaaatcatcattcgctaacgcttcgcgaatcgcagtgctactaattcgctgtgcatctagacaaaaactacggttatcttcaacaataaaaccaaaacgcttactagctgcttgcaacatggcaaaattgccttggcgttttgagccgaatttgaaatcatcgccaatgcttaaaaatttcacatgtagatgattaacaagcgtttgttcaataaaaacatcggctggttgctcggcaaaagtgcggtcaaatttcgccacaattacgacatcgaccttagccttttcgagataataaattttgtcacgcaaacgcattaaacgtgcaggtgcattttcccccataaaatattcacgcggctgtgattcaaataacaataccgccatgggtaaatttaattcgtcagctttttggcgcaaatggcggaggacggtttgatgccctaaatgcacaccatcaaagttgccgatcgttagcgcacaaccttgtaaaacacgatttgcattatgaagcccacgaattaattgcatgtccttatccatgaaaagaagagaatttcggcattatagcgagaagttagttttttgtcagcaaatggtgcttgcgaacgcctaataaaatcaacgttgtgccataaactattgcggctaagacaatcaaccaaacaagccaataaacacgcataaagaaatccatttttgcccattggttgatttcaggcacgtaataccaaactgccgcacccattgcgattgcagccaataaaactttgacaaaaaagaccgcacttttacgtgaaaaatggtacacatccgctttggctaagccgcgatagagcaaataggcgttaagagttgcggacattgctgaagcaatagctaaaccaacatagctgaaaggaatcgccaatagattaaagcccatattactcaccatggcaataatgccaatttttactggggttttggtatcttggcgagcgtaatagccattggcgaggattttaatcaacataaagctaagcaaacccgcattaaacgcccataaagaataagaggcggcataaacatcatttagcatgaaatttccacgcataaagagcgtaagtaacatcggttgagccaatacagcaataccaatggcagcaggaacgccaagtaagaaaatcattcgcacgccccaatccattgtattacgaaaatcaaccgcacttttagctgaatcgccttcacgattaacgtggtggcgagcaagcgttggtaaaattacggtagaaatcgcaatgccaaataaaccgagaggaaattccagtaagcggtcggaataatacagccagctaatagagcccgtcattaagaagctcgcaatcactgtatccagcaaaagattaatttgacttaccgatacaccaaataacgcagggatcattaatttacgaattttggttacgccttcatcccgccaagcccattttggtttcaccagtaaacctgcttgtttcataaatggaatttggaataagaactgtaataatccgccaagaaaaatcccgatagccagtgcaagatctgggttatccatttgtggtgcaaggaaaagtgcggtggcaatcatcgctatatttaataacacgggtgaaaaggacatcacgccgaattttccaatcgtgttaagtacagctccaaaaagcgcgacaaaagtaacaaaccataaataaggaaaagttattttaagaagaagagaggcttgttcaaatttatgtgcatcagggccatcattcatccaatcggtaaaccagcccatcccaaataaagcggcaacgacaggcgatccaaccatcgcaaggatcgtaacaatactcaccaatcccccaagggtaccagaaacttttccaataaattcacgggttttattcatatcgccagatttttgatattctgcgagaacagggacaaaagcctgtgaaaaagccccctcagcaaataaacgacgaagaaaatttgggatacgattagcaaataaaaaaacatccgccgcagcgccagccccaatgagatgagcgataactacatcgcgtacaagacctaacactcttgataataacgtcatagaactaacaacaatgctagattttaaaagtcgtttactcaaaatattcttctctaccctaaaatttttgcctaattgtatagaaattttgtttttacgctatattccgtgaaaaaaaactgataaaatccgccacacatcgtttgtgtgagcccatattgaaagagcttgtaaaaataacgatacttactttcggttgtgtctcaccgaaatcaacacaaattttccattgacaaaagtataaaaaatcggcatattgacgccctttattttgtctatcaatcaacagaaattttaggagtttgaccttggctaatatcaagtcagcaaaaaaacgcgcggttcaatctgaaaaacgtcgccaacacaacgcaagccaacgctctatgatgcgtacttatatcaaaaaagtatatgctcaagtggcagcaggcgaaaaatcagcagctgaatcagcattcgttgaaatgcaaaaagttgtagaccgtatggcttctaaaggcttaatccacgctaataaagcagcaaaccacaaatctaaattagctgcacaaatcaaaaaattagcgtaatttttagctagaaagaatgaaaaataaaaccgcactttaaagtgcggttttttattgcatcgaattttagactaaagtaacaacatcgatccccatttgataatatcaaagaagaatttattttgattggttgcaatgccatcagaattttttggtgtgccatcttcatttttttgcacttccaccataccatttttatattgacctttcacgacagccaaatcatcgtgcgcttcgttacgcaacttcaaacaagactgtttagttaaaggttcaacattgctcactttggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcggaaagttggtaatcagccccagcaaattccgctggaattgcggattgttgactatcaaacattgaacagccagacagcaatgctgccatacctaaggttgcaattaatttcacatttgatccttataaaagtgagaatgcacaaaattctagcaatatcttcacaacagataaagcagcaaatgaatttagttttcctgatctgaaaaacttccgctataatgaccgcacttttttacgttaattaaaaggaattcttatgcaaaatccaaaagatgatgtgttatatgcgcctgttgaatgggtcgatcacagtgaaggctatagcgatattcgctatcataaatccactgatggcattgcaaaaattaccattaaccgcccagaagttcgtaatgcgttccgcccacaaacagtgaaagaaatgatcactgcattttccgatgcacgtttcgatgaaaacattggtgtcattgtattaactggcgaaggcgaaaaagcattctgttctggtggtgaccaaaaagtgcgtggcaattacggtggttacaaagatgacagcggcgtacatcacttaaatgtattagatttccaacgcgatattcgttcttgtccaaaaccagttgtagcaatggtggctggttatgcaattggtggcggtcatgtattacatatgctttgcgacttaacgattgctgctgaaaatgccattttcgggcaaactgggccaaaagtcggttcattcgatggcggttggggcgcaagctatatggctcgtttagtggggcagaaaaaagcgcgtgaaatttggttcttatgccgtcaatataatgcacaagaagcattagacatgggcttagtcaatacggttgtgccttacgctgatcttgaaaaagaaaccgtgcgttggtgtcgtgaaatgttacgcaatagcccaatcgcaatccgttgtttgaaagcagcattaaatgcggattgtgatggtcaagctggtcttcaagaattagcgggtaacgcaacaatgttgttctatatgactgaagagggtcaagaaggtcgcaatgcgtttaacgaaaaacgcgccccagacttcagcaaattccgtcgtaatccttaattatccgtagttttttatatttataacgacactcttgccttcccctgcttgcgggggaaggtgcccgaaagggcggaagggggctttatatcctttctctaccttcggcagctctccccacaagcagggggagccaagcgtttttgatagaataattcaaggacgtaaaatggcacaaaaatccttcaatctttaccgttattccatccccgttgatagccaacttattctgcgtgatcgttttttaaaacgccgtgaaggcttaatcgtaagagtgagttgcagccgagacggttggggagaaatcgccccactacctggttttagcgaagaaaccctagaccaaactcaagaacaagcaattgaatggctaacgacatggtgcaatgcaagctgtgacgcacctcgcgtaccattagatggcacctatccctctgttgcttttggtatcagttgcgcaatggatgaaatgaaaggttatttacaagccgaaggcaattatcatacggcaccactttgttgtggcgatccagatgaactgtacgccaaacttgcgagcatggaaggcgaaaaagtagcaaagatgaaagtgggcatatacgaagccaatcgcgatggattaattgccgatatgtttttagaagccattcccgatttacaattacgactagatgcaaaccgacattggtcgttagaaaaagcgttacaatttgccgctaaagtcaaaccgcaacatagaaaacgtattcaatttttagaagaaccttgtaaaacacaagaactcagtcgtgaatttgcagctcaaaccgacattgcgattgcatgggatgaatccgtgcgagagcctaatttttgcctggaaaaagaaccgcacttatcggctgtcgtaatcaaacccactttaattggttcaattcaacgttgtactgagctcattaaccaagcacattcgttaggtctaaaagcggttattagttcaagtatcgaaagcagtttaggactctctcagctcgcgcgaatcgcacaacaatacaccccgaatgtaactccaggcttagacacgttagatttgatggaatatcaagtactacgcgcttggcctaattctaatttacctattgttaatttagaatctgaatttatcactaaaattatctgattcgaccaccaaaaatcgaaaaaccagtataatgcgccacacaaaaaggattaaaaatgtcgcaaacacacagaattttgctgttaaatggcccgaacttaaatatgttaggggctcgcgagccaaaacattatggcagtatttctcttgcatccattgaagagaaaatacaaacattagccactcagcacaatgtaaaagtggaatgttttcaagccaatagtgaagaaaaattaattaataagatccacgaaagttttcagcaagtcgattttattttaatcaatcctgctgcctacacccataccagtgtggcattgcgcgatgcacttttagccgtttcaattccttttgtggagattcatttatccaacgtgcataaacgtgaaccatttcgtcatcattcttattttagcgatgtggctgaaggtgttatttgcggtttgggtgcaaaaggttacgagtttgcctttttatttgctattgattaccttgctaaaaaataagaaaatcgagcatttttggcgaaattcatagaattttatcgcaaatttgcaaaatttgaggtaatctctacaacaaaaaaacaagtttattcataaccgcacttttttcgtttaaaagtgcggttaaaatttcaatctttttaggaagaacgtatggacattcgtaaaatcaaaaaattaatcgaattagtagaagaatctggcattactgaattagaagtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaataatttccaatattttcgtcgggcggactttagtccgcctgtttcatatacaaataattagagcgaatttatcgtaggcgatataaattgaaatctgttcacaccaaattttatagggagaacaatatttcaataacctacataaaaattcacgtctatctgactaaacggactcttttatgttagaaaaagttgtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctatcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaataattaaacgttaaatggctaacaatggttagccatttcttatatatgccgatatttatttaatgataataaaaactaaagctagtaaagcgttttgaattattcaaaaaagttgtaatatgaataagtataaggggcgtaggatatatgtgcctcttataccattcaaaaaatatactttcacttataaaaatttaaggaagaaacatgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaatgaatctaggtattattcttcccttaattatttatctcacttttgtttttggtgcggcaatttttgcctatgtaaaacgtacaaaaggcgattttttaacagaatattatgtaggaaatcgctcaatgacggggtttgtacttgcaatgaccacagcctctacttatgccagtgcaagttcttttgtaggagggccaggggctgcttataaatacggcttaggctgggtattacttgcgatgattcaagtccctgctgtatggttagcattaggtgcgttgggtaaaaaattcgcactcttatcaagagaaaccaatgctttaaccattaatgatcttttcttttatcgctataaaaacaaatatttagtttggctatcaagccttgctcttcttctcgcattttttgctgcgatgaacgtgcaatttattggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgcttttttagtaggtaataaattgggcgaacgtcgaatcgaaaaaactcaattaaaagctaccgcactttaagcgtcaatcaatatgctgtcaccttcttctaaacttagaggaaggtgatatttaattttctcactttcagcaatttctaggctaaaacatagaattggaactattcacagggatacatcaatgctctatcaaattctcgcgctacttatttggagcagttcattaatcgtcggtaagctcacttattcgatgatggatcctgtgcttgttgtgcaagtgcggttaattattgcaatgattttggtaatgccactttttttgcgtcgttggaaaaaaatcgataaaccaatgcgtaaacaactttggtggttggcattctttaactataccgcggtctttttattacaatttattggtctgaaatacacctctgcgtctagtgccgttacgatgattgggctagaaccgctacttgttatatttgttggacatttcttttttaaagacaaagcaaaatggtttcactggctattcggcgcaatggcatttattggcgttgcaattttaatcaatggtggaaaaaataatgaaggcattgataatgttagtttattaggttgcttattagtgctaagcgcagggattatttttgcgactgtattacgttggacgcggcgagttgttgccaaagtttcaacgcaagtttacacatccatcagtattgttcttggtgttataacaacattaccttttaccttattactgacagaaaactggcaaatatcattaaattccacgggaattgtaggtttattatatcttgcgcttggttgtagctggcttgcttattggttatggcataaaggactcaataccgttgatgctaatatctctggtattttacttgcacttgaaccattattcggaatcttatttgccgtatcattacttggcgaaacgctgtcattttcagccgtacttggcataacaattattatgttagccacacttggctcgattttactaccgaaacttttgaaaaaatcggtataatacgccccattttatgaaataaaggaaaaaacaaatggcttggattcaaattcgcctaaatagtaccaatgaaaaagcagaacaaataagtgattttttagaagaaatcggatccgtttctgtgacttttatggatagtcaagataccccgattttcgagcctttaccgggcgaaacgcgtttgtggggcaatacggatgtaattgcgctatttgatgcagaaacagatatggcagaaatcgtccgcttattaaaagaagcaaaacacttagatagcaatacggcatacaaaattgaacaaatagaagataaagactgggagcgagagtggatggataatttccacccaatgcaatttggtaaacgtttatggatttgtccaagttggcgtgatgtgcctgataaaaatgccgtcaatgttatgcttgacccaggcttagcgtttggtactggtacgcatcctacaaccgcattatgtttagaatggcttgatagcttggacttaaaaaataaaactgtcatcgattttggttgtggttcaggcattttagccattgctgcattaaaacttggtgcgaaaagtgcggtgggaattgatatcgatccacaagcaattctagccagtcgtgataatgccgagcaaaatggcgttgtagatcgcctacaactgttcttatctgatgaaaaaccttctgatttaaaagctgatgtcgtggtggcaaatattcttgctggcccactcaaagaactttacccaatcattagccaacttgttaaaccgaatggcaatcttggtttatcaggtattttagaaactcaagctcaatctgtctgtgatgcttatacgcaaacatttgcgttagaacccgtcgcggtaagagaagaatggtgccgaattacgggtaatctaaaaacgctttaatttctttttgtcaatcaaaaaaagtgtattttttaaacaaatttcactttgcaaagtaaggcaaaatgcgtattatagccagccttgtcggttgtcgagcagttcaatataaattagatttaggcttgctaggaaggtaacgtaaaatgcgaatcggttcataccaattaaaaaatcgtgttttacttgcaccaatggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattgttataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatgggataaggcgatattcttttattaacaaaaagattgaatgtttttcattctattttaaaaattagccccaagtaatttgaatttggggctaatttattattacaatttaagatcttcgatgtgcatttttcataatgcgatcttttgttactttccattcacgttctttaatatcatcacgtttatcctgttgttttttacctttggctaaaccgattttgacttttgcccacgcacttttccagtaaagagaaagtgcaactatggtaaaaccgtctcggtttgctttgccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttattcagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgagaaagataaaaagatgaattaagtgttagtgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaatacggtcaaaagcacaaggagaaccaccacgttgaatatgccctaaaacggttgcgcgagtttcgtgacctacgcgagcttcaatttcttttgccagagaatgaacatcagttaaaagttcagtgatagcaataatagcgtggcgtttaccgcgaataatgctacgttcaatttgttgaattaattcttcgcgattaaattcaatttctgatgcgacgatatattcacaaccgccagcaatgcccgcagaaatcgttaagtcactacaatggcgacccataatttcaacgatagaaatacgttggtgtgagcttgatgtatcacgtaaacggtcgattgcatccactgcagtttgtaatgcggtttgatagccgatggtatagtcagtacctgcaacatcattatcaatagtaccgggtaagccaacacaagggaaaccgtgttcttcggttaataatttagctcccatataagaaccgtcaccaccgataaccacaagtgcatcaatgccgtgagaacgtaaaatttctgcacattttgcacgaacatttggatctttaaattcaggaaagcgtgcagaacctaaaaaagtaccgccacgattaattacatcagatacgctatagcgatttaattgtttgattttattattgtataaaccttggtaaccatcatagataccaaacacttctaagccttctgcaagtgcagagcgtactacgccacgaattgcggcattcatacccggcgcatcgccaccacttgttaaaactgcaatttttttaatcataatttacctacttttaaccataattgaaaatgggcataagattacatcattcaaagaatctgctctagcaaaatttgacgagattttgatctacattatttttcacaaaacagttgccatttcaaattttgtaaatgttttctttctatatccacaatgtatttttgcaaatgttgttgtactttatcgacagataaatgtttagaatgcgttggttgctgtattttctgcgaatattgaaattgcacaaagccacattggggcaattgtcgtcctttcatcacattgacttgccaagatggattttcctttgttggcgaatagatgacatatccatttaattcatttggattggtcgaattttctggaatagtatcaaaatgaaaatctttcacgtctgtattgcgataaatgcgttctcttaatgcaatacgttctttaatagaacgttcggattgattgcgatcaaagagaatttcaatttcagattgccaattttctagcgtatctggcttagatatatacgcatagcgtgcaatggttcctaaatcttggctgccagtaagtacataatgtttgccattatattctaactgcgtaggcacatttaattgggtcagcttagttgcacagcctgaaagtataagtgcggtcaaaataacaaaaattttattcattaatatctcgcttaaagacaaattcagtttcagtggaggatgctgaatcaaaccaataaccacctaaatcaaattcttttaactgttcaatgtcggttaaacgattttgaataagataacggcacattaatcctcgcgcttttttagcataaaagctaattactttgtattttccatttttattgtctaagaaaactggcttgataattttggcgttaagttggttttctttaacagatttataatattcatcagaggctagattgactaacacattatcgccttgtgcatcaatagcttgttgaactgcttgggtaatcacatttccccaaaaggcatacagatcttttcctttcggattggctaattttgtccccatttctaatcggtaaggttgcattaaatcaagtggttttaaaagcccataaagcccagaaagcatacgtaaatgggattgtgcaaaaatgacatcatcttccgaaagggaatcagcatctaaacccgtataaacatcgcctttaaatgcaaagagtgcagggcgagaattgtcttcattgtgaatttttgtccattcagcaaaacgtgcaacattaagccctgctaatttatcgctgatagacattaatgatgaaagatcttgcggagaaagtttacgacaaacctcaataagttgttcgctgtaatcagtaaagtgcggttgaaaaacaggaaaattttttaccgcactttcaaaatcaagggttttggcaggggagataatggctaacataatcgtccttttatgaaaaaagaatgggcgtatcttagcataaaaatttacgttaaatgcgtttatataagccattttcacttatgataagatcttgtagctcaagatcgagcaattgaacaagtaaaacatcgacacttaaattaaattcttcagctaaatcatcaatgctcacaggagtatagccaatacgtgaataaagtttcgggtggcttggtgcttctactaatcggcgaggatcgggtggtggcgtgtaattaggcacggcgatctggtcaaaatcaatttcagtttggctgtggatagaatgttggtagagcgtttccaaaatgtcctttgcattttctaccaacattgcgccttgtttaatcaggcgatgacaaccttgacttgattcattttgaatattgcctggcacagcaaaaacctctcggttttgttccaacgcataccgtgcagtaataagtgatccacttttttcggtggcttcaacaacgagcgtgccgactgaaagcccactaataatccgattacggcgtggaaaattagcagcaataggtgcttggttaggtaaaaattcagagactaatgccccattattttcgatgatttgtgctgataatctttgatgtttagagggatagatttgttctaatccactgcctaagaccgcaatagtttgcccttgaatattgacgacagcctgatgacaatgaccatcaattcctaatgctaaaccgcttgttatggtaaaacccgctaatgaaagttctgttgcaaaatgttttgcccaatattctccataagtcgtgcaataacggctcccaaccattgccatttggcgttgtgaaagtgcggttaaatttccttttacaaataatagtggcggaaagtttgcggtttgtttcaataaaaagggataaaaaggggaaaaataatttactaaatgatttccctctttttgtgaccacgcgagtgctggctcaataaattttgcttcaggtttgaaccaacggcgaatttgaatggctccccatcccatttgtcggaaagcaacatcatcataattaagtaattcatttaaggtaatattggacaaaattttatcaatgccaacgccgccaagtttaggcacttgcattaaacggagtaatgtgtaggtaatgtcattcatattttttcctttttatttgaaagcctagtatgggaaaaacgagggaaagaaacgattaatttaaaagcattttgcgatgtagatcgcaaaaattctttttaatgaataaaaaattgcaaaatttttcttattttgaaaatgtaaaaaatccaataagaaaaatttgttgatgacgattaaattggttaaatattctgattttattaaatttattagttaaatatatatttaataaagtgtgagtaggtttatttttaatataaaatgccaaaaaatagtttgacagccagttttttattcgtaatatggaaaacgttttacacagaaggatttttatttatgtttcgtattgtttctttatctctcaacctgctgctctcacattttgcgtgcggctaagttgtggataaaaaacagtcagatgtaaatacccaattttaaacccgcactttataagtcgcgggttttttgtctaaaaaatacaggaaaaacgcaccgcacttttggagtgattttagaggaacttttagtaaggatattgttatgacagatcgcgttattatttttgataccaccttgcgtgatggggaacaggcgttaaaagcaagtttgacggtaaaagaaaaattacagatcgctttagcacttgaacgcttaggtgtggatgtaatggaagtggggtttcccgtttcttctcaaggggattttgaatcggtacaaaccattgcgcgccatatcaaaaacgctcgtgttgccgcgttatctcgagccgtagataaagacattgatgccgcataccaagcattgaaagtggcagaagcattccgtattcatacttttattgcaagctcggcattacacgttgaagcgaaattaaaacgttcttttgatgatgtggtaggaatggcagttgcagcagtgaaacgcgcacgtaattatacggatgatgttgagttctcttgcgaagatgcggggcgtacgggcattgacaatatctgtcgtattgtagaggcggcaattaatgcaggtgcaactacagtaaacattccagataccgttggtttctgcttaccaaatgaatacggcaatattattgctcaagtgcgtaatcgcgtgccgaatatcgacaaagccgtgatttccgtgcattgccacaatgacttaggtatggcaaccgctaattctttaaccgctgtacaaaatggtgcacgccaaattgaatgtactattaatggaattggggaacgtgcgggcaatacttcccttgaagaagtggtaatggcaatgaaagtgcgtcaagatttcatgggcgtggatactcgtattaatacccaagaaattcatcgcgtgagtcaaatggttagccagctttgcaatatgccaattcagccgaataaagccattgtaggctcaaatgcttttgcccattcttctggtattcatcaagatggtatgttgaaaaacaaaaatacctacgaaattatgtctccagaaaccattggtttgaaaaaagaaaaattgaatttaactgcacgttctggtcgtgcggctgtgaaaggtcatatggcggatatgggctacaacgaacaagattatgatttggataaattgtatgacgcgttcttaaaattggcggataaaaaaggtcaagtgtttgattatgatttggaagccttggcatttatcgatatgcaacaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcactaacccaatccccctctttagtaaagaggggttaggggagatttggcagaagtaacatcaacctcagtggtgaattttatatcgttaaaatctcctccagaccctcttcacaaaagatgagagaaaattaaccgcacttttgcagtaaaaaataggaaaaataatatgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatttaatacttgccttcctccgtttacgggggaaggtgcccgaagggcggaaggggggcaatctcccacccttagttatttagaaatatccccaataaacagggggacaaagtatttaaagtgcggctgaaaaacacgtcgaattttaaccgcacttcccttaacgaatagagaaaaacattatggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaattaaggctcaataagaggaaaaagaaaaatggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgttaaaaataaaaaatgtgctgatttttcaccgcacttaatcactgaatttcattcaaaaataaagccctgtaatacacagggctttgtcgtttataacgctaattcaaacaggctgattaaaaactaaaacttagtttcacttctgcagttttttgtttttccgcttgttttgcttttgttaatccgccaattagacttaatttcacattatgatatttcaatttaagtcctgcgttatattgctgttggttttccacattgtaagcaaaatcatatctatctacattaattttgccgctgccttgatttgcatcatatcgagcagacaaaattggcgtaatggaaaactcgcctaagtgataagtataacttaaatcaacttgagcaaaggctgttttgacagatattggatttactttaatgcgatctttagctaatgcaaaattagcgtttgataagtaactataacgaacccctacagttggtttaacagcaaaattgccaagattaaatgctttgcctgcggttaaaccaaattgtgcagtatggcgagcaaatttcgcattatgattagtttgtaagttgctttggaaattaccatagcctaaatccaccgctaaataccaatgattatccatataatatttagaatagagatttgcttgtgctaaggtatttttactgcttgccttatcaaagttgttactattgcgaacataagtaaacacaccacctaactgaacattgcttgagattgtttgatcccaaccaagttgagtttgcgcacttttagaactaaaatgacgatattgacttgaggaataattttctttcattgaagtattagatacccaaacgttatattgcccctcgttattcatttctaactggctaatatgttgagaaacggctttccctacatttaatgcaacaaattgtgcttttgccatggcatcagaaattaccgcattggtgtttgtacttgtgagatcgcgcaatactagttgtgtagccacatcatttcccgattgcggattctccgcattttcagtatgtagttccactggctcgtaactattctgagctgatctacgagttcttctgcttcgtggttgtggagtagatcctgaattatccactgttgtttcttgagtagaagctactgttgtttcttcagcagaagtcactttagactggctaacaacagcttctgttgtcgctgtttctgattgaactgcctctgaattaaccgtagattgagttgtagcaggtgttgtattctctggatttttcactacagggttttcagtgcttactgttgtggtttctgtcacaggttgttcagcttctgtagttttattctcaacaggtttaataggtgttgtagcattttcaggtgtaacaacttctgttgaagcaacagcagtgtgggcttcaggctgatgaatattttcatctgtcgtttctgttgattgaggattttctgctttattttcagctgtttttggattagctacaggttgagcagtttctttctgttcactgtttgatgcagttgtctctttcgcagcaacagttgtaggttttgcttgcggttgagcttcttttacattattaacagtcgaaacattttcacgagcaggctctgcttgctgtgtggtagtttctggctgtgcttgcgattgaacagttttaggctgttcttgctgtttagccatttctggttcttcttgttttggagacgcttgaaaagccacttgaggggcttcttgagttttctctgtttctactttagcagtatcttctgttcctgctagatttatattattagaagacgagctaatacttcttctaggtctgctctttggttcactgattgtaggatcatcttctactactgtttcttcagtagaatttatttcagactgacgagcagtttcagcctcttgagtttcctcggtttcgcttccattttgggcgagttcatttgtttgagtgttagcttccacagttggtttagcttcttttgcaacttcatcattttgagctgttgtctcggttgctttttgctcgtttttcgctactgtttcactttcttgcggactattttcagccactttttcaattgtctctgatggaacactttctgaatttggatcatcagcctgtgttgtatcagcttgtggttcagatcccgatgggtgagtagtatttgtatcttccattgtaggttgaacggtttctgcaggacgagtttctggttgctcgtttgccattgctgatccagtagcaggtgcaggtggtgctggcagtggaattggtgcttcaacacgagcggtttcttcatggttatttgatacgctaggtacatcagcttgcatattattagctgttgcaatacttggcgtatcgacagtttgatttcttctttctacttctgggttatgcaagtaataacgtccactattttctttcaaagtatagctccaagcacctcgatcaactttgccattagccagtgaaacatttaagccacttctttcagttgcatttgacgcatcaaaaagcgtaagttcattatgatttggctcgcctgttttatttgccacttgtaatgtaaaggtacctttggctgatttggttacaacaactttgtcgccctgatttttggtaaaatcaacccaataatagaaagaaccattacctgataaattgctaatattgagcgtgtggtattttgtttcttttgttgcatctgagacattatttaaatgaatatgcccatttgctagatctaattgatgaacatcactatttcctgttaaataccaatggctgttttcttttaaattaacttggctattttccgtgctgttaattgtgccaaataagttagctttgcctaaggtaaagtttgcactttcggttaaatttacattaccgcgcaaattagttggattaaaactattgagtgcttttgtagataaagtgtcattatggcaagtcacatagcccgtatagtcagaacgtacacaaacggtatcgcctgctttatagccgatatgcacttttgctttattagaggctgtgatatttgaagtaatactttcaacattgcgacctgaataaagggttgcgttattggttacattaatatttgttgctttaaaagtgcggttaatccagtcgtcttctaccaccacttcattattttcagcaaagtgtttatctttttctgttgaagaaatatttgcaatatctcttgcgtgtggtgttggtctgccagaaaggaataatgtacctttttcaacttttaattcaccgttaaggtttgttccgccagtcaataaaaagcgattttgatcacttttgccactaaaggtaacatttaatttaccgttttgatctgccttagttgcttcctcgccaaaataaccattaaagccattcatacgtctgttattgatgtacaccatggctttcttttgtgcatcattttgattgtcgcccatgaattcccaattagcatctgatttttcagagctatagcaaggcatttctgcagtagggcttccaccttgctttaacgcatagtatttataacaggtattactaaagtaaagatcttttcctcttggaatagatggcacatagtaataattatcatcatcggcggttattgctggtgtatatatagtgacctgacttggatttgtaattaatcctgctccagtaatcgttatatttgaggcattagtcatattatgattaactagtcttgcaccatcatcaatattacggatatgttcaaaagtgagattattgccattggcatctaatcgaccgcctctaaaaccaaagtaaattgaatttggatctacttggttatcatcattaagtacaacagttgagcgaccacttacaattcctacagaagcaaaagcgtgttgtcctgtagttgtttgttgttttaaaacaactgtgccatcgcccacttttagcgaacctttattatctcctcttccttcaacaattagctttcctttaccaattttagctaaacgatcaaattgagggttatgcactttccactttactgtttttccttcagcaacagatataccagcccctttccaagtcgtattttctgaagtgcctttaacttcataatcaccttcaaagaacaatccgcctgcaccttgatcgatattattatttaaggtaaggtttccacttccttcaaacgtaacatttttcccatgattgagatttttattatccactaaatcaacacttaatgattcagatgttccagatatcaagcttgtattacctttgcttgtccagttatattgcgtattacctttcagtaaaccagcactgtcttttttgagaatattttcagcaaattgtggtttataaatattccattcttgccaagattttttcttataccctccccaaaaatcataagcaccaaggaaaagccatttctctttagatttatcataaacaaataacggtgagccactatctcccaagacagcataattagtaagcggtttacgagataatatctcttttggatcgttatgatcttcggttgaatcaccaaacccaatgagtccatcgtctgtatgattcactttataaggcgtgcctgcaataccataggtataagcgttaccaactaatttaagattatctccacctacatcccatctgtgtattatttcctttttctcgtttttctcttctaaaattaattcataatggcttccttttttatagataaattgagagccacttcctaatctcacaaaagcaggatatttattctgatcattatatgttccagcatcactacttgtagttgaagcctctatcggtgcaacttcggtaacaaatttatcaaggcgtggcatataataatcttcacggcgtttttggttttgctgttctttaactaaggcttgtccatataattcggaaggaacatcttttttattagatgtatactgtttatctttttcgttattttgtgtttttccgtttaattcagaagaaaaattatttttttcaacagtgtaatatctgttttcctcccaagatacatctcgatgctgaatagaatttccaaatttagggttccaattcccatttaaattcccaaaatgtagttcacccacaccgttaccaacgtgttttacccccacaacatattgtggatttaccaacgtggcaattctcttatctacatccacagcactaaaatcaatcatcggaatatctttaggtagcgcactgcccaaattattatttttgttatctctcacttccacatttgttgcaccaacagaaaacttccctttattctctgcaaaatcacgaaatatttgataatccacatcgtttctcactaacgcggcttctgtataaggggttaatgcgtaggcgacagtaagcgcaataaaattgagtttgaattttttatttagcatagaagctgtccttattaattaagtttaaaaagtagatttgatatacagctacaagttgattcaaatcttggctgtgttgcgttgatagtttgcaagttgtcttcatttttataatgagtgggttttatagcataaatcgctcaaaacttgaattacatttattaggtaatgataatgatttttgatattttttaaaaaattggcgtattttttaccgcacttttggttaatttaaggcgttaatgatgccattatggacagaaaacatttttttgttttccacttgcatttcttttagttgtctttgagtgatggcggtaacaaatacttgcgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatacacacattaaaagtttaagctgtccacgagaaagcacatcttcaacaggcaatccttgtgctttgaaacgaaaatccgctttttgagggccagaaaaggtgtaatttaaggcacgatctcgttcaaaattttgttgaagaatttcataataatcagcatttttttcccacccttgatgaaagctgacattaatttctaattcaggcagaaaaagttggcaagtttgttcaatttcagggcggagagcttctgcatattcggcacgccattgacttacttggtgggcaagtttggcaagttcaacgtcccaaatttttatggcagagtaaggctgattttgtgcgagtgcggcatttcgttgtttaagtaatcggttgagattgctccaagcggaatagaaacttgtttggtggtggaataatccccaatctaaaaacgcacgacgataacttggcccaccgttgagtaaggttaagccctctggcgtgattaattgcattggtaaaagatgggctagatcggaaattttattgccatcttcgccgttaatttttactaaggtgttgccttgacgaagtttttgtaagccgacagaccattgatgttggctttcttggatttgtccaaatagggtaaagtgcggttcgtcgtaagaaatgatgcggtttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcgcattcgcacttgattacatttaagtgcattcagcacatcaagaatataggtgacattaaagcccacttctaattcttcgccattgtaattgacatcgacaatttcttctgcttcttcgtgttctgtgtttgaggcagtaattttaagctggttttcctttaagcttaaacgcacgctgcgcgctcgttcattagataaaatggacgcacgaacaaaagcctgtttcagcatttcccaattgccttcgacagtttttgtggcattacgaggcaatactcggcgatagtcaggaaagcgaccatcaattaattttgatgtaaataccgtgttttttaaatggacacgtaaattgttggtgccaatttgtaaacgcgctggttcatcgtttgtttctaataaacgaaccagctctaacacacctttacgcggtaaaatcacagaatgattttgtaattcttgttcaagggaaatggtacacaccgcaagtctatgaccatctgttgccaccgttcgcaataaattgccttctgtttcaaacttcataccatttaagaaatagcgcgcatcttggtttgccatagaaaattgagtggcttcaattaaacggcgtaaggtattttgcggtagttgaaaatccacttcagactgccaatccgtgaggtttggatattcttcggcaggttgggttgtcagcgtaaaacggctacgcccagactgcactaaagcacggtcttgttcaaaagtcaccgtgatttctgaatcatcagataaagtgcggcaaatatctaagaatttttttgctggaatggtaaaagtgccattttcagaagacgatgaaagctgagtttgactcgataattcgacttctaaatctgtaccagtgatagtcagacgattgtcttcaatttgcaacaatacgttgtttaatacaggaatatttggacgattactcaatacgccacatacttgttgcaacggttttaataaattttctcttgaaatgctaaattgcattgcgttctccttttatgcaggatttattgtatttcttggctccacccatttctggggggagctgccgaaggctgaggggggattaaccagcccccttccgccctatgggcaccttcccccgcaagcaggggaaggcaaggtatttgtctagcgaaaagttctttgctgttttatatctttttcaattttagattatgcggacaaagtgcggattaaattcgcccaatcttcttgaatgctattgtcttgctcgcggaattttggcacttcacggcaagcgtttaatacggttgtgtgatcacggtcaaaggcacgaccgatttcaggcaaactgcggtttgttaattcttttgctaacgccatggcaatttggcgagggcgagtgactgaacgcgcacgactttttgattttaaatctgaaaccttaattcgataatattcagccaccactttttgaatattttcaatagtaaccaagcgttcttgtaaagccaaaatatcttttaaggtatcacgcacgaaatcaatatcaatgtcaccgcctttgaagtcttgcattgctttcactcgatttaatgcaccctcaagttcacgcacgttggtacgcaagcgttgagcaatgaagaaagcaacttcttctggcaagttcatattatgttcttccgcctttttcaataaaatcgctacgcgagtttcaagatcgggcggttcaatggctgttgttaagccccagccaaaacgtgattttaaacgttcttcaattttttcaatttctttagggtaacgatccgaagttaagataatttggcgacccgtttcaaataagttattgaatatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgcgcattcggtttatcggctaaaatgccgttgccaatggcgtgtaacaagtgagttttccctaaaccagtgccgccatataaaaagaaaggattagccgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatatatttggcgtattttctactactttaggtgcaggcttgaccccttcttttaaagaaatacgcagttcaggattttgtgtaagtgtttgacaaatttgctggatttgtgcgagataatgggtttccacccaacctttcacaaacatattagaagcatataaaacaatgtggttatccgccaccacatcagcctgtaaaggacgaagccaagtgctaagatcgctggctgaaacttgatcttgaagttgtaacaggcaactttgccaaagatttgagagattcacaaaaggatccttgttgtttttattataaaagtgcggtcaaaattgtcggagattttacaataaatgtgtgaaaagatcttctaaaaaatctagtgttgagttttcatttcataagattatagaactgaaaagaaatgcgccagtgcgatatagatagcgtgcttaacctgtctggcgcattttaatttagaatttcatttctaatgttaaggtatagtttcgtcctgatgctgcgtagcgagtataattaccaacattttgatgttgattgaccgctccttgtgctgtttgacgcaccgcttcccaagtgacatagcgatagtttaataaattatatactcctaatcggaacaaaatacttctattcaccatgtaataacccgatacatctaagatatgccatgcccgagtaagttttcttgttgattttacaccccttgaagtgttacctaatgaacgttgtcctagcaattcattttgagattttgcttttgattgagtaaacattgtattaattccccaagtattacttggatgatcatagcctaaaccaatgatataacggctgggctgaatggcatcaaataaataactgcttacggaggctaaaccagcattgattttttgatctttaacttttactcggttataagcaaatgttgcataccaaccgtagggaatacgtttccataaaccattaaaatctaattgcgcagttatatttacgccaactaattttgcattttgtgcattatgatatccataattgcccttgccctttccatttttaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccatccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataataatttttccctttaattaaccgcactttacagtcactataattagaggagctaccttgataattacaatgatctcgtcctacaaaagatgcatttggttttgggtataagtaaggttgtaatttgaaaccatttcttcttggtgtttcaccaggtttctctgaaatactctttgccgtagcggtaacacgtcgagttaaataatctttatgctgaagcgctgaagtaaagtcatcaaaaccaagattgaagacaatttgatgagtaagccaattttgttgaatttttttctctaaattcaattgcaacatattatgtttttctttataaacatttctatcagaatgatagtatgaataaggtttatcaagtgttgggcggcaattcttacttggattaggataaagactgcaatgtgtatgttgcatataactgtcaagtataatgttttgttgattagcacttaacactgctttgtcaatgattcccgctttgttcttattttcgtaaatatattcaatacctacacgctgttttctatggtgttcatcgaaataaagcccacttgcatatttaacgcctcggccatcctcaatacgttgatatgcaccataatcttgctttggataaaaagaactattttctaaatccggtttttctgttgatcttaaataagcgggaaatgtcatatcacggatatcaaatttttgttgtgtgaattcaaaaataccaccaatataatgttgttcagaaaaatgatagcctcctcttaaaaaccaagactggctttcatatttcattggattaggtttgatacggttagcccccgtataatctgaaacgcttacggtttctctttgggaggataacttcgcaggtggtttggctgaaggtatacaactgttataatcctttggacactcatcttccatcacaaagtatgcattagatccatcttctttggcgattaatcgattataactttgcacgccttttaatgcatctttatggacttgggtttcaattgaatttcgttgagtgtaaatagcaagtccttcaaatccaccttgttttcctgctacagctaaagaatgggtaaagcctttatttttgcttgaataagcatttttagtttgaattccccatgatttgtctccttctaagatatcggctgcggatttgctttgaaatgttacagaaccagctagtgctccattaccatactcagaagaactcccccccttgcttatttcgacggcctttacattttcatattcaatttcattaattgcaccagtgccagaatatcctgaacgagcaactaaagggctttgcactacataagattgcgtttgaggtaaaccatctactaataaagcaactctatttctgtccataccacgaatagaatatccagaacttgcaccgcgaccttgttctacaactgaaatccctggatcatagcgtgttagatcacgaatatttaatacttgttctcggctgatactttcactagttttgataattttgccaagtccagttacttcattatctttacgatctcttactttttctgcagtgactgagatagtttctaattctgaatcttctgtactttgagtgtccacttcagatgatatagcttcttttgtatcttttatactttgagtttctgcttttacatagcatgaaattaaaagacaagaaataatacttaggcgaaaatagggttttttagtcatttttagtattccattatttgtttttttctacttgttggttgtttctacttgttggttttttctacttgtcttttagctccaaagacaactgcagctcttgcatttggtgaattgggtggtgaaggtacggttgaggaactttcagaatttgtagctgtaggattgtttccgttataggtgaaataaccgcctaattctgtagcgtgcggaccataaaatgccccgtttactgttgtcgtgaaattgactttagatgtggcttgtgtatttttgggatcaatcactacatttgcggttgctttaccttcgaaggcattactaccatttttaaaggttgcctcaatgttaaacacggtattttgtgagtcggctcgttttaatttgcctgttaatgttttattgtcaaaattgacatcaaactcggcgggagcatttttatcttgttgtttatttcctgtagtggagtaagatgtcttgtcatcaccaatataaccaaaccaactaccgagatatttcacgtttcccgttacaggaatttgagaactgggagtacggagacctaacaaaaattggtggtattgtcctgtttgatttgtgtttttcttctctttatcctcataatacataccaaattttacatagcttagattcttgcaacatgcttctactttataggttttatttccaatatcgtgatgtttactcgttacgaagtcatcagtatccccttcagggaaaagaggaacagggtaattatcaattaaaaggtaatcagcttcaccaaaacttgatatatcttttgtcgtaaagtttttttcatcggtttttacatcggctgttgtactggctgttgtactggttgttgcatcggctgttttagtagagaaagtaattagcttgccatcaattaaggtttctttggataatttttccttttctgtttctggcgtttctttggcactaaataccccaaaaactcgtttatccctagctaagaatttaccccctagttcttcagcattaggtccataaaaaccaccttctaatgttccctcgctggtaaagggatgttcatccgatgtggatttcgtaggagtaactttacccctgaatctattactataaatatgggcatctatatcatagagtttttccttttcatattgttgaatatcagtttttcttttggtgtaagacagttgtcctgtcagttttttagtcccaaaatctgcactaaattcacttattaagcctatatcaccattctttgaattattttctaaatcaatatctcctcgagtagcactacgtcgaaaataagcttgacctctagcattactgaacaaagaataattttggccatatttagttgcagtgatgaaatcccaagttcctttatacgttgctacaccgcttactggcaagtctgttgcagttttattaccataataaaacgcataaccataatggccactataggcttttttttctgttgctaatttggaaaagtctttccaattctcaatatagtacaaaccagaataaacgtatttttgtaaattggggtcttgtaatgctctattaggttcaagcccaattggatttgtatgtattttattttctgttttaacatttttaacatcatcttcaatcgtagaaggtgaggaaaaatatgatatatagccattttcatttaagaaactaggttctttattaccactcagattctgagccactaacttcatccctcctcctaaagaaggaatggacaacttttccaaattagattttgttcttgaacttgaagtatcgtcttgataacgtggtttagaagaggagggattagagacgtcatctacatcaaaagaaccacctcccccgctacaagcgcttaataaaaaggaaagtccaccagtgataagaggtacagatttcatagaattaatacttatacaaaattgataataattcgcattattgttctttttttgtaataatgtcaagttagagttttttaagaatatggataaaatatgaaaaatggcgtaaaacaaatttctttcttatcattaataggcttatcattaataggcttatcattaacgaatatagcttgggcaaaagttgcacgtcctaaaaatgatacactgacaaatacgattcaaagtgcggaattaaaaacctcctctttttcctctatgcctaagaaagaaataccaaataggcatattatttctctttccaaaagccaattagcacaacatccaagacttgttttgcgtgggttaattcttgctttatatcaaaataacactcaggcagttcaactgttattaccactatataaacaatttcctcagcacgataatttcttactcacttgggcaaaggctattgacgcgcgtgaacaaggtgatttaactcaatctattgcttattatcgtgaattattcgctctagacgcatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtagttggaccgcttgggaaaaagaaagtgggaaggggggtagggtattctttatcagtagaaaaaaatggccatgggcagatcatttttttagtaaaactatgtttaatgggaatggaaaatattattgggataataaaaaatacaatgaggctactttgcgtataggtggtggtttaggttatcaaactgccttagttgaagtctcgttgtttccttttcaagaaaagcgttggtatgcaggcggtagctctggaacgaatacaatgaagcaatatgcggataaattgggtattcgtttagaaaacgtagattggctaagtaaaacttggcaaatttctaccgcacttgagtatggagaatctcgttataaaatccgaaaacatttagatggtaattattatttcatttcatcaacactattttatttacctaaaagcactcaattttggtttgttggcatggattttcatcgagaaaatacacaagcattagataatgcttatcaacaaaagacattgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattttaaggttgtaaactaactgttgagttatctctaacattgttaaagtgcatacactatatttttaatattagtttgaaattttttaaaaaatttctgtttcttatttgacgaacgcgcattttatgactagaattgcaccctattttattcactcttaattgtatttaggtaaattaaaatgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgcataatcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatcttaattaagattattcgtctttatcaaattatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagaaaaaataatggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtatctaactggggtttagcgattatctgtgtaacaattgtagtgaaagcaattttgtatcctcttacaaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggtttagagaaaaaagggttgcattctcgtaaaaaatagtcacgaacaggcaaaaagaaaggcacggaatgtgccttttctttattttactgccgtgggtatacctaccctaggtagtagtgtacctaccctaagcaatcaaccgtgggtaagtatacccacggttaattatagtaataatagttcccctttggggaacgtcaagctctaccccaaaggggtagcactaggataaacactagggtatacttaccactaggtagtagtgtacctaccactaagcaatcaaccgtgggtaggtatacccacggttaattatagtaataatagttcccctttggggaacatcaagctctaccccaaaggggtagcactgggataaacctagggtatacttaccctaggtagtagtatacctaccctaggtagtgtgtacctaccctaagcaatcaactgtgggtaggtatacccacggttaattatagtaataatagttcccctctggggaacgtcaagctctaccccaaaggggtagcactgggataaacctagggtatacttaccctaggtagtagtatacctaccctaggtagtgtgtacctaccctaagcaatcaaccatgggtaagtatacccacggttaattatagtaataatagttcccctttggggaacgtcaagctctaccccaaaggggtagcactaggataaacctagggtatacttaccctaggtagtagtatacttaccctaggcaatcaaccgtgggtaagtatacccacggttaattatagtaatagtagttcccctttggggaacatcaagctctaccccaaaggggtagcactgggataaacctagggtatacttaccctaggtaatatcatatttccccagacaataataggttttttatgaaagaaacaatcgttgctcaagctactgcaccaggtcgtggtggcattgggattttaagggtctcagggcctttagcaacaaaagttgctcaagctatattaggtaaatgccctaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgacggaatccgtttggcgagaccaggcgagttttctgaacaagcttttttgaatgataaattggatcttgctcaagcagaggccattgcagatttaattgatgcaacatcagaacaagcggcacgctcagcattaaaatcattacaaggcgagttttctaaaaaagtaaatgaattggttgattctgtgatttatttacgtacttatgtagaagcaagcattgattttcctgatgaagaaattgatttcttggcagatggaaaaattgaagcaaatttacgcggtattattaatcagctagaaaatgttcgttctgaagctaaacaaggttctattttacgtgaggggatgaaagtcgtgattgctggtcgcccgaatgcaggcaaatcgagtttgcttaatgcacttgctggtcgcgaagcagctatcgtcacggatattgcaggtacaacccgtgatgtattgcgtgagcatattcatattgatggtatgccattgcatattattgataccgcaggtcttcgagatgcaaccgatgaagtagagcgaattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaattattagtctttctgctcaaacgcatgatggtgtaaaacttttacgtgaccatttgaaacaagcaatgggttttcaaacaggtatcgaagggggatttttagctcgtcgtcgtcatttagatgcacttgagaaagccgcagagcatttacaaatcggtttggttcaacttacagaatttcatgcaggagaacttttagcggaagaattacgcttagttcaaagctatttaagtgaaattacgggtcaattcacatccgatgatttacttggtaatatttttagttctttctgcattggaaaataggaagcgtaaagtgcggtcattttttggcaaaaatttaaatcaaaagtggcaatatttggtggtgttttgttgataggaattggtattagctggctttgtgagcatggagttttcactttttaagatgctaattttttacgtttagattataatcaggaaaattttatatttataacaagggttatagaatgttaattgaaaaaatgcacaatttaacaaactcaaaggtttctaaatttatcttaggtttgattactgtatcgtttttagttggtggaatgtctggctatctttttagctcaaatgatacttatgcggcaaaagtgaacggcgaagtgatttctcaacaagattttttaaatcgctataatcaagaatttgaaatacgcgcacaacgtgagggagaggcgtttgtggctcagtcagattctcctgaatttgttaccgcacttcgtcaaaacatcgtcaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagtgcagaagttttctttcaaaagcgtttagctcgtttagcaactttatctcttgaagatgaaatggcaaaacaatcagtctctgatgatgaaatcaaaacgtattatgaagctaatcaaaagtcttttgttcagccagagcaggttaaagttcagtatattgatctttctgcagataacatcagtagaaatcttcaagttacagatgtagaaattgcgcaatattatcaagataataaagcacaatttatgactcaacatttagcacatattcaatttgcaaatgaacaagatgcgaaagtggcttacgaggaattacagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttaatggagagtcgttatttttctttagaaaaacaagcgagtgataaggcttttgaagacagtaagtctcttaatactgcagcacaagcagcaggtgttaaggttcaagagagtgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatcgatattgaaactttcttaaaacgtcagaaagctgagaatgcgcttaatgaaaaagcacaacaagcagtgaaaaaattaagtgaaaaccctgaatcaaaagtagatggcattaatttctcaagtgagcagacttttactttaagtgaaaataaagatcctattttaacaaatggtatattttcaattgctaaaccaaaatcaaatgaagctctttatcaagtggtgcataattcaaatggcgatgtggttgttgttgccttgaataaggttgaacaaggcagtttaagtgaaaaagaattgtcgcaatttggtatgcaattattgcgtagtcatcaatctgaattacaatttcagttaatacaaggattacgtgagagagcaaaaattgaggtaaatgactctttcatcaatcaagatgatgaagtgcaacaataacaggttaaatgataatttgagataaattttgctcaaaagtgcggtaaatttcaccgcacttttttacttttgtgcaaaaggaagttaatgatgtttgggaaagaaataattcattctaaaacaatatggttttattttttgttgtttctcttttccatatttaccaatatgggattaggcaatgtattaagtgagaatattcccgtttcagattacgcaattttatttgttatcacggcgatttctttttattttaccccttggcttgggcgaatattaattactgtattattcctcagtgcgctattttattgctctgctggttttttctatggaattccatctttggggattatcgcttctgtttatgaaacgaatattaatgaaaccttagaatattacacaaccattcctttttggatatttttatttcaagttagttatatcattttatttgttgctttaatgaaattaagtttttatgttaaacaacaagcatttaaatggctaaatatggttgttatcagcctattattagttttttcttataatcaattttctaattggaactacgcctataaattccgtttttatccagttcttttttattctgaatttgatcgaatgaatgatctatatttagaacaacgagattttctaaatcaatccgttaatgcgccgtctcaatgggatattcaatcttttacgccaaaatataaaaattatattttaattattggtgaaagtatgcgaaaagattatatgtcgttatatggctttccactgaaaaccacgccatttttagagcgtgtgaaaagcacagtttttgaaaattattattctgcagcaccgaatacgcaaccgtctttacaacacaccctatatcgagcagataaaggagaaacggtttatacggataatattatttctttagccaaaaaagcgggcgtgaaaacttattggatttctaatcaaggcaaaattggggaatttgatacgatggcctctcgtattggtcaaagtgcagatgaaacgatttttatgaagccgttaggttataactctaaaaaagtttatgacgatgaaatgttgcctgtattagataaagccttaaaagaaaatattacgaatccaaaattaattgtgattcatttaatgggctcacatccagccttttgtgagcgtcttccgtacgaagttaaaaattattttattaatcaatctatgtcttgttatttagaatcgattaaatatacggatcagtttttagaaaaattaaattcgcagttagtatcgcaaaatgaaccctattcggtgatttacttttctgatcatgggcttgctcattatgaggattctgaaggtttatcattgcatccaaataatctttataaacaaaattatgaaattcctttcgttatgttttcgagtgatagtaaaaagctagaaaaaataaaaacgccacaatcggcatttaattttgtttatggttttgctgattggatgggaattaaggaaaaacatttacaaggcgtggatttcttccatcctgaaaaacaggaaattaaagtatttgattggaataacgttgtaaatgttaaagagttggctgatgatccagcaaaattaccagaagccgttcagtaaatgagatcgtgctttatcatttatcggcttgtgctagaattagcggaatttttttaaaagggaaatagtatgtccaaaaaatcagggctttcatttttatggttaagtgcggtcgctttcgtggttgatttgcttacaaaatacattgtggtacaaaaatttgatttgtatgaaagtgttaatgtgctgcctgtttttaacctgacttatgttcgaaattatggcgcagcatttagtttcttagcggatcatagtggttggcaacaatatttctttattttgttggcattggctatttcaggaatgttggtctattttttagcaaaaaataatgccgaacaaaaaatccaaaattctgcttatgcactgattattggtggggcgttagcgaatatggtagatcgcacttacaatggtttcgtcgtggatttctttgatttctattgggatatttaccattatccagtatttaatatcgccgatattgccatttgtattggcgcagggttattagcattagatgcgtttaagagcgaaaagaaaaaagtacaagataaacaagtagaaaagtgcggtcaaaaatgaagataattttagccaatccacgaggattctgtgccggtgtagaccgtgctattagtattgttgaactcgccttagaaattcatggcgcaccgatttatgttcgtcatgaagtggtgcataaccgatttgttgtgaacggattgcgtgatcgtggtgcgatcttcgtggaagaattaagcgaggtacctgatggtgcgatcgtgattttttctgcgcacggcgtatctcaagccgttcgacaagaagcgaaagaccgcaatctcaaagtatttgatgcaacctgtcctttggtgaccaaagtgcatatgcaagttgctcgtgcaagtcgaaagggaacaaaagcgattttgattggacataaaggacaccctgaagttgaaggcacaatggggcagtatagtaatgaagatggcggaattttcttgattgaaaaagtagaagatattgcacgtttgccaatgcaagacaatgatgatttaacctttatgacgcaaaccactttatcgctagatgatacagcagaaactattgctgcattaaaggaaaaatatcccgctattcaagggccacataaaaacgatatttgttatgcgacaaccaatcgtcaagaagcggtgcgagaattggctaaattatcagatttagtgttggttgtggggtctaaaaactcatcaaattcaaatcgtttaaatgaattggcgtctcgaatggggattaaatcacagcttcttgatgatccttccgatattcaagatgattggtttaatgatgtaaaaaccatagggattacagctggcgcgtctgcaccagaagaattagttcaatcgattatttcccgcttaaaaaagtttggtgcggatatatagaagggctgcaaggttaacggaatccgagtctgtattccgccaacat

(The sequence listing continues in the following parts.)

What is claimed:

1. An isolated polynucleotide comprising the nucleotide sequence of SEQ ID NO: 970.

2. A method for detecting NTHi bacteria in a biological sample comprising
   (a) contacting a polynucleotide of claim 1 with polynucleotides from a biological sample under stringent hybridization conditions, wherein the hybridization conditions comprise washing with 0.015 M sodium chloride, 0.0015 M sodium citrate at 65-68° C., and
   (b) detecting hybridization of the polynucleotide within the sample, wherein hybridization indicates the presence of NTHi bacteria in the biological sample.

3. The method of claim 2 wherein the biological sample is selected from the group consisting of serum, sputum, ear fluid, blood, urine, lymphatic fluid and cerebrospinal fluid.

4. A vector comprising the polynucleotide of claim 1.

5. The vector of claim 4, wherein the polynucleotide is operatively linked to an expression control sequence.

6. An isolated host cell comprising the vector of claim 4.

7. An isolated host cell comprising the polynucleotide of claim 1.

\* \* \* \* \*

UNITED STATES PATENT AND TRADEMARK OFFICE
CERTIFICATE OF CORRECTION

Page 1 of 1

PATENT NO. : 8,283,114 B2
APPLICATION NO. : 11/917368
DATED : October 9, 2012
INVENTOR(S) : Bakaletz et al.

It is certified that error appears in the above-identified patent and that said Letters Patent is hereby corrected as shown below:

In the Specification

Column 1, Line 13-16 delete

"Scientific work relating to the invention was supported by Grant Nos. R01 DC03915 and R01 DC005980 from the National Institutes of Health. The United States government has certain rights in the invention." and insert --This invention was made with government support under Grant Nos. R01 DC03915 and R01 DC005980 awarded by the National Institutes of Health. The government has certain rights in the invention.--

Signed and Sealed this
Twenty-fifth Day of March, 2014

Michelle K. Lee
*Deputy Director of the United States Patent and Trademark Office*